US012583896B2

(12) United States Patent (10) Patent No.: US 12,583,896 B2
Baker et al. (45) Date of Patent: Mar. 24, 2026

(54) CAGED-DEGRON-BASED MOLECULAR FEEDBACK CIRCUITS AND METHODS OF USING THE SAME

(71) Applicants: The Regents of the University of California, Oakland, CA (US); University of Washington, Seattle, WA (US)

(72) Inventors: David Baker, Seattle, WA (US); Scott Boyken, Seattle, WA (US); Hana El-Samad, San Francisco, CA (US); Marc Lajoie, Seattle, WA (US); Robert Langan, Seattle, WA (US); Andrew Ng, San Francisco, CA (US)

(73) Assignees: THE REGENTS OF THE UNIVERSITY OF CALIFORNIA, Oakland, CA (US); UNIVERSITY OF WASHINGTON, Seattle, WA (US)

( * ) Notice: Subject to any disclaimer, the term of this patent is extended or adjusted under 35 U.S.C. 154(b) by 997 days.

(21) Appl. No.: 17/419,236

(22) PCT Filed: Jan. 6, 2020

(86) PCT No.: PCT/US2020/012355
§ 371 (c)(1),
(2) Date: Jun. 28, 2021

(87) PCT Pub. No.: WO2020/146254
PCT Pub. Date: Jul. 16, 2020

(65) Prior Publication Data
US 2022/0119467 A1 Apr. 21, 2022

Related U.S. Application Data

(60) Provisional application No. 62/789,418, filed on Jan. 7, 2019, provisional application No. 62/850,336, filed on May 20, 2019.

(51) Int. Cl.
| | |
|---|---|
| *C07K 14/47* | (2006.01) |
| *A61K 35/17* | (2025.01) |
| *C12N 1/16* | (2006.01) |
| *C12N 5/07* | (2010.01) |
| *C12N 5/10* | (2006.01) |
| *C12N 5/16* | (2006.01) |

(52) U.S. Cl.
CPC ............ *C07K 14/4705* (2013.01); *C12N 1/16* (2013.01); *C12N 5/06* (2013.01); *C12N 5/10* (2013.01); *C12N 5/16* (2013.01); *A61K 35/17* (2013.01); *C07K 2319/02* (2013.01); *C07K 2319/70* (2013.01); *C07K 2319/71* (2013.01); *C07K 2319/715* (2013.01); *C07K 2319/80* (2013.01); *C07K 2319/95* (2013.01); *C12N 2501/60* (2013.01)

(58) Field of Classification Search
CPC ............ C07K 14/4705; C07K 2319/02; C07K 14/7051; C07K 14/435; A61K 35/17; A61K 48/00; C12N 2740/16043; C12N 15/63; C12N 15/86; C12N 15/79; C12N 15/85; G01N 33/5047
USPC ........... 435/455, 366; 536/255.1, 23.1, 23.4; 530/324, 358
See application file for complete search history.

(56) References Cited

U.S. PATENT DOCUMENTS

| | | | |
|---|---|---|---|
| 7,574,306 | B1 | 8/2009 | Baker et al. |
| 2016/0202256 | A1 | 7/2016 | Church et al. |
| 2017/0198363 | A1 | 7/2017 | Medford et al. |
| 2017/0369892 | A1 | 12/2017 | Klavins et al. |
| 2019/0002578 | A1 | 1/2019 | Brayshaw et al. |

FOREIGN PATENT DOCUMENTS

| | | |
|---|---|---|
| CN | 106103475 A | 11/2016 |
| WO | WO 2009/114506 A2 | 9/2009 |
| WO | WO 2014/124301 A1 | 8/2014 |
| WO | WO 2017/173356 A1 | 10/2017 |
| WO | WO 2018/191032 A1 | 10/2018 |
| WO | WO 2018/206791 A1 | 11/2018 |
| WO | WO 2020/018935 A2 | 1/2020 |

OTHER PUBLICATIONS

Bretones et al. 2011, Journal of Biological Chemistry, vol. 286(11), 9815-9825. (Year: 2011).*
Ferrell & Sears 2014, Cold Spring Harbor Perspectives in Medicine, vol. 4, a014365, 1-16. (Year: 2014).*
Gur et al. 2004, European Molecular Biology Organization Journal, vol. 23(16), 3270-3281. (Year: 2004).*

(Continued)

*Primary Examiner* — Anne Marie S Wehbe
*Assistant Examiner* — Katie L Pennington
(74) *Attorney, Agent, or Firm* — James S. Keddie; Bozicevic, Field & Francis LLP

(57) ABSTRACT

Provided are molecular feedback circuits employing caged-degrons. Aspects of such circuits include the use of a caged-degron to modulate the output of a signaling pathway in a feedback-controlled manner. Also provided are nucleic acids encoding molecular circuits and cells containing such nucleic acids. Methods of using caged-degron-based molecular feedback circuits are also provided, including e.g., methods of modulating a signaling pathway of a cell that include genetically modifying the cell with a caged-degron-based molecular feedback circuit.

11 Claims, 38 Drawing Sheets
Specification includes a Sequence Listing.

(56) References Cited

OTHER PUBLICATIONS

Matsumura et al. 2003, Cell Cycle, vol. 2(4), 333-338. (Year: 2003).*

Yuan et al. 2009, Journal of Cell Biology, vol. 185(2), 203-11. (Year: 2009).*

Bonger et al. 2012, Nature Chemical Biology, vol. 7(8), 531-537. (Year: 2012).*

Jungbluth et al. 2010, BMC Systems Biology, vol. 4: 176, 1-12. (Year: 2010).*

Chakravarti & Wong 2015, Trends in Biotechnology, vol. 33(8), 449-461. (Year: 2015).*

Miller et al. 2016, CA: A Cancer Journal for Clinicians, vol. 66(4), 271-289. (Year: 2016).*

Arellano et al. 2016, Discovery Medicine, vol. 22(119), 73-80. (Year: 2016).*

Jensen et al. 2009, Cell Stem Cell, vol. 4(5), 427-439. (Year: 2009).*

Ordonez-Moran & Huelsken 2012, The European Molecular Biology Organization Journal, vol. 31, 2064-2066. (Year: 2012).*

Khatib et al. 2016, Stem Cells and Translational Medicine, vol. 5, 694-702 (Year: 2016).*

Boyken et al., "De novo design of protein homo-oligomers with modular hydrogen-bond network-mediated specificity", Science, 2016, 352(6286): 680-687.

Langan et al., "De Novo Design of Bioactive Protein Switches", Nature, Jul. 24, 2019, 572(7768): 205-210.

Ng et al., "Modular and tunable biological feedback control using a de novo protein switch", Nature, Jul. 24, 2019, 572 (7768): 265-269.

Drobnak et al., "Designed Protein Origami", Protein-based Engineered Nanostructures, Advances in Experimental Medicine and Biology, 2016, 940, DOI 10.1007/978-3-319-39196-0_2, pp. 7-27.

Heal et al., "Applying graph theory to protein structures: an Atlas of coiled coils", Bioinformatics, 2018, 34(19), 3316-3323.

Lapenta et al., "Coiled coil protein origami: from modular design principles towards biotechnological applications", Chem. Soc. Rev., 2018, 47: 3530-3542.

Rhys et al., "Navigating the structural landscape of de novo a-helical bundles", Journal of the American Chemical Society, 2019, 141(22): 8787-8797.

Rink et al., "De Novo Designed α-Helical Coiled-Coil Peptides asScaffolds for Chemical Reactions", Chemistry 2019, 25(7): 1665-1677, abstract only.

Roybal et al., "Precision Tumor Recognition by T Cells With Combinatorial Antigen-Sensing Circuits", Cell, 2016, 164: 770-779.

Slope et al., "De Novo Design of Xeno-Metallo Coiled Coils", Chemistry—An Asian Journal, 2016, 11(5): 660-666. https://doi.org/10.1002/asia.201501173.

Son et al., "Design patterns for engineering genetic stability", Curr Opin Biomed Eng., Sep. 2021, 19: doi:10.1016/j.cobme.2021.100297, 13 pages.

Stone et al., "Context-dependent redesign of robust synthetic gene circuits", Trends in Biotechnology, Jul. 2024, 42 (7): 895-909.

Thomas et al., "De Novo-Designed α-Helical Barrels as Receptors forSmall Molecules", ACS Synth Biol., Jul. 2018, 7 (7): 1808-1816, abstract only.

Truebestein et al., "Coiled-coils: The long and short of it", Bioessays, 2016, 38: 903-916,.

Varshavsky, "N-degron and C-degron pathways of protein degradation", PNAS, Jan. 2019, 116(2): 358-366.

Wood et al., "Tools for Protein Science, CCBuilder 2.0: Powerful and accessible coiled-coil modeling", Protein Science, 2017, vol. 00:00-00, pp. 1-9.

Cromm et al., "Targeted Protein Degradation: from Chemical Biology to Drug Discovery", Cell Chemical Biology, 2017, 24: 1181-1190.

Faden et al., "Phenotypes on demand via switchable target protein degradation in multicellular organisms", Nature Communications, 2016, 7:12202, 15 pages.

Furukawa et al., "Synthetic biology: lessons from engineering yeast MAPK signalling pathways", Molecular Microbiology, 2013, 88(1): 5-19.

Mcisaac et al., "Fast-acting and nearly gratuitous induction of gene expression and protein depletion in Saccharomyces cerevisiae", Molecular Biology of the Cell, 2011, 22: 4447-4459.

Taxis et al., "Efficient protein depletion by genetically controlled deprotection of a dormant N-degron", Molecular Systems Biology, 2009, 5:267, 7 pages.

Trost et al., "Regulated protein depletion by the auxin-inducible degradation system in Drosophila melanogaster", FLY, 2016, 10(1): 35-46.

Gao et al., "Programmable protein circuits in living cells", Science, Sep. 21, 2018, 361(6408): 1252-1258.

Chen et al., "A Barcoding Strategy Enabling Higher-Throughput Library Screening by Microscopy", ACS Synthetic Biology, 2015, 4: 1205-1216.

Elowitz et al., "A synthetic oscillatory network of transcriptional regulators", Nature, Jan. 2000, 403: 335-338.

Fivaz et al., "Specific Localization and Timing in Neuronal Signal Transduction Mediated by Protein-Lipid Interactions", Neuron, Oct. 2003, 40: 319-330.

Gardner et al., "Construction of a genetic toggle switch in Escherichia coli", Nature, Jan. 2000, 403: 339-342.

Landschulz et al., "The Leucine Zipper: A Hypothetical Structure Common to a New Class of DNA Binding Proteins", Science, 1988, 240: 1759-1764.

Teruel et al., "Translocation and Reversible Localization of Signaling Proteins: A Dynamic Future for Signal Transduction", Cell, Oct. 2000, 103: 181-184.

* cited by examiner

Native Input
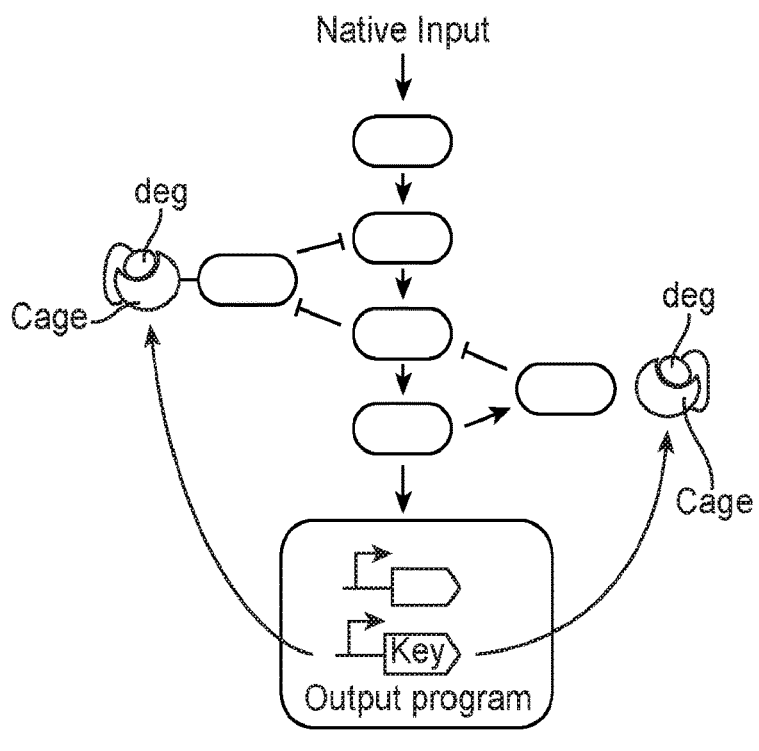
FIG. 5
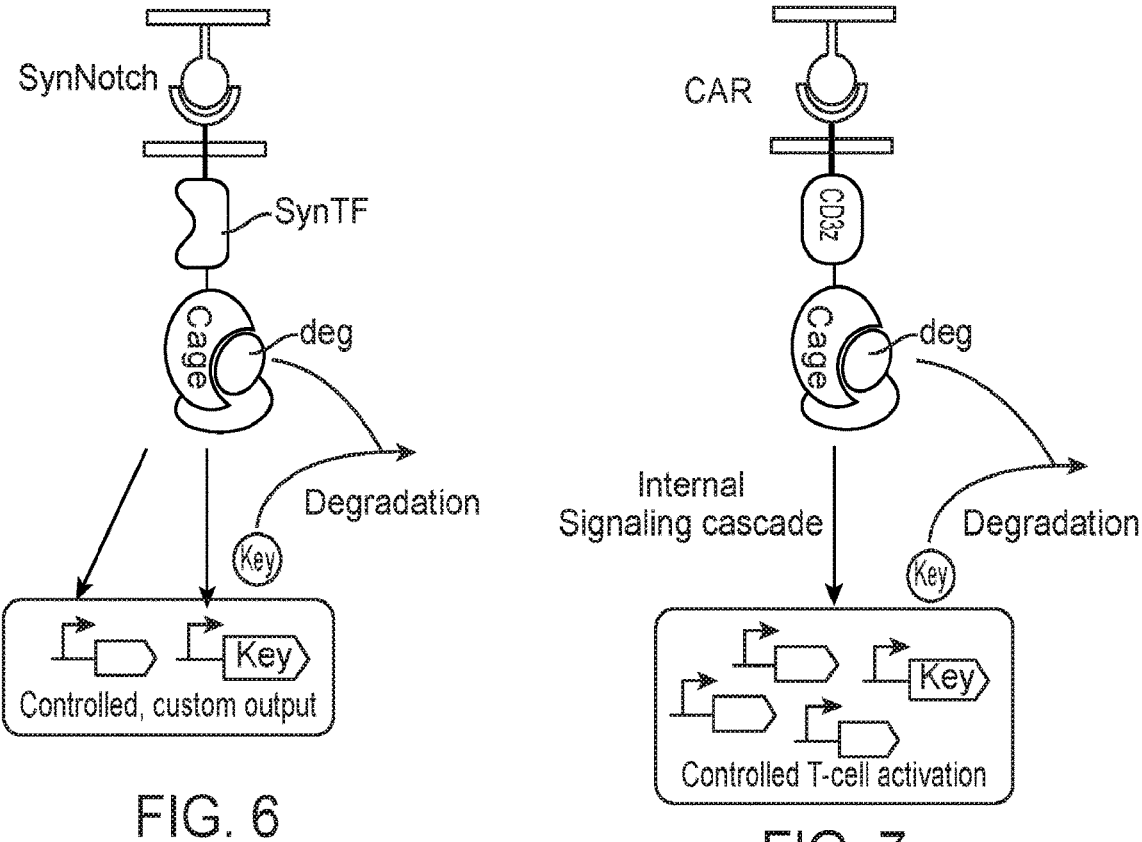
FIG. 6
FIG. 7

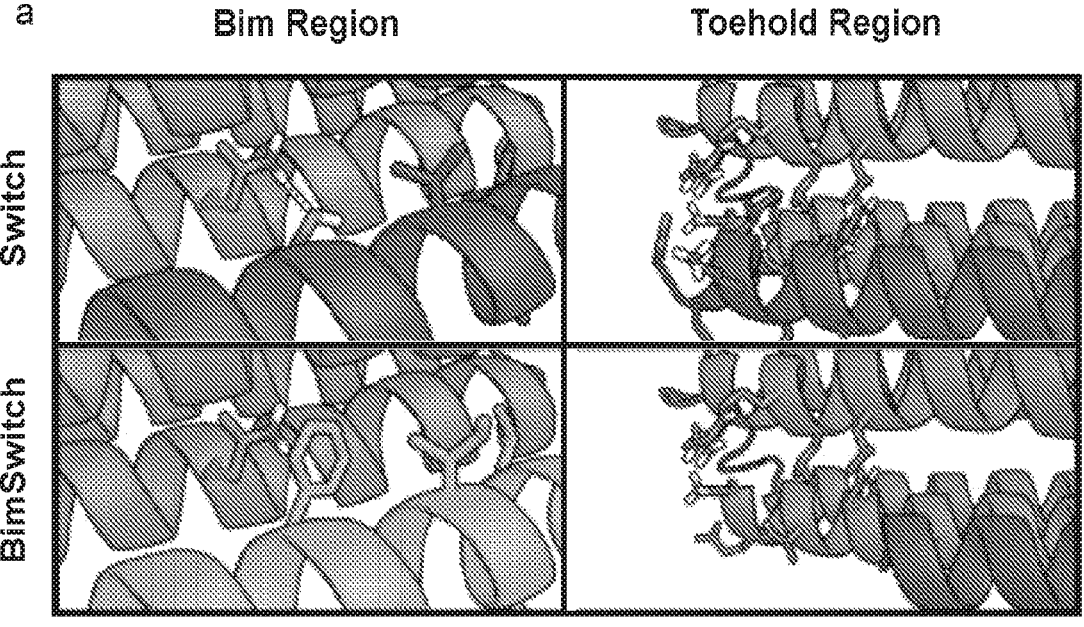
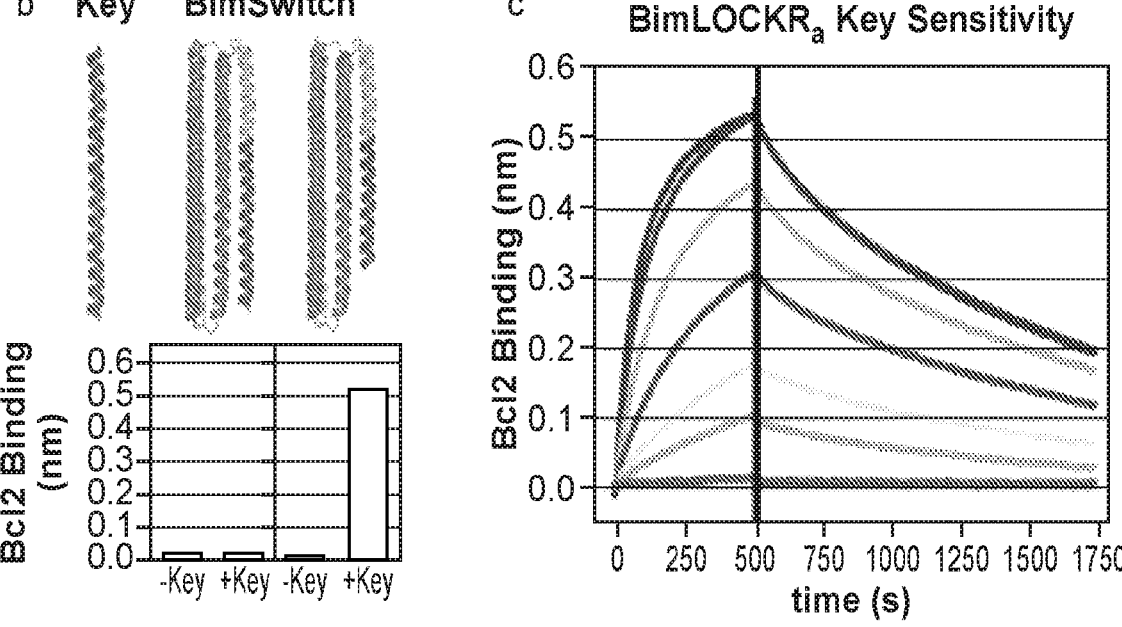
FIG. 11

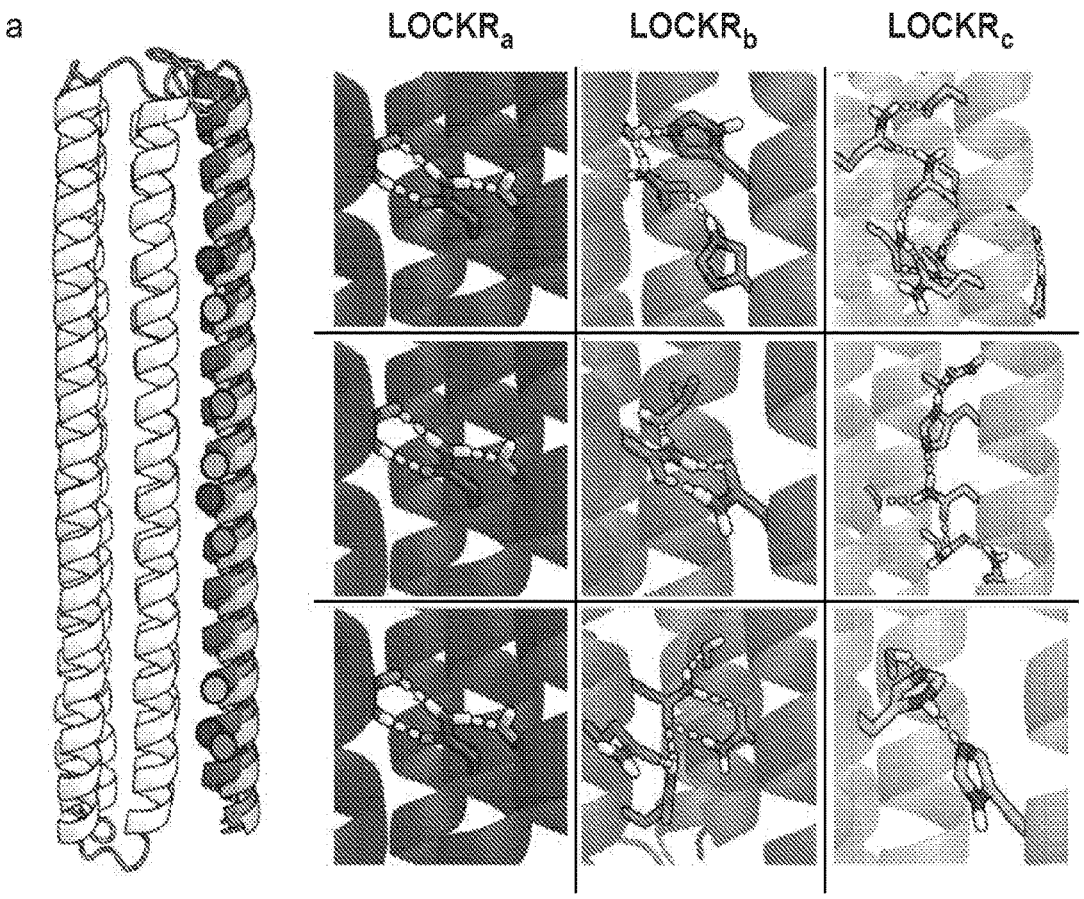
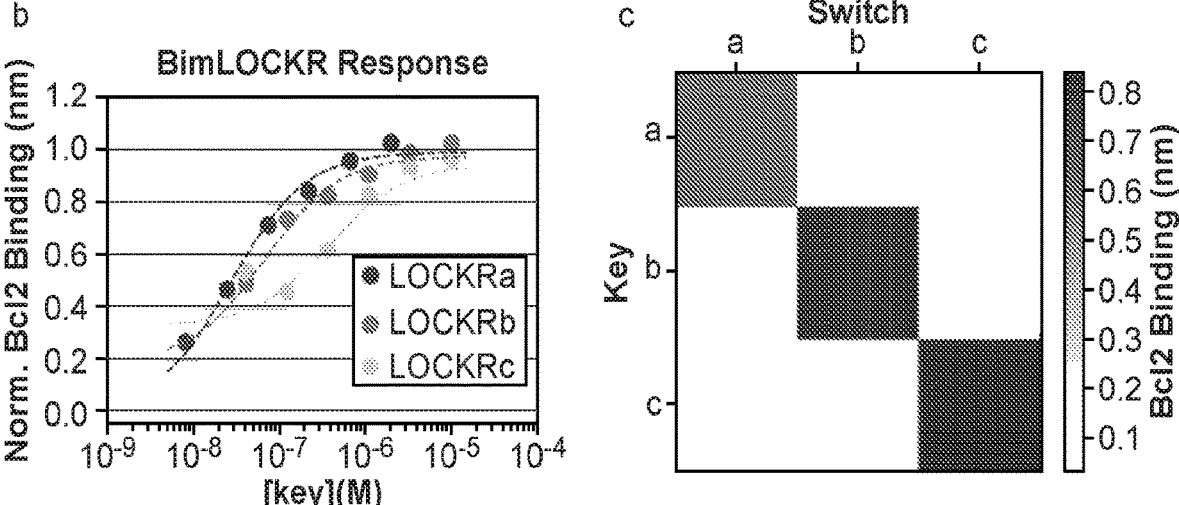
FIG. 12 a
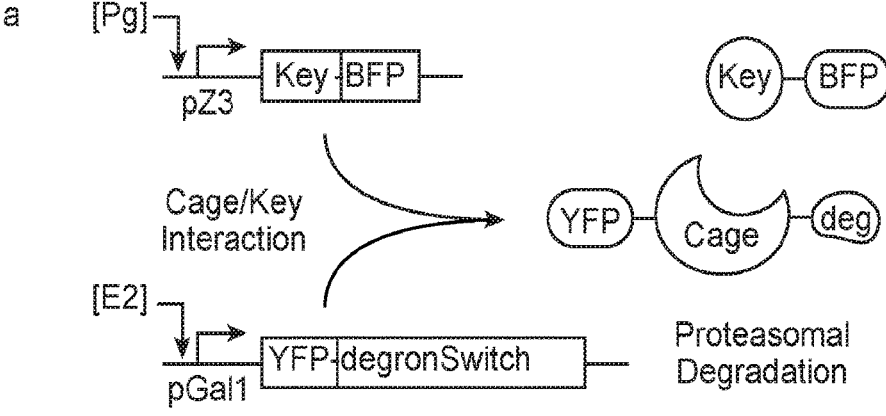
b
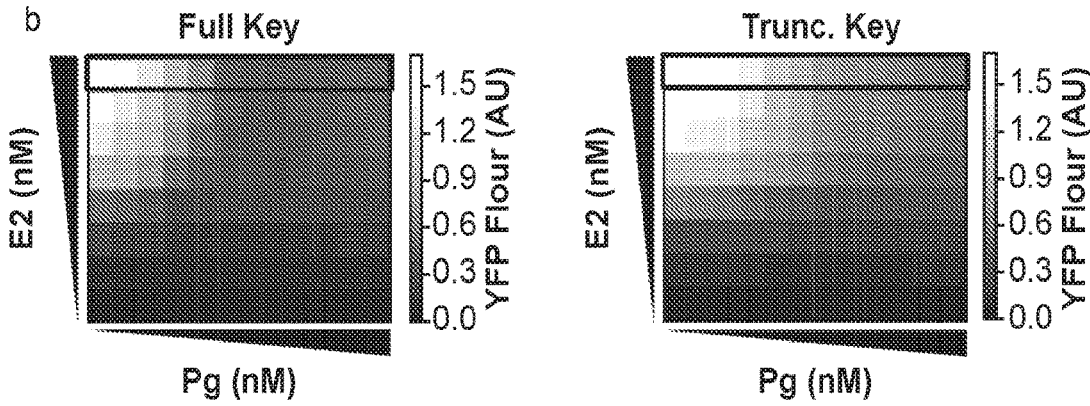
c
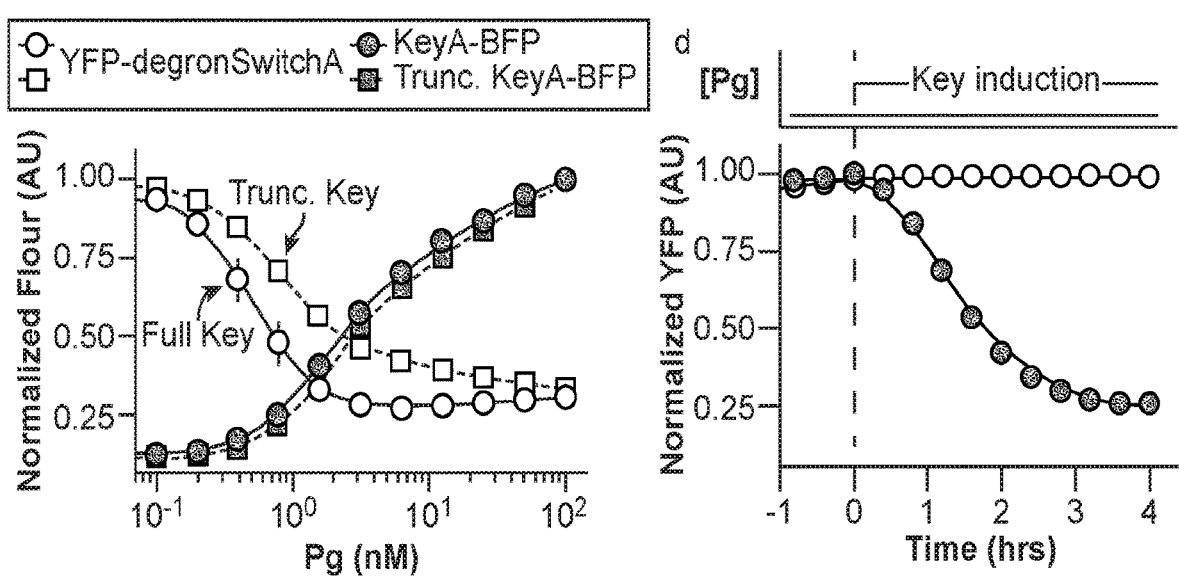
d
FIG. 13

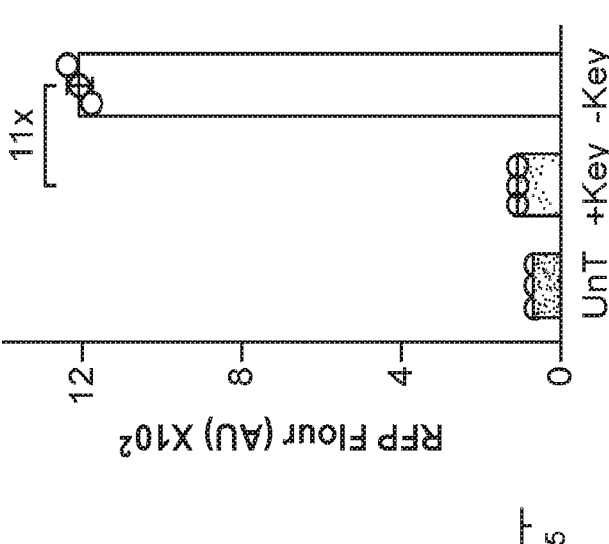
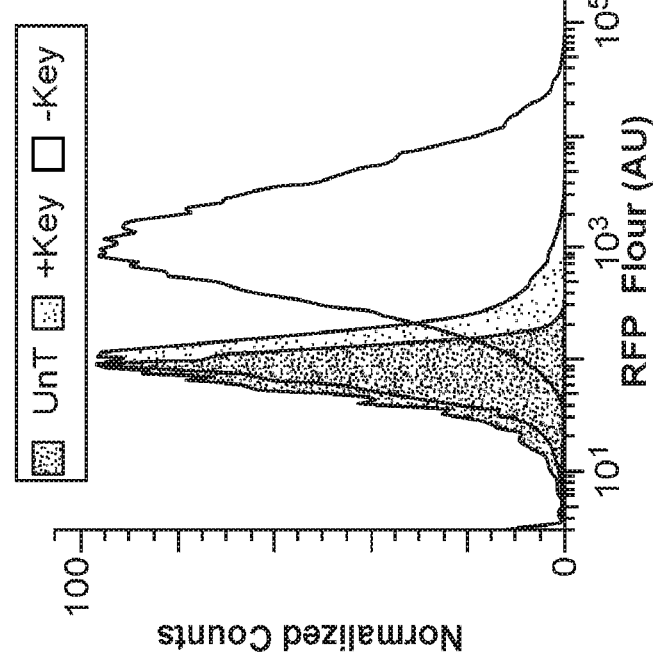
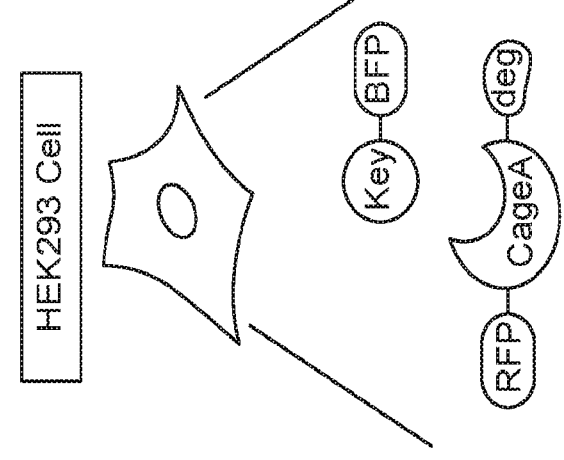
FIG. 13 (Cont. 1)

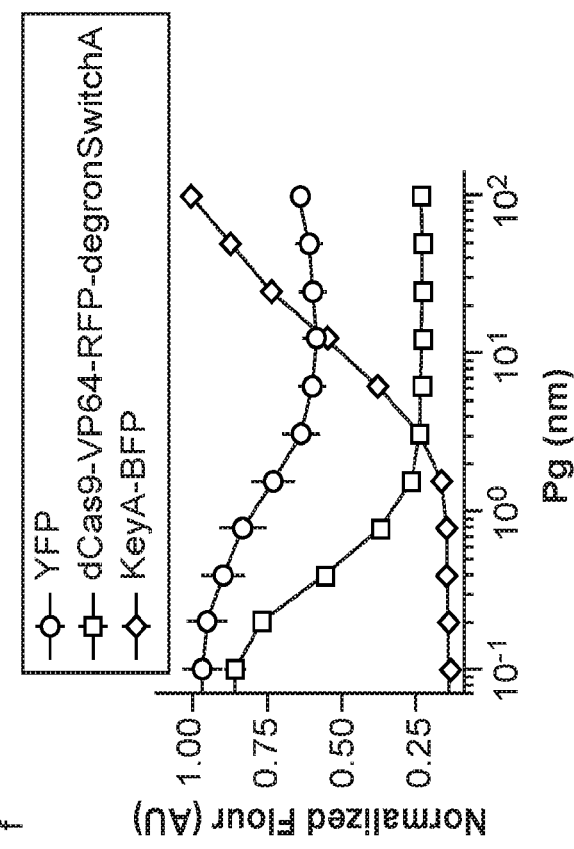
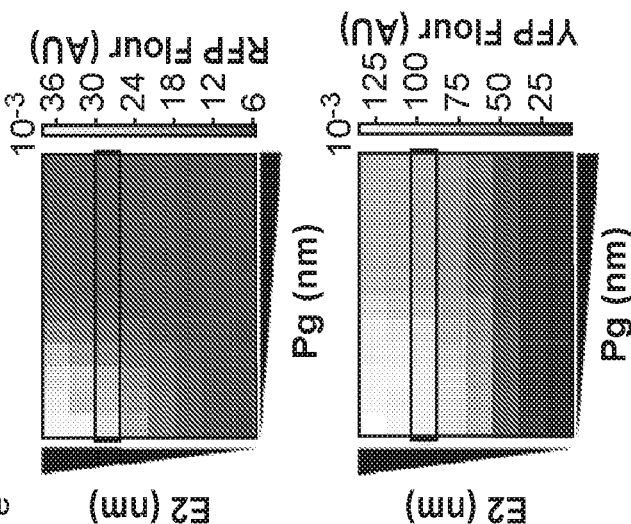
FIG. 14 (Cont.)

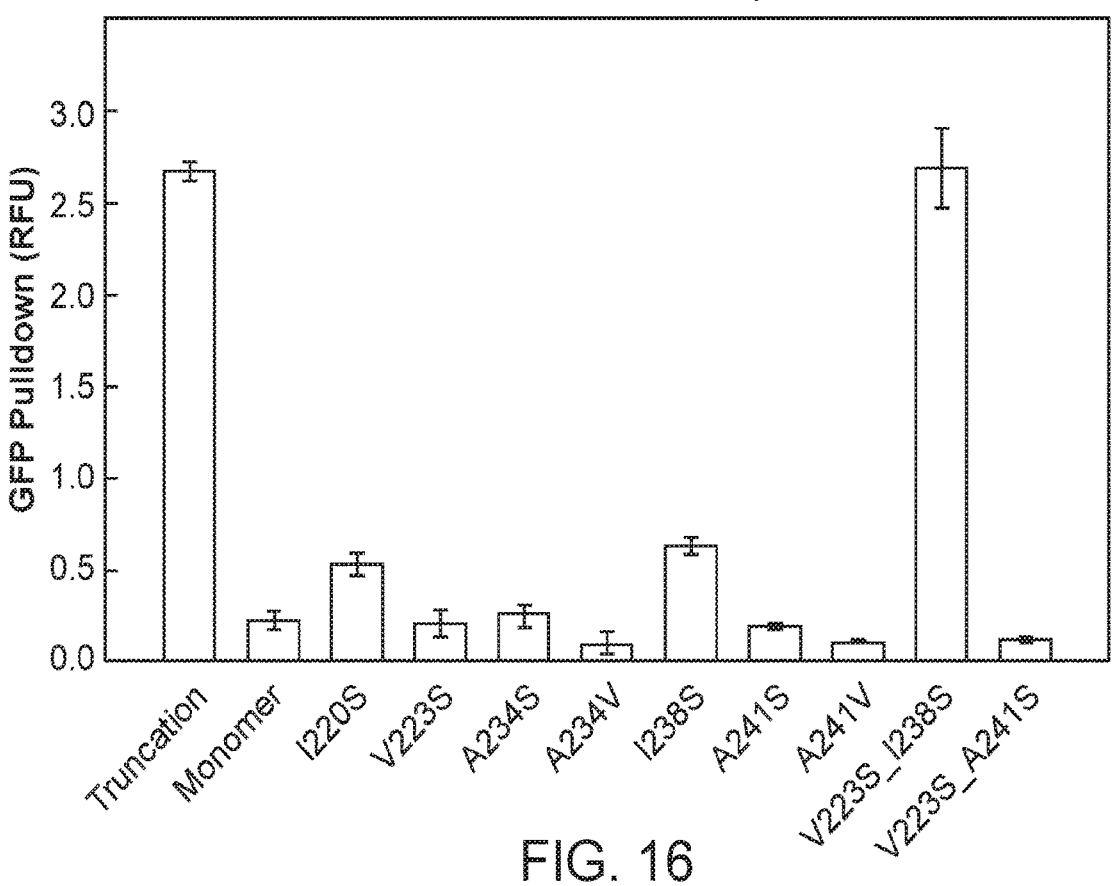
FIG. 16
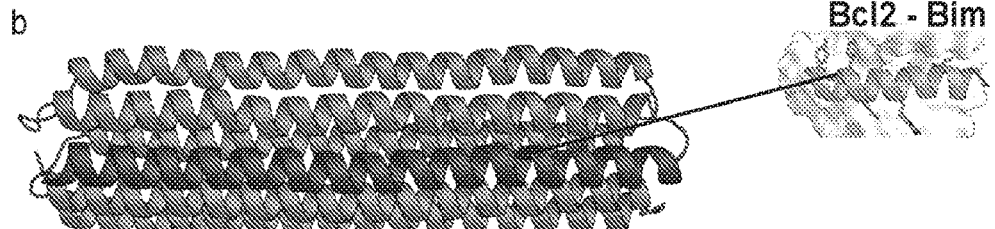
FIG. 17
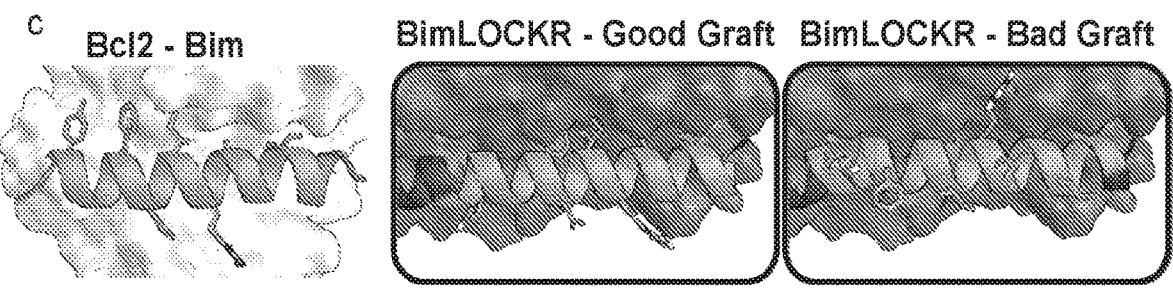

```
LOCKR_0002_0003  DSEELLKRLATESRKIAKKHAKTADDVERKIEKTLRDLRRKIDEAEKQAKKTEDDS
                 | | | | | | | | | | | | | | | | | | | | | | | | | | | | | | | | | | | | | | | | | | | | | | | | | | | | | | | | |
LOCKR_0002_0003  DSEELLKRLATESRKIAKKHAKTADDVERKIEKTLRDLRRKIDEAEKQAKKTEDDS
Score=272

LOCKR_0002_0003  DSEELLKRLATESRKIAKKHAKTADDVERKIEKTLRDLRRKIDEAEKQAKKTEDDS--------
                 | | | | | | | | | | | | | | | | | | | | | | | | | | | | | | | | | | | | | | | | | | | | | | | | | | | | | | | | | | | |
LOCKR_0007_0001  --------SSKELKDIATEAAKTLKKIQDDIEREAKKVEEEYEEKLKKSKKHADDVRKRLTDIS
Score=59

LOCKR_0002_0003  --DSEELLKRLATESRKIAKKHAKTADDVERKIEKTLRDLRRKIDEAEKQAKKTEDDS
                 | | | | | | | | | | | | | | | | | | | | | | | | | | | | | | | | | | | | | | | | | | | | | | | | | | | | | | |
LOCKR_0013_0005  DKKLLDDVKETLKEIAKTAKRIVEEAEKTARKIAKEAKDLARKSKRHAKEQQKTTS--
Score=63

LOCKR_0002_0003  DSEELLKRLATESRKIAKKHAKTADDVERKIEKTLRDLRRKIDEAEKQAKKTEDDS-
                 | | | | | | | | | | | | | | | | | | | | | | | | | | | | | | | | | | | | | | | | | | | | | | | | | | | | | | | | |
LOCKR_0013_0010  -DREALKKVKRTLTELAKTAEKIAQDANRTHKRLADEARKLLEKLKREAKKSQKDIS
Score=69

LOCKR_0002_0003  DSEELLKRLATESRKIAKKHAKTADDVERKIEKTLRDLRRKIDEAEKQAKKTEDDS-
                 | | | | | | | | | | | | | | | | | | | | | | | | | | | | | | | | | | | | | | | | | | | | | | | | | | | | | | | | | | |
LOCKR_0013_0014  -DKELLDTVKKILEDILRTAQKIADDTSRILERILREHEKLQRKLQEDAKKLEKDIS
Score=63
```

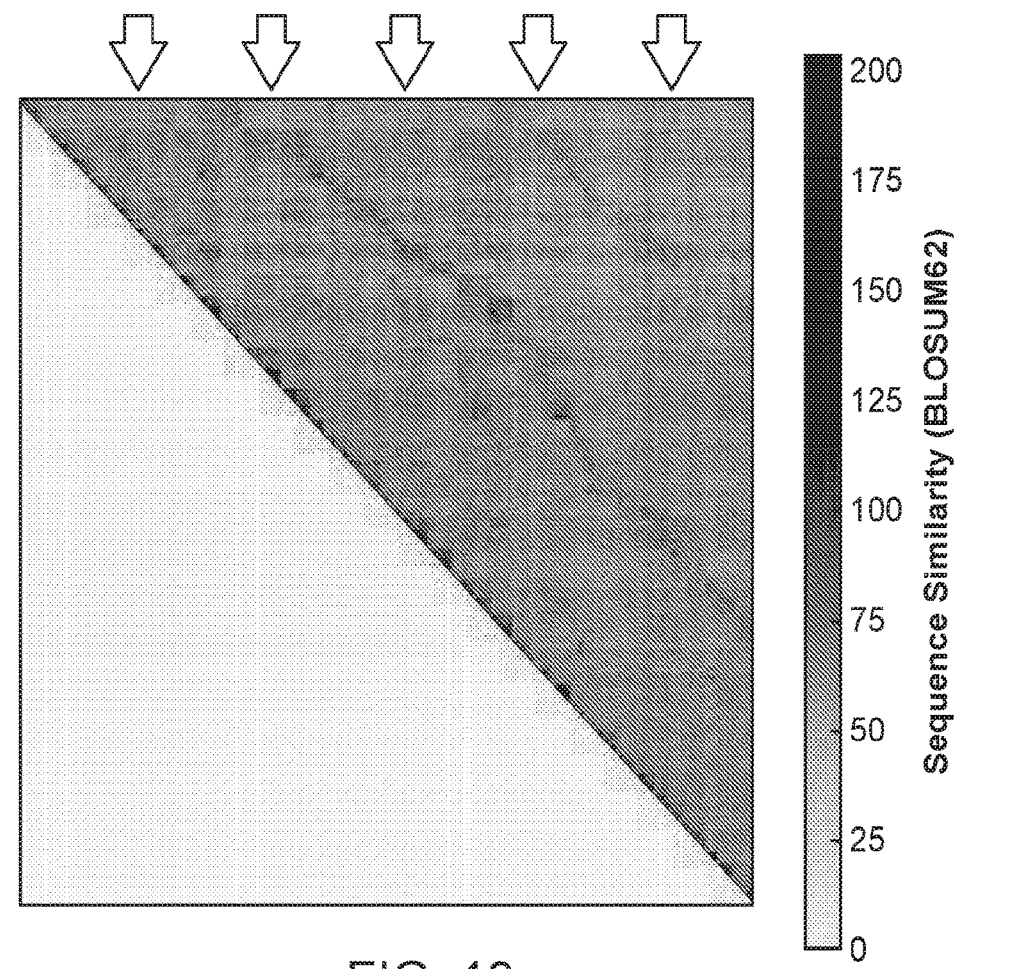

FIG. 19 a
```
cODC Full:     LPMSCAQES
cODC noPro:    L-MSCAQES
cODC CA_only:  ----CA---
``` b      Full                                no Pro a
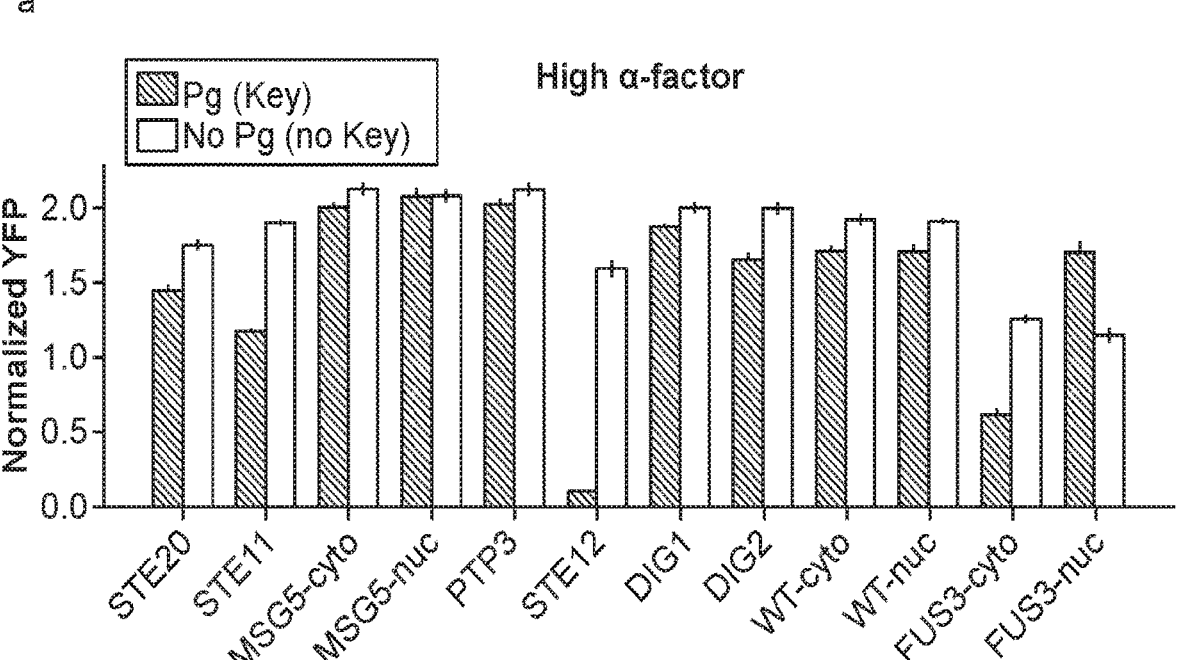
b
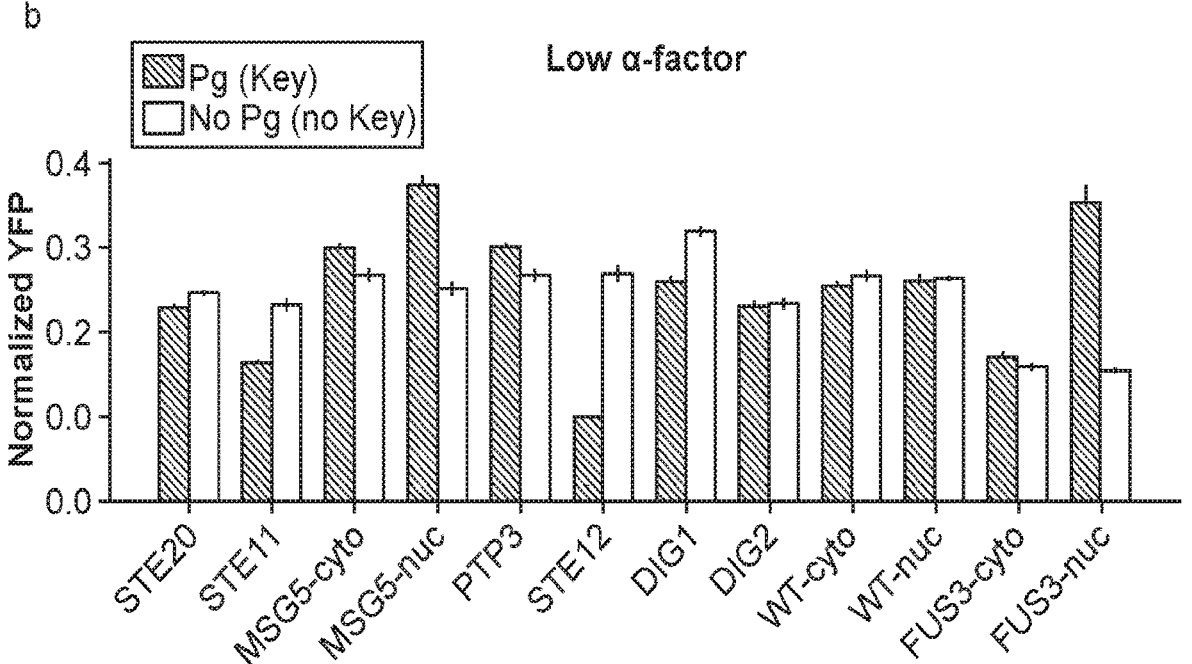
FIG. 29 a
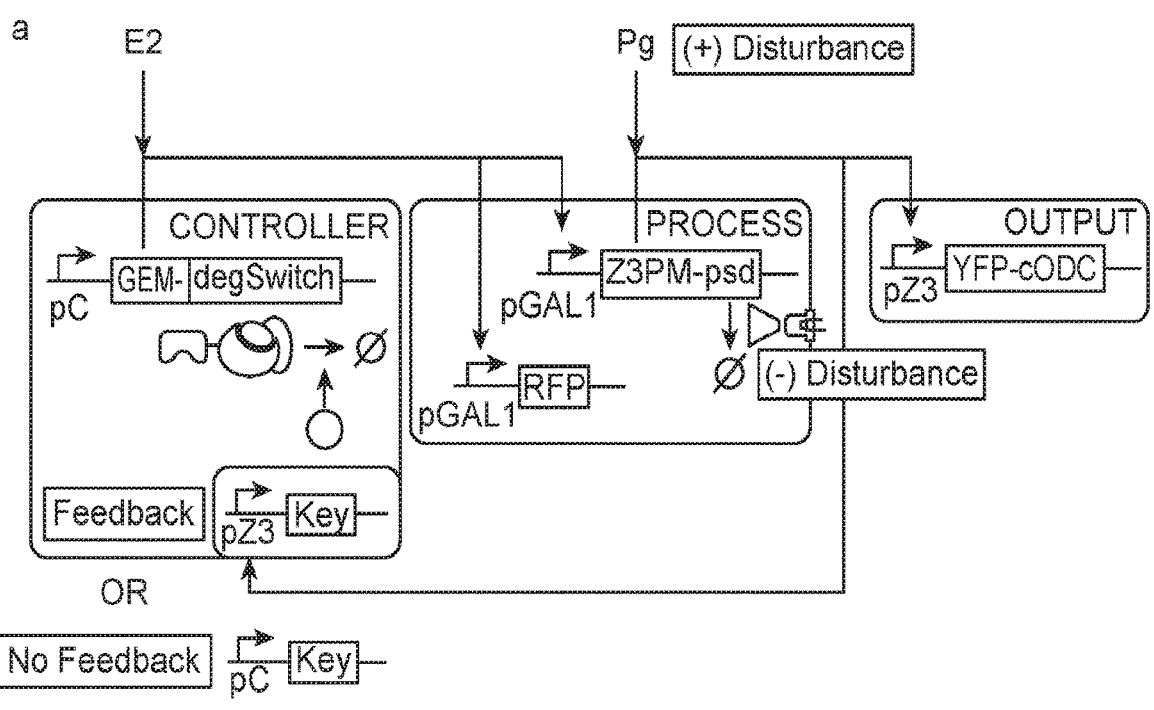
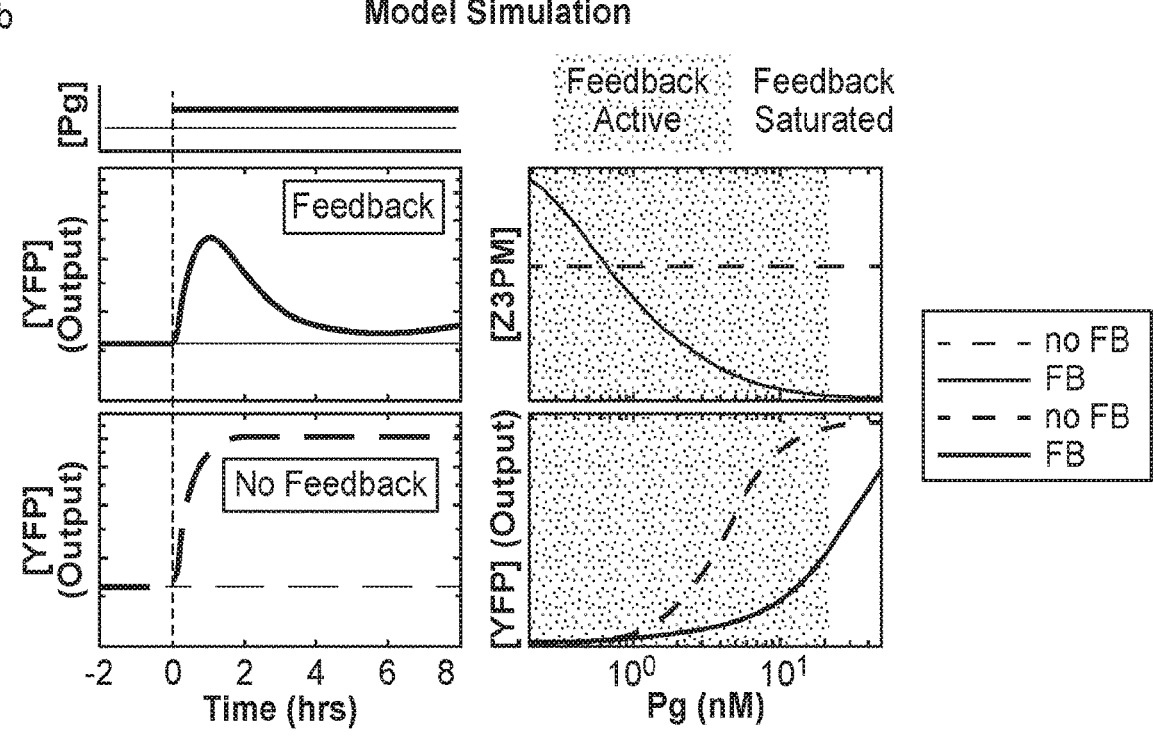
FIG. 31

FIG. 34

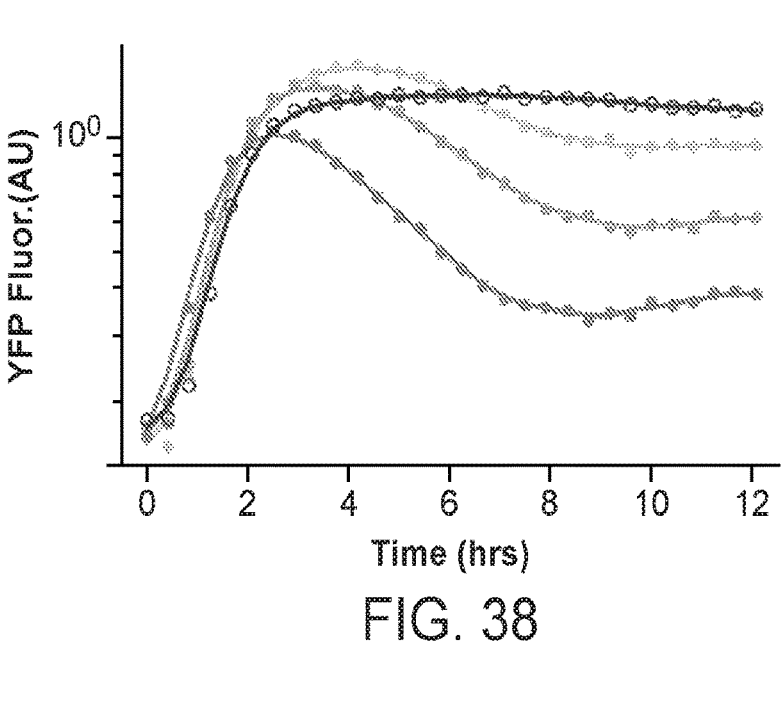
FIG. 38
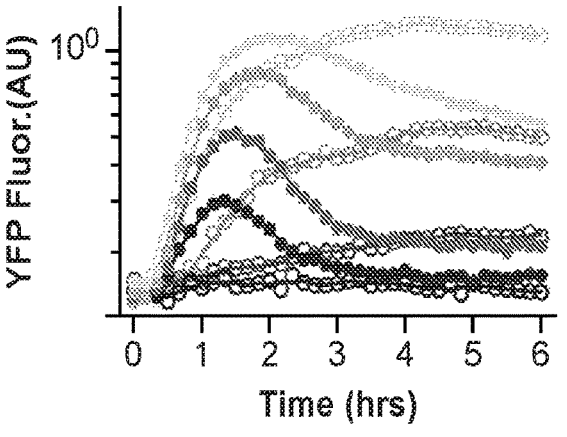
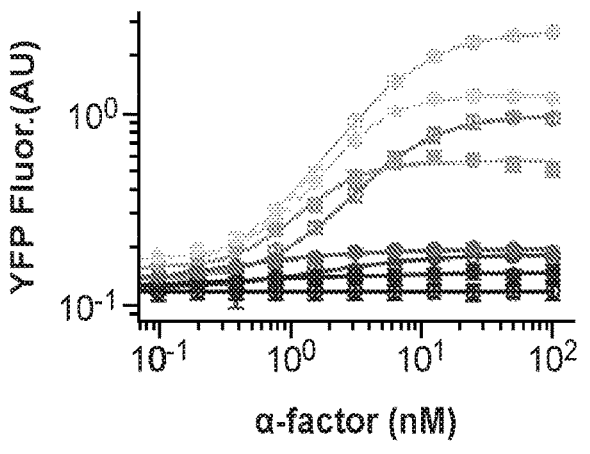
FIG. 39

CAGED-DEGRON-BASED MOLECULAR FEEDBACK CIRCUITS AND METHODS OF USING THE SAME

CROSS-REFERENCING

This application is a § 371 national phase of International Application No. PCT/US2020/012355, filed on Jan. 6, 2020, which claims the benefit of U.S. provisional applications 62/789,418, filed on Jan. 7, 2019, and 62/850,336, filed on May 20, 2019, which applications are incorporated by reference herein.

STATEMENT REGARDING FEDERALLY SPONSORED RESEARCH

This invention was made with government support under Grant No. HR0011-16-2-0045 awarded by the Defense Advanced Research Projects Agency. The government has certain rights in the invention.

INTRODUCTION

Conventionally, desired regulation of cellular activities has been controlled by repeated, user-provided inputs to cellular systems. For example, in the context of some medical treatments, a desired level of a cellular output in a subject over an extended period of time is achieved by repeated cycles of dosing an agent, assessing, re-dosing and re-assessing over the course of treatment. Similarly, in bioproduction applications and metabolic engineering, to coax production cells to output desired yields of product, growth media is repeatedly augmented, e.g., by supplementing growth factors and/or removing toxic byproducts.

Huge advances in the abilities of engineered cells to perform desired tasks, and methods for producing such engineered cells, have been made in recent decades. For example, recent progress in synthetic biology and systems metabolic engineering technologies provide the potential of microbial cell factories for the production of industrially relevant bulk and fine chemicals from renewable biomass resources in an eco-friendly manner. In addition, designer cell therapies, such as chimeric antigen receptor (CAR) T cell therapies, which may be directed to various user-defined targets, have shown great promise in the clinic and are gaining wide adoption and continued regulatory approval.

Without further user-input, the output of such engineered cells, e.g., as used for various purposes as described above, is constant once administered to a subject or set in motion in a bioreactor. Adjustments to modulate engineered cell output are made using an external input, e.g., in the form of small molecules, or other stimuli or user-performed actions.

SUMMARY

Provided are molecular feedback circuits employing caged-degrons. Aspects of such circuits include the use of a caged-degron to modulate the output of a signaling pathway in a feedback-controlled manner. Also provided are nucleic acids encoding molecular circuits and cells containing such nucleic acids. Methods of using caged-degron-based molecular feedback circuits are also provided, including e.g., methods of modulating a signaling pathway of a cell that include genetically modifying the cell with a caged-degron-based molecular feedback circuit.

BRIEF DESCRIPTION OF THE DRAWINGS

FIG. 5 schematically depicts strategies for negative and positive feedback using a molecular feedback circuit of the present disclosure.

FIG. 6 schematically depicts a molecular feedback circuit strategy employing a synthetic Notch receptor as described herein.

FIG. 7 schematically depicts a molecular feedback circuit strategy employing a chimeric antigen receptor (CAR) as described herein.

FIG. 12 depicts aspects related to design and validation of orthogonal BimLOCKR. a, Left: LOCKR in cartoon representation. Cage in white with three different latches superimposed and hydrogen bond networks marked by colored markers. Right: Design models of hydrogen-bond networks across the orthogonal LOCKR interfaces corresponding to the colored markers on the left. b, BimSwitches binding to Bcl2 in response to its cognate key, measured by biolayer interferometry (Octet). c, Binding response to Bcl2 from biolayer interferometry experiments for each switch at 250 nM against each key at 5 µM; average of two replicates.

FIG. 16 provides data related to a GFP Plate assay to find mutations for LOCKR.

FIG. 17 demonstrates the caging Bim-related sequences. a) Three Bcl2 binding sequences were grafted onto the latch. aBcl2 is a single helix from a designed Bcl2 binder (pdb: 5JSN) where non Bcl2-interacting residues were reverted back to the standard LOCKR latch sequence, shown as dashes. pBim is the partial Bim sequence where only Bcl2-interacting residues are grafted onto the latch. Bim is the full consensus sequence of the BH3 domain. b) LOCKR (left) with the latch in dark blue. The helical Bim sequence is taken from the Bim/Bcl2 interaction and grafted onto the latch c) Left: Bcl2 (tan) binding to Bim (purple) from pdb:2MV6 with pBim residues shown as sticks. Center: a well caged graft where important binding residues are caged. Right: a poor graft where Bcl2 binding residues are exposed and polar surface residues are against the cage interface.

FIG. 19 depicts sequence alignment of 1504 keys for filtering for orthogonality. From top to bottom SEQ ID NOS. 28214, 28214, 28214, 28215, 28214, 28216, 28214, 28217, 28214, and 28218.

FIG. 29 provides a panel of mating pathway regulators tested with degronLOCKR. degSwitch was fused to the C-terminus of the endogenous copy of each regulator. Key with or without SV40 NLS was expressed using a Pg inducible system. STE20, STE11, and PTP3 were degraded using cytoplasmic key (Key-CFP), and STE12, DIG1 and DIG2 were degraded using nuclear key (Key-CFP-NLS). MSG5 and FUS3 were degraded using either cytoplasmic (cyto) or nuclear (nuc) key. Cells were induced with (a) 100 nM (high) or (b) 1 nM (low) α-factor and 50 nM or 0 nM Pg and grown for four hours before YFP fluorescence was measured using a flow cytometer. Data represent mean±s.d. of three biological replicates.

FIG. 34 depicts circuit behavior as a function of E2 for a fixed dose of Pg.

FIG. 38 demonstrates that tuning feedback strength changes dynamic behavior of circuit output.

FIG. 39 depicts combinatorial tuning of synthetic feedback in mating pathway.

SEQUENCE LISTING

A Sequence Listing is provided herewith as a text file, "UCSF-578WO_SF2019-073-3_SeqList_ST25" created on Jan. 3, 2020, and having a size of 34,282 KB. The contents of the text file are incorporated by reference herein in their entirety.

SEQ ID NOS. 63-1169 are examples of degron-LOCKR cage polypeptide sequences.

SEQ ID NOS. 1170-13903 are examples of Key polypeptide sequences.

SEQ ID NOS. 13904-28210 are examples of Cage polypeptide sequences.

Figure 40:
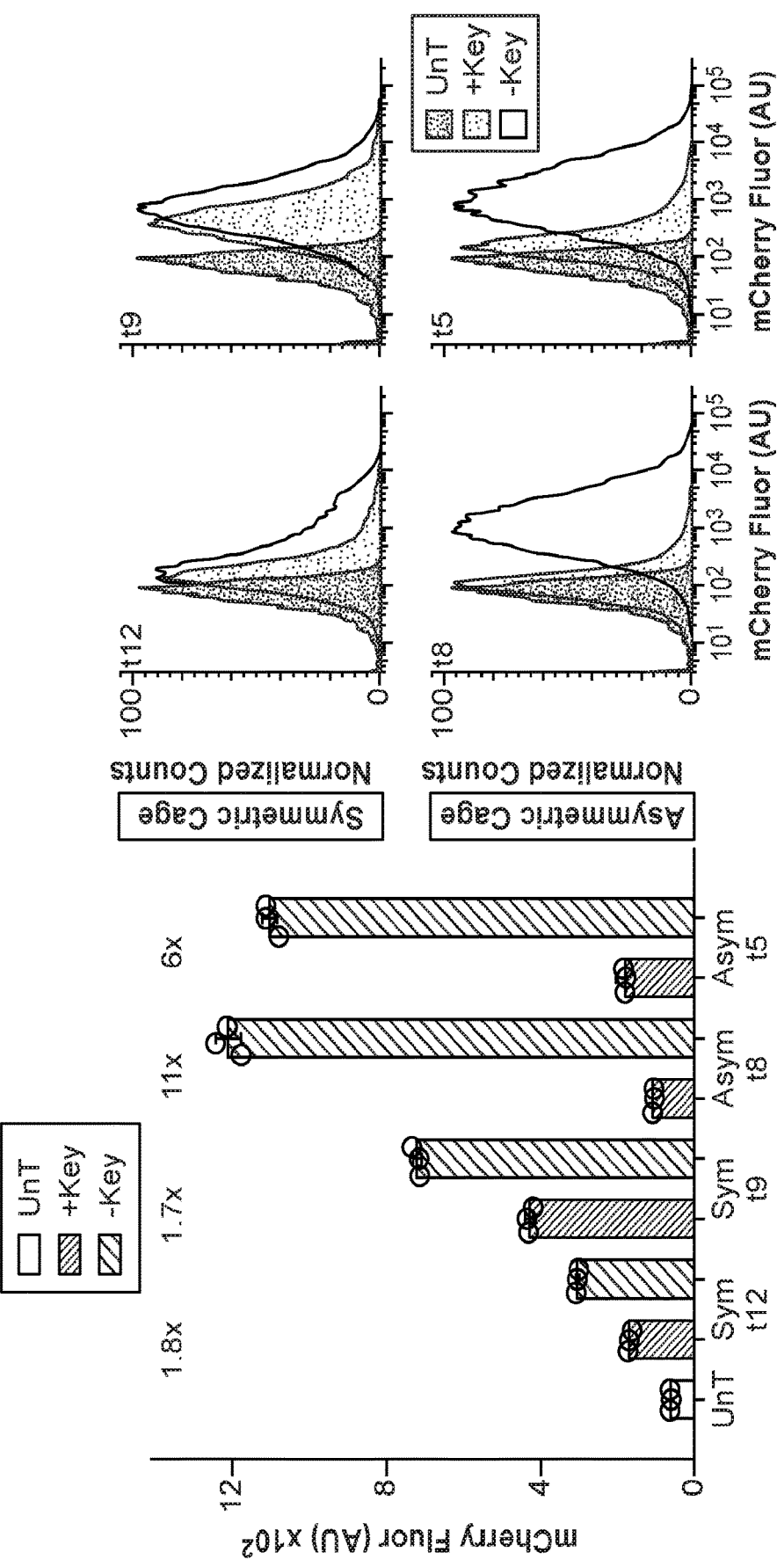
FIG. 40 provides a comparison of different degronSwitch variants in HEK293T cells.
Figure 41:
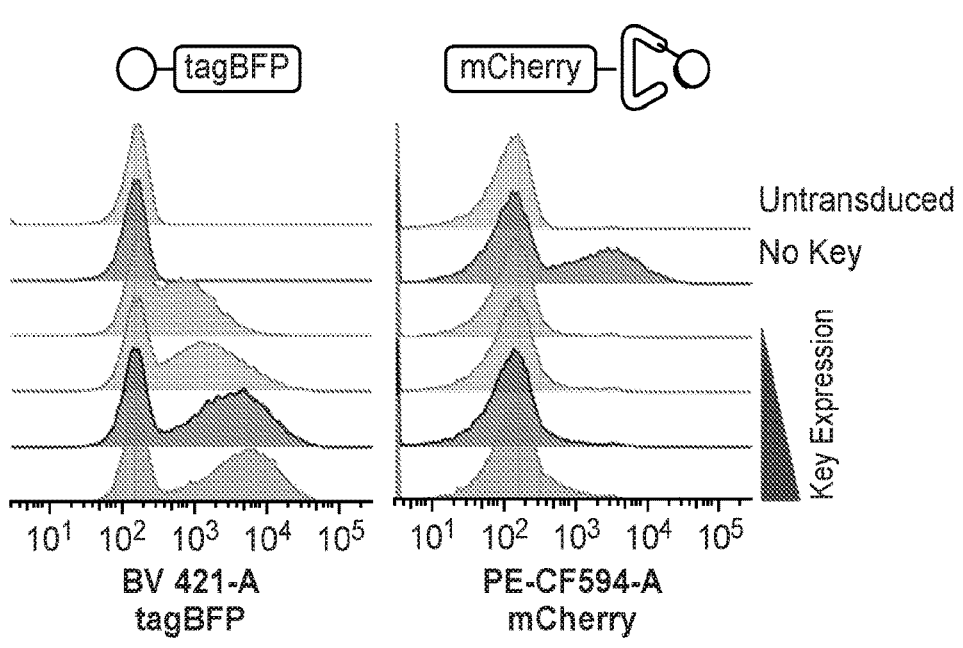
FIG. 41 shows fluorescence histograms of tagBFP (left panel) and fluorescence histograms of mCherry (right panel).
Figure 42:
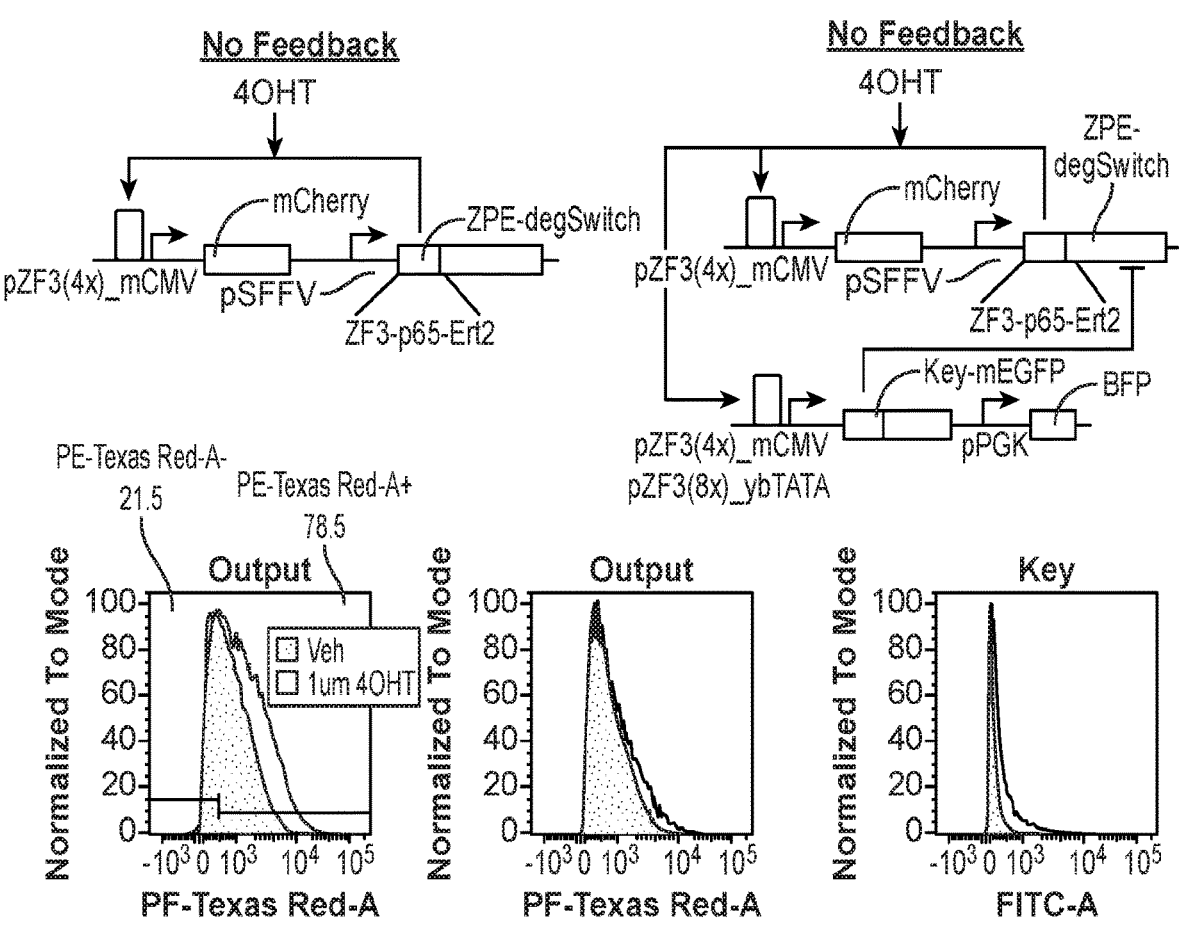
FIG. 42 shows no feedback and feedback circuit diagrams (top panels) and representative histograms comparing output and key fluorescence for both circuits in the presence and absence of drug (bottom panels).

FIGS. 40, 41 and 42 of provisional application Ser. No. 62/850,336, filed on May 20,2019, disclose SEQ ID NOS. 63-1169, 1170-13903 and 13904-28210, respectively, and are incorporated by reference herein for the disclosure of each sequence, including any annotation associated therewith.

Definitions

The terms "synthetic", "chimeric" and "engineered" as used herein generally refer to artificially derived polypeptides or polypeptide encoding nucleic acids that are not naturally occurring. Synthetic polypeptides and/or nucleic acids may be assembled de novo from basic subunits including, e.g., single amino acids, single nucleotides, etc., or may be derived from pre-existing polypeptides or polynucleotides, whether naturally or artificially derived, e.g., as through recombinant methods. Chimeric and engineered polypeptides or polypeptide encoding nucleic acids will generally be constructed by the combination, joining or fusing of two or more different polypeptides or polypeptide encoding nucleic acids or polypeptide domains or polypeptide domain encoding nucleic acids. Chimeric and engineered polypeptides or polypeptide encoding nucleic acids include where two or more polypeptide or nucleic acid "parts" that are joined are derived from different proteins (or nucleic acids that encode different proteins) as well as where the joined parts include different regions of the same protein (or nucleic acid encoding a protein) but the parts are joined in a way that does not occur naturally.

The term "recombinant", as used herein describes a nucleic acid molecule, e.g., a polynucleotide of genomic, cDNA, viral, semisynthetic, and/or synthetic origin, which, by virtue of its origin or manipulation, is not associated with all or a portion of the polynucleotide sequences with which it is associated in nature. The term recombinant as used with respect to a protein or polypeptide means a polypeptide produced by expression from a recombinant polynucleotide. The term recombinant as used with respect to a host cell or a virus means a host cell or virus into which a recombinant polynucleotide has been introduced. Recombinant is also used herein to refer to, with reference to material (e.g., a cell, a nucleic acid, a protein, or a vector) that the material has been modified by the introduction of a heterologous material (e.g., a cell, a nucleic acid, a protein, or a vector).

The term "operably linked" refers to a juxtaposition wherein the components so described are in a relationship permitting them to function in their intended manner. For instance, a promoter is operably linked to a coding sequence if the promoter affects its transcription or expression. Operably linked nucleic acid sequences may but need not necessarily be adjacent. For example, in some instances a coding sequence operably linked to a promoter may be adjacent to the promoter. In some instances, a coding sequence operably linked to a promoter may be separated by one or more intervening sequences, including coding and non-coding sequences. Also, in some instances, more than two sequences may be operably linked including but not limited to e.g., where two or more coding sequences are operably linked to a single promoter.

A "biological sample" encompasses a variety of sample types obtained from an individual or a population of individuals and can be used in various ways, including e.g., the isolation of cells or biological molecules, diagnostic assays, etc. The definition encompasses blood and other liquid samples of biological origin, solid tissue samples such as a biopsy specimen or tissue cultures or cells derived therefrom and the progeny thereof. The definition also includes samples that have been manipulated in any way after their procurement, such as by mixing or pooling of individual samples, treatment with reagents, solubilization, or enrichment for certain components, such as cells, polynucleotides, polypeptides, etc. The term "biological sample" encompasses a clinical sample, and also includes cells in culture, cell supernatants, cell lysates, serum, plasma, biological fluid, and tissue samples. The term "biological sample" includes urine, saliva, cerebrospinal fluid, interstitial fluid, ocular fluid, synovial fluid, blood fractions such as plasma and serum, and the like. The term "biological sample" also includes solid tissue samples, tissue culture samples, and cellular samples. Accordingly, biological samples may be cellular samples or acellular samples.

The terms "polynucleotide" and "nucleic acid," used interchangeably herein, refer to a polymeric form of nucleotides of any length, either ribonucleotides or deoxyribonucleotides. Thus, this term includes, but is not limited to, single-, double-, or multi-stranded DNA or RNA, genomic DNA, cDNA, DNA-RNA hybrids, or a polymer comprising purine and pyrimidine bases or other natural, chemically or biochemically modified, non-natural, or derivatized nucleotide bases.

The terms "polypeptide," "peptide," and "protein", used interchangeably herein, refer to a polymeric form of amino acids of any length, which can include genetically coded and non-genetically coded amino acids, chemically or biochemically modified or derivatized amino acids, and polypeptides having modified peptide backbones. The term includes fusion proteins, including, but not limited to, fusion proteins with a heterologous amino acid sequence, fusions with heterologous and homologous leader sequences, with or without N-terminal methionine residues; immunologically tagged proteins; and the like.

Polypeptides may be "non-naturally occurring" in that the entire polypeptide is not found in any naturally occurring polypeptide. It will be understood that components of non-naturally occurring polypeptides may be naturally occurring, including but not limited to domains (such as functional domains) that may be included in some embodiments.

A "vector" or "expression vector" is a replicon, such as plasmid, phage, virus, or cosmid, to which another DNA segment, i.e. an "insert", may be attached so as to bring about the replication of the attached segment in a cell.

The terms "domain" and "motif", used interchangeably herein, refer to both structured domains having one or more particular functions and unstructured segments of a polypeptide that, although unstructured, retain one or more particular functions. For example, a structured domain may encompass but is not limited to a continuous or discontinuous plurality of amino acids, or portions thereof, in a folded polypeptide that comprise a three-dimensional structure which contributes to a particular function of the polypeptide. In other instances, a domain may include an unstructured segment of a polypeptide comprising a plurality of two or more amino acids, or portions thereof, that maintains a particular function of the polypeptide unfolded or disordered. Also encompassed within this definition are domains that may be disordered or unstructured but become structured or ordered upon association with a target or binding partner. Non-limiting examples of intrinsically unstructured domains and domains of intrinsically unstructured proteins are described, e.g., in Dyson & Wright. *Nature Reviews Molecular Cell Biology* 6:197-208.

As used herein, the term "affinity" refers to the equilibrium constant for the reversible binding of two agents and is expressed as a dissociation constant (Kd). Affinity can be at least 1-fold greater, at least 2-fold greater, at least 3-fold greater, at least 4-fold greater, at least 5-fold greater, at least 6-fold greater, at least 7-fold greater, at least 8-fold greater, at least 9-fold greater, at least 10-fold greater, at least 20-fold greater, at least 30-fold greater, at least 40-fold greater, at least 50-fold greater, at least 60-fold greater, at least 70-fold greater, at least 80-fold greater, at least 90-fold greater, at least 100-fold greater, or at least 1000-fold greater, or more, than the affinity of an antibody for unrelated amino acid sequences. Affinity of an antibody to a target protein can be, for example, from about 100 nanomolar (nM) to about 0.1 nM, from about 100 nM to about 1 picomolar (pM), or from about 100 nM to about 1 femtomolar (fM) or more.

The term "binding" refers to a direct association between two molecules, due to, for example, covalent, electrostatic, hydrophobic, and ionic and/or hydrogen-bond interactions, including interactions such as salt bridges and water bridges. Non-specific binding would refer to binding with an affinity of less than about $10^{-7}$ M, e.g., binding with an affinity of $10^{-6}$ M, $10^{-5}$ M, $10^{-4}$ M, etc.

As used herein, the terms "treatment," "treating," and the like, refer to obtaining a desired pharmacologic and/or physiologic effect. The effect may be prophylactic in terms of completely or partially preventing a disease or symptom thereof and/or may be therapeutic in terms of a partial or complete cure for a disease and/or adverse effect attributable to the disease. "Treatment," as used herein, covers any treatment of a disease in a mammal, e.g., in a human, and includes: (a) preventing the disease from occurring in a subject which may be predisposed to the disease but has not yet been diagnosed as having it; (b) inhibiting the disease, i.e., arresting its development; and (c) relieving the disease, i.e., causing regression of the disease.

The terms "individual," "subject," "host," and "patient," used interchangeably herein, refer to a mammal, including, but not limited to, murines (e.g., rats, mice), lagomorphs (e.g., rabbits), non-human primates, humans, canines, felines, ungulates (e.g., equines, bovines, ovines, porcines, caprines), etc.

A "therapeutically effective amount" or "efficacious amount" refers to the amount of an agent, or combined amounts of two agents, that, when administered to a mammal or other subject for treating a disease, is sufficient to effect such treatment for the disease. The "therapeutically effective amount" will vary depending on the agent(s), the disease and its severity and the age, weight, etc., of the subject to be treated.

The terms "chimeric antigen receptor" and "CAR", used interchangeably herein, refer to artificial multi-module molecules capable of triggering or inhibiting the activation of an immune cell which generally but not exclusively comprise an extracellular domain (e.g., a ligand/antigen binding domain), a transmembrane domain and one or more intracellular signaling domains. The term CAR is not limited specifically to CAR molecules but also includes CAR variants. CAR variants include split CARs wherein the extracellular portion (e.g., the ligand binding portion) and the intracellular portion (e.g., the intracellular signaling portion) of a CAR are present on two separate molecules. CAR variants also include ON-switch CARs which are conditionally activatable CARs, e.g., comprising a split CAR wherein conditional hetero-dimerization of the two portions of the split CAR is pharmacologically controlled (e.g., as described in PCT publication no. WO 2014/127261 A1 and US Patent Application No. 2015/0368342 A1, the disclosures of which are incorporated herein by reference in their entirety). CAR variants also include bispecific CARs, which include a secondary CAR binding domain that can either amplify or inhibit the activity of a primary CAR. CAR variants also include inhibitory chimeric antigen receptors (iCARs) which may, e.g., be used as a component of a bispecific CAR system, where binding of a secondary CAR binding domain results in inhibition of primary CAR activation. CAR molecules and derivatives thereof (i.e., CAR variants) are described, e.g., in PCT Application No. US2014/016527; Fedorov et al. Sci Transl Med (2013); 5(215):215ra172; Glienke et al. Front Pharmacol (2015) 6:21; Kakarla & Gottschalk 52 Cancer J (2014) 20(2):151-5; Riddell et al. Cancer J (2014) 20(2):141-4; Pegram et al. Cancer J (2014) 20(2):127-33; Cheadle et al. Immunol Rev (2014) 257(1):91-106; Barrett et al. Annu Rev Med (2014) 65:333-47; Sadelain et al. Cancer Discov (2013) 3(4):388-98; Cartellieri et al., J Biomed Biotechnol (2010) 956304; the disclosures of which are incorporated herein by reference in their entirety. Useful CARs also include the anti-CD19-4-1BB-CD3ζ CAR expressed by lentivirus loaded CTL019 (Tisagenlecleucel-T) CAR-T cells as commercialized by Novartis (Basel, Switzerland). The terms "chimeric antigen receptor" and "CAR" also include SUPRA CAR and PNE CAR (see, e.g., Cho et al Cell 2018 173: 1426-1438 and Rodgers et al, Proc. Acad. Sci. 2016 113: E459-468).

The terms "T cell receptor" and "TCR" are used interchangeably and will generally refer to a molecule found on the surface of T cells, or T lymphocytes, that is responsible for recognizing fragments of antigen as peptides bound to major histocompatibility complex (MHC) molecules. The TCR complex is a disulfide-linked membrane-anchored heterodimeric protein normally consisting of the highly variable alpha (α) and beta (β) chains expressed as part of a complex with CD3 chain molecules. Many native TCRs exist in heterodimeric αβ or γδ forms. The complete endogenous TCR complex in heterodimeric αβ form includes eight chains, namely an alpha chain (referred to herein as TCRα or TCR alpha), beta chain (referred to herein as TCRβ or TCR beta), delta chain, gamma chain, two epsilon chains and two zeta chains. In some instance, a TCR is generally referred to by reference to only the TCRα and TCRβ chains, however, as the assembled TCR complex may associate with endogenous delta, gamma, epsilon and/or zeta chains an ordinary skilled artisan will readily understand that reference to a TCR as present in a cell membrane may include reference to the fully or partially assembled TCR complex as appropriate.

Recombinant or engineered individual TCR chains and TCR complexes have been developed. References to the use of a TCR in a therapeutic context may refer to individual recombinant TCR chains. As such, engineered TCRs may include individual modified TCRα or modified TCRβ chains as well as single chain TCRs that include modified and/or unmodified TCRα and TCRβ chains that are joined into a single polypeptide by way of a linking polypeptide.

The terms "synthetic Notch receptor", "synNotch" and "synNotch receptor", used interchangeably herein, refer to recombinant chimeric binding-triggered transcriptional switches that include at least: an extracellular binding domain, a portion of a Notch receptor that includes at least one proteolytic cleavage site, and an intracellular domain that provides a signaling function. SynNotch polypeptides, the components thereof and methods of employing the same, are described in U.S. Pat. Nos. 9,834,608 and 9,670,281, as well as, Toda et al., Science (2018) 361(6398):156-16; Roybal & Lim, Annu Rev Immunol. (2017) 35:229-253; Lim & June Cell. (2017) 168(4):724-740; Roybal et al. Cell. (2016) 167(2):419-432.e16; Roybal et al. Cell. (2016) 164

(4):770-9; and Morsut et al. Cell. (2016) 164(4):780-91; the disclosures of which are incorporated herein by reference in their entirety.

As used herein, a "bioactive peptide" is any peptide of any length or amino acid composition that is capable of selectively binding to a defined target (i.e.: capable of binding to an "effector" polypeptide). Such bioactive peptides may comprise peptides of all three types of secondary structure in an inactive conformation: alpha helix, beta strand, and loop. The polypeptides of this aspect can be used to control the activity of a wide range of functional peptides. The ability to harness these biological functions with tight, inducible control is useful, for example, in engineering cells (inducible activation of function, engineering complex logic behavior and circuits, etc.), developing sensors, developing inducible protein-based therapeutics, and creating new biomaterials.

Before the present invention is further described, it is to be understood that this invention is not limited to particular embodiments described, as such may, of course, vary. It is also to be understood that the terminology used herein is for the purpose of describing particular embodiments only, and is not intended to be limiting, since the scope of the present invention will be limited only by the appended claims.

Where a range of values is provided, it is understood that each intervening value, to the tenth of the unit of the lower limit unless the context clearly dictates otherwise, between the upper and lower limit of that range and any other stated or intervening value in that stated range, is encompassed within the invention. The upper and lower limits of these smaller ranges may independently be included in the smaller ranges, and are also encompassed within the invention, subject to any specifically excluded limit in the stated range. Where the stated range includes one or both of the limits, ranges excluding either or both of those included limits are also included in the invention.

Unless defined otherwise, all technical and scientific terms used herein have the same meaning as commonly understood by one of ordinary skill in the art to which this invention belongs. Although any methods and materials similar or equivalent to those described herein can also be used in the practice or testing of the present invention, the preferred methods and materials are now described. All publications mentioned herein are incorporated herein by reference to disclose and describe the methods and/or materials in connection with which the publications are cited.

It must be noted that as used herein and in the appended claims, the singular forms "a," "an," and "the" include plural referents unless the context clearly dictates otherwise. Thus, for example, reference to "a circuit" includes a plurality of such circuits and reference to "the nucleic acid" includes reference to one or more nucleic acids and equivalents thereof known to those skilled in the art, and so forth. It is further noted that the claims may be drafted to exclude any optional element. As such, this statement is intended to serve as antecedent basis for use of such exclusive terminology as "solely," "only" and the like in connection with the recitation of claim elements, or use of a "negative" limitation.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable sub-combination. All combinations of the embodiments pertaining to the invention are specifically embraced by the present invention and are disclosed herein just as if each and every combination was individually and explicitly disclosed. In addition, all sub-combinations of the various embodiments and elements thereof are also specifically embraced by the present invention and are disclosed herein just as if each and every such sub-combination was individually and explicitly disclosed herein.

The publications discussed herein are provided solely for their disclosure prior to the filing date of the present application. Nothing herein is to be construed as an admission that the present invention is not entitled to antedate such publication by virtue of prior invention. Further, the dates of publication provided may be different from the actual publication dates which may need to be independently confirmed.

DETAILED DESCRIPTION

As summarized above, the present disclosure provides molecular feedback circuits employing caged-degrons. Aspects of such circuits include the use of a caged-degron to modulate the output of a signaling pathway in a feedback-controlled manner. Nucleic acids encoding such molecular circuits, cells containing the molecular circuits and/or nucleic acids, as well as methods of using the subject molecular circuits, are also provided.

Molecular Circuits

Molecular circuits of the present disclosure may, in some instances and in whole or in part, be encoded by nucleic acid sequences. Such circuits may, in some instances, be present and/or configured in expression vectors and/or expression cassettes. The subject nucleic acids of the present circuits may, in some instances, be contained within a vector, including e.g., viral and non-viral vectors. Such circuits may, in some instances, be present in cells, such as immune cells, stem cells, etc., or may be introduced into cells by various means, including e.g., through the use of a viral vector. Cells may, in some instances, be genetically modified to contain and/or encode a subject circuit, where such modification may be effectively permanent (e.g., integrated) or transient as desired.

Circuits of the present disclosure, the components of which are modular, may include a signaling protein that includes a caged degron. As used herein, the term "signaling protein" generally refers to a protein of a signaling pathway, including natural and synthetic signaling pathways, described in more detail below. Any convenient and appropriate signaling protein of any convenient signaling pathway may be employed. Generally, signaling proteins include proteins that may be activated by an input of the signaling pathway with which the signaling protein is associated. A signaling pathway may generate an output that is dependent upon, or at least influenced by, the function of the signaling protein. Such outputs may be a direct or indirect result of the response of the signaling protein to the input. Useful signaling proteins include members from any convenient and appropriate point a signaling pathway, including input-receiving members, intermediate members, and output-producing members.

By "input-receiving members", as used herein, is generally meant the initial component of a signaling pathway that receives an input to initiate signaling along the pathway. Examples of input-receiving members include but are not limited to e.g., extracellular receptors (e.g., G protein-coupled receptors, protein kinases, integrins, toll-like receptors, ligand-gated ion channels, and the like) and intracellular receptors (e.g., nuclear receptors, cytoplasmic receptors, etc.). In some instances, an input-receiving member may be a protein that directly binds an input of a signaling pathway, such as a ligand input of a signaling pathway. In some instances, a signaling protein that includes a caged degron in a circuit of the present disclosure may be an input-receiving member. In some instances, a signaling protein that includes a caged degron in a circuit of the present disclosure may not be an input-receiving member, e.g., it may be an intermediate member or an output-producing member.

By "intermediate member", as used herein, is generally meant a component of a signaling pathway that is required for, or at least involved in, signal transduction but does not directly receive the initial input or directly produce or cause the final output of the signaling pathway. Examples of intermediate members of a signaling pathway include but are not limited to e.g., enzymes, binding partners, protein complex subunits, scaffold proteins, transport proteins, co-activators, co-repressors, and the like. In some instances, a signaling protein that includes a caged degron in a circuit of the present disclosure may be an intermediate member. In some instances, a signaling protein that includes a caged degron in a circuit of the present disclosure may not be an intermediate member, e.g., it may be an input-receiving member or an output-producing member.

By "output-producing member", as used herein, is generally meant a component of a signaling pathway that directly produces an output of the signaling pathway or otherwise causes the output of the signaling pathway to occur. Examples of output-producing members of a signaling pathway include but are not limited to e.g., DNA binding proteins, such as e.g., transcription factors, enzymes, and the like. In some instances, a signaling protein that includes a caged degron in a circuit of the present disclosure may be an output-producing member. In some instances, a signaling protein that includes a caged degron in a circuit of the present disclosure may not be an output-producing member, e.g., it may be an input-receiving member or an intermediate member.

Figure 1:
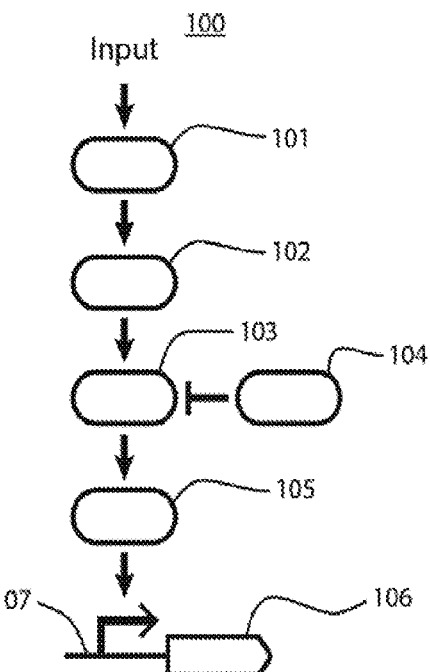
FIG. 1 schematically depicts a signaling pathway as described herein.

A schematized example of a signaling pathway is depicted in FIG. 1. As shown, the signaling pathway includes an input 100 that activates an input-receiving member 101 of the pathway. Activation of the input-receiving member 101 positively regulates a first intermediate member 102 of the pathway, which positively regulates a second intermediate member 103 of the pathway. In the pathway depicted, the second intermediate member 103 is negatively regulated by a third intermediate member 104. In the absence of inhibition by the third intermediate member 104, the second intermediate member 103 positively regulates an output-producing member 105 of the pathway. Thus, in the presence of activation by the second intermediate member 103, the output-producing member 105 is active and binds a regulatory region 107 operably linked to a sequence 106 encoding an output of the signaling pathway.

Useful signaling proteins may be a regulator of one or more signaling pathways with which the signaling protein is associated, including where the signaling protein may be a negative regulator of a signaling pathway or a positive regulator of a signaling pathway. Accordingly, molecular feedback circuits of the present disclosure include positive feedback circuits and negative feedback circuits.

For example, in some instances, a signaling protein employed in a circuit of the present disclosure may, when activated, drive an output of the signaling pathway. As such, uncaging of a caged degron, resulting in degradation of the signaling protein, may negatively regulate the output of the signaling pathway thus resulting in negative feedback. In some instances, a signaling protein employed in a circuit of the present disclosure may, when activated, inhibit an output of the signaling pathway. As such, uncaging of a caged degron, resulting in degradation of the signaling protein, may positively regulate the output of the signaling pathway thus resulting in positive feedback.

Figure 2:
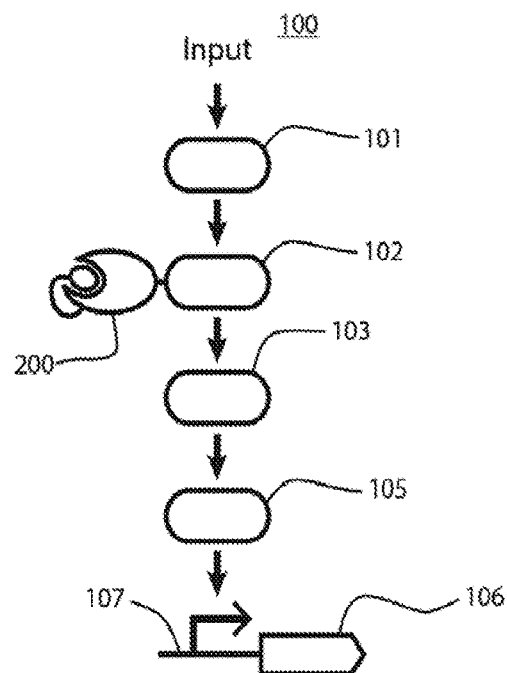
FIG. 2 schematically depicts a signaling pathway with a caged degron attached to a positive regulatory member of the signaling pathway of FIG. 1 as described herein.

FIG. 2 depicts the signaling pathway presented in FIG. 1 where a first intermediate signaling member 102, that positively regulates the pathway, has been modified to include a caged degron 200. Thus, when the caged degron 200 remains caged, signaling through the signaling pathway proceeds from the input 100, through the input-receiving member 101, to the first intermediate signaling member 102, which positively regulates downstream components of the pathway, such that, in the absence of inhibition by the third intermediate member (not pictured), the output-producing member 105 drives the output of the signaling pathway, depicted as expression of the product encoded by the sequence 106.

Figure 3:
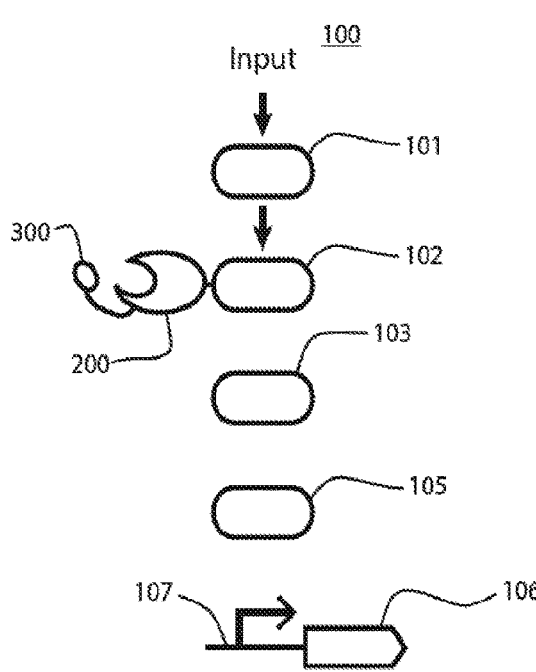
FIG. 3 depicts the uncaged degron in the schematically depicted signaling pathway of FIG. 2 as described herein.
Figure 4:
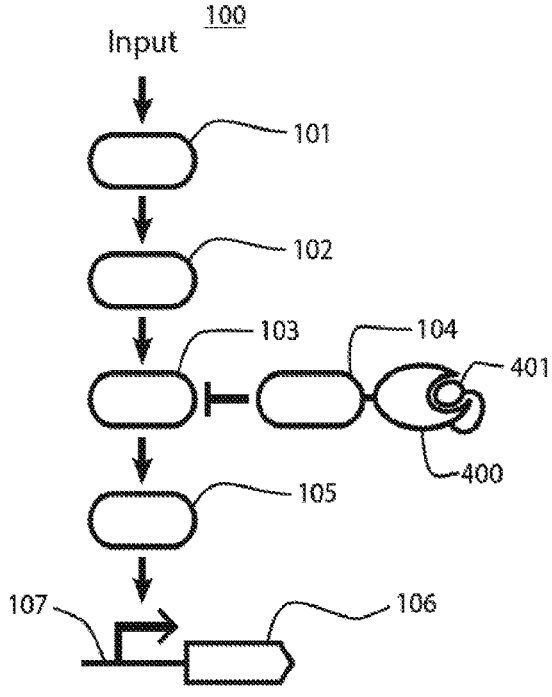
FIG. 4 schematically depicts a signaling pathway with a caged degron attached to a negative regulatory member of the signaling pathway of FIG. 1 as described herein.

As depicted in FIG. 3, uncaging of the degron 300 of the caged degron 200 results in degradation of the first intermediate member 102 and, thus a lack of positive signaling from the first intermediate member 102 to the second intermediate member 103 and subsequent points of the pathway. Accordingly, output from the sequence 106 is not generated or is reduced. In another example, depicted in FIG. 4, the inhibitory third intermediate member 104 includes a caged degron 400, such that, when the degron 401 remains caged, the presence of the third intermediate member 104 negatively regulates the second intermediate member thereby repressing expression and production of the product encoded by the output sequence 106. Correspondingly, upon uncaging (not pictured) the degron 401 induces degradation of the third intermediate member 104, thereby preventing negative regulation by the third intermediate member 104 and positively regulating the pathway 100 to promote generation of the output, i.e., at least an increase in expression of the product encoded by the sequence 106.

When integrated with a key polypeptide, the expression of which is driven by an output of the signaling pathway, coupling a caged degron to a signaling protein of the pathway may provide for positive or negative feedback as desired. For example, as depicted in FIG. 5, coupling the caged degron to positive signaling regulators creates negative feedback on the pathway, whereas coupling the caged degron to negative regulators creates positive feedback on the pathway. In some instances, negative pathway feedback can be used to dampen responses, whereas, in some instances, positive pathway feedback can be used to amplify responses or generate ultra-sensitivity. As will be readily evident, the feedback circuits of the present disclosure are highly modular and thus, circuits described herein may be readily modified as desired and/or applied to essentially any convenient and appropriate signaling pathway, including e.g., signaling pathways with measurable output via a promoter.

Feedback control enables robust, stable performance of a physical process through disturbance rejection. Implementation of feedback control may generally include: (1) the ability to measure or "sense" the output of the process, (2) a controller to generate a corrective signal based on a comparison of the output measurement against a desired output or "setpoint", and (3) a method to input or "actuate" the corrective signal to the process to be controlled. Provided herein are designed circuits that utilize degradation-based protein switches, such as the de novo protein switch degronLOCKR, to generate feedback control of biological systems. Specifically, three modules analogous to the ones described above: (1) a sensing promoter that is activated by the output of the process of interest, (2) a key peptide produced by the sensing promoter that activates degradation of (3) a signaling protein (i.e., transcription factor, kinase, etc.) that is fused to, e.g., the degronSwitch. Each of these modules can be independently tuned, as desired, via simple manipulations to achieve the desired feedback control of the process.

Signaling proteins that may be employed in the circuits of the present disclosure include signaling proteins that are endogenous components of the signaling pathway as well as heterologous or synthetic components of the signaling pathway. Such endogenous, heterologous and/or synthetic components of signaling pathways may be modified to include a caged degron, described in more detail below, for use in a circuit of the present disclosure. By "endogenous component of the signaling pathway" is generally meant a component of the signaling pathway as it occurs naturally in a cell.

By "heterologous component of the signaling pathway" is generally meant a component that functions in the signaling pathway but is derived from a cell or signaling pathway other than that in which it is employed in the subject circuit. Heterologous components may be derived from a signaling pathway separate from the signaling pathway of the subject circuit. Heterologous components may be derived from a different type of cell and/or a different organism from the cell and/or organism of the signaling pathway modulated in the subject circuit. For example, in some instances, a component of a signaling pathway from a first organism (e.g., mouse) may be employed in a corresponding signaling pathway of a second organism (e.g., human).

By "synthetic component of the signaling pathway" is generally meant a component that functions in the signaling pathway but is non-naturally derived. Non-naturally derived components may include recombinant components, including e.g., analogs, mimetics, fusions, mutants, truncated versions, fragments, and the like. Non-limiting examples of synthetic components of signaling pathways including synthetic receptors, synthetic enzymes, synthetic co-activators, synthetic co-repressors, synthetic binding partners, synthetic scaffold proteins, synthetic transcription factors, and the like.

Circuits of the present disclosure may employ one or more regulatory sequences, the control of which may be dependent upon a component of the signaling pathway with which the signaling protein is associated. For example, in some instances, a circuit of the present disclosure may include a regulatory sequence responsive to an output of the signaling pathway. Regulatory sequences may be operably linked to one or more nucleic acid sequences encoding one or more components of the subject circuit. For example, a regulatory sequence may be operably linked to a nucleic acid sequence encoding a key polypeptide.

In some instances, a circuit may include a regulatory sequence operably linked to a nucleic acid sequence encoding the signaling protein. Regulatory sequences operably linked to a sequence encoding the signaling protein of the subject circuits may vary and may include endogenous and heterologous regulatory sequences, including but not limited to e.g., native promoters, native enhancers, heterologous promoters, heterologous enhancers, synthetic regulatory sequences, and the like. Regulatory sequences operably linked to a sequence encoding the signaling protein may be constitutive or inducible as desired. In some instances, a regulatory sequence operably linked to the nucleic acid sequence encoding a signaling protein is a native promoter of the signaling protein.

In some instances, a regulatory sequence may include one or more binding sites (e.g., 1 or more, 2 or more, 2 to 10, 3 to 10, 4 to 10, 5 to 10, 2 to 6, 3 to 6, 4 to 6, 1, 2, 3, 4, 5, 6, 7, 8, 9, 10, etc.) for a transcription factor of the output, including e.g., where the transcription factor is an endogenous, heterologous, or synthetic transcription factor that functions in the signaling pathway.

Regulatory sequences of circuits of the present disclosure may be controlled by, or otherwise responsive to, an output of a signaling pathway. For example, in some instances, an output of a signaling pathway, which the subject circuit is configured to influence, may induce expression of a coding sequence through a regulatory sequence operably linked to the coding sequence. By connecting the regulation of a sequence encoding a component of a circuit of the present disclosure to an output of the signaling pathway, circuits of the present disclosure may provide feedback that is response to the output.

Useful signaling pathway outputs employing in circuits of the present disclosure may vary and may include essentially any output that may be configured to directly or indirectly influence expression through a regulatory sequence. Non-limiting examples of useful signaling pathway outputs include but are not limited to e.g., activity (e.g., activation, repression, etc.) of a transcription factor, expression of a transcription factor, translocation of a transcription factor, activity (e.g., activation, repression, etc.) of an enzyme, expression of an enzyme, production of a signaling molecule, secretion of a signaling molecule, cellular activation (including e.g., activation of native cellular programs, such as but not limited to e.g., immune activation, immune suppression, proliferation, etc.), and the like.

Signaling pathways may be modulated (e.g., activated, repressed, etc.) by one or more inputs. Inputs of signaling pathways may vary and may include endogenous (e.g., native) inputs of signaling pathways and heterologous (e.g., engineered or synthetic) signaling pathway inputs. As signaling pathways, and signaling pathway outputs, may be native or synthetic, signaling pathway inputs may similarly be native or synthetic.

Native signaling pathways may, in many instances, be controlled by a native or natural receptor of the pathway. Non-limiting examples of native signaling pathways include but are not limited to e.g., the AKT signaling pathway, the Akt/PKB signaling pathway, the AMPK signaling pathway, the apoptosis signaling pathway, the BMP signaling pathway, the cAMP-dependent pathway, the estrogen signaling pathway, the hedgehog signaling pathway, the hippo signaling pathway, an immune activation pathway, an immune suppression pathway, an immune cell differentiation pathway, an insulin signal transduction pathway, the JAK-STAT signaling pathway, the MAPK/ERK signaling pathway, the mTOR signaling pathway, the NF-κB signaling pathway, the nodal signaling pathway, the notch signaling pathway, the p53 signaling pathway, the PI3K signaling pathway, the TGF beta signaling pathway, the TLR signaling pathway, the TNF signaling pathway, the VEGF signaling pathway, the Wnt signaling pathway, and the like.

Non-limiting examples of synthetic signaling pathways include, but are not limited to, those pathways controlled by a synthetic or engineered receptor, such as but not limited to e.g., a CAR, an engineered TCR, a synNotch, etc. Signaling pathways are described in more detail below.

Schematized examples of modulating a synthetic syn-Notch signaling pathway and a synthetic CAR signaling pathway using circuits of the present disclosure are depicted in FIG. 6 and FIG. 7, respectively. As shown in FIG. 6, a synNotch receptor is triggered by an antigen input to release a synthetic transcription factor (synTF) that includes an attached caged degron. Release of the intracellular portion of the synNotch after antigen binding induces expression of a desired output which is controlled by the synTF. In the embodiment pictured, the synTF output also controls expression of a key polypeptide. Thus, when the released intracellular portion of the synNotch induces expression of the key polypeptide, the key polypeptide uncages the degron resulting in degradation of the key polypeptide and the synTF-containing intracellular portion of the synNotch receptor. Accordingly, by providing negative feedback through the synthetic synNotch signaling pathway a controlled custom output is generated.

As shown in FIG. 7, a CAR is triggered by an antigen input to induce an internal signaling cascade, e.g., leading immune cell activation through immune stimulatory signaling through the CD3z domain of the CAR. The CAR also includes an attached caged degron and the cell includes a regulatory sequence, operably linked to a sequence encoding a key polypeptide, that is responsive to a component of the internal signaling cascade. Thus, activation of the internal signaling cascade induces expression of a desired output, such as immune cell activation, which is controlled by the CAR. However, in the embodiment pictured, the CAR output also controls expression of the key polypeptide. Thus, when signaling cascade induces expression of the key polypeptide, the key polypeptide uncages the degron resulting in degradation of the key polypeptide and the CAR. Accordingly, by providing negative feedback through the synthetic CAR signaling pathway T-cell activation is controlled.

As will be readily apparent, these examples employing synthetic signaling pathways are not intended to be limiting.

Caged Degrons and Key Polypeptides

As summarized above, signaling proteins employed in the circuits of the present disclosure may include a caged degron. The caged degron included in a subject signaling protein of the present circuits may vary and may be attached or otherwise integrated into the signaling protein as desired. Any convenient method of attaching or integrating a caged degron into a subject signaling protein may be employed, including but not limited to e.g., where the caged degron is attached via a linker.

Caged degrons employed in the herein described circuits will generally include a single polypeptide that includes one or more degrons and multiple other domains that, when in a three dimensional configuration, prevent the degron(s) from triggering degradation of the polypeptide and any attached protein, such as e.g., an attached signaling protein. Caged degrons of the subject circuits may be uncaged by a key polypeptide that, when present, uncages the degron(s) thereby triggering degradation of the polypeptide and any attached proteins, such as e.g., an attached signaling protein.

The "cage" portion of a caged degron, also referred to herein in some instances as a "switch" or "switches", may be made up of multiple polypeptide domains having intramolecular affinity for one another such that the domains assemble into a three-dimensional structure sufficient for preventing the degron(s) from triggering degradation. For example, in some instances, a cage portion may include multiple units of secondary protein structure, such as alpha helices, that, in the absence of the key polypeptide, assemble into a three-dimensional structure, e.g., an alpha helix bundle, that cages a degron. A cage portion of a caged degron may include a "locker domain" or "cage domain" or "structural region" that provides the majority of the formed three-dimensional structure and a "latch domain" that is capable of being displaced by the key polypeptide to uncage the degron.

Cage polypeptides may comprise a helical bundle comprising between 2 and 7 alpha-helices. In various embodiments, the helical bundle comprises 3-7, 4-7, 5-7, 6-7, 2-6, 3-6, 4-6, 5-6, 2-5, 3-5, 4-5, 2-4, 3-4, 2-3, 2, 3, 4, 5, 6, or 7 alpha helices.

Each alpha helix may be of any suitable length and amino acid composition as appropriate for an intended use. In some embodiments, each helix is independently 38 to 58 amino acids in length. In some embodiments, each helix is independently between 18-60, 18-55, 18-50, 18-45, 22-60, 22-55, 22-50, 22-45, 25-60, 25-55, 25-50, 25-45, 28-60, 28-55, 28-50, 28-45, 32-60, 32-55, 32-50, 32-45, 35-60, 35-55, 35-50, 35-45, 38-60, 38-55, 38-50, 38-45, 40-60, 40-58, 40-55, 40-50, or 40-45 amino acids in length.

The amino acid linkers connecting each alpha helix can be of any suitable length or amino acid composition as appropriate for an intended use. In one embodiment, each amino acid linker is independently between 2 and 10 amino acids in length. In various embodiments, each amino acid linker is independently 3-10, 4-10, 5-10, 6-10, 7-10, 8-10, 9-10, 2-9, 3-9, 4-9, 5-9, 6-9, 7-9, 8-9, 2-8, 3-8, 4-8, 5-8, 6-8, 7-8, 2-7, 3-7, 4-7, 5-7, 6-7, 2-6, 3-6, 4-6, 5-6, 2-5, 3-5, 4-5, 2-4, 3-4, 2-3, 2, 3, 4, 5, 6, 7, 8, 9, or 10 amino acids in length. Linkers may be structured or flexible (e.g. poly-GS).

In some embodiments, a useful locker domain may include five alpha helices which may form a six helix bundle with a latch domain that includes an alpha helix. The alpha helices of the locker domain may interact with each other via hydrogen bond networks formed between helical interfaces. The alpha helix of the latch domain may interact with helices of the locker domain other via hydrogen bond networks formed between helical interfaces shared between the latch domain alpha helix and helices of the locker domain. Interactions between a latch domain helix and a locker domain helix may be weaker than a corresponding interaction between two locker domain helices.

A latch region may be present near either terminus of the cage polypeptide. In one embodiment, the latch region is placed at the C-terminal helix so as to position the bioactive peptide for maximum burial of the functional residues that need to be sequestered to maintain the bioactive peptide in an inactive state while simultaneously burying hydrophobic residues and promoting solvent exposure/compensatory hydrogen bonds of polar residues. In various embodiments, the latch region may comprise a part or all of a single alpha helix in the cage polypeptide at the N-terminal or C-terminal portions. In various other embodiments, the latch region may comprise a part or all of a first, second, third, fourth, fifth, sixth, or seventh alpha helix in the cage polypeptide. In other embodiments, the latch region may comprise all or part of two or more different alpha helices in the cage polypeptide; for example, a C-terminal part of one alpha helix and an N-terminal portion of the next alpha helix, or all of two consecutive alpha helices.

In some instances, one or more of a latch domain, a locker domain, a key polypeptide, or a portion thereof, may be modified to achieve a desired relative affinity. For example, in some instances, a latch domain may be modified to have an affinity for the locker domain that is lower relative to the affinity of the key polypeptide for the locker domain. In some instances, a key polypeptide may be modified to have an affinity for the locker domain that is higher relative to the affinity of the latch domain for the locker domain. In some instances, a locker domain may be modified to have an affinity for the latch domain that is lower relative to the affinity of the locker domain for the key polypeptide.

In some instances, all three of a latch domain, a locker domain, and a key polypeptide may be modified to "tune" the affinities of each element to facilitate caging and uncaging at desired amounts (e.g., expression levels, concentrations, etc.) of key polypeptide. Various modifications may be employed to modulate the affinities of latch domains, locker domains, and key polypeptides, including but not limited to e.g., modifications of the overall length of the domain/polypeptide or the length of a portion of the domain/polypeptide, e.g., an alpha helix of the domain/polypeptide. Other useful modifications include but are not limited to e.g., the presence and/or size of a toehold truncation, the presence and/or number of destabilizing mutations, and the like.

In some embodiments, the dynamic range of activation by key polypeptides can be tuned by truncating the latch region length to be shorter than the alpha-helices in the structural region, simultaneously weakening the cage polypeptide-latch region interaction and opening an exposed region on the cage polypeptide that the key polypeptide can bind to as a "toehold" (i.e., toehold truncations). Similarly, the dynamic range of activation by key polypeptides can also be tuned in a similar manner by designing mutations into the Latch that weaken the cage polypeptide-latch region interaction (i.e., destabilizing mutations). In some embodiments, the latch region can be one or more helices totaling in length 18-150 amino acids, 18-100 amino acids, or 18-58 amino acids. In some embodiments the latch region may include, in all or in part, helical secondary structure, beta strand secondary structure, loop secondary structure, or combinations thereof.

Accordingly, the overall length of a caged degron may vary and may range from about 200 amino acid residues or less to about 600 amino acid residues or more, including but not limited to e.g., 200 aa to 600 aa, 200 aa to 575 aa, 200 aa to 550 aa, 200 aa to 525 aa, 200 aa to 500 aa, 200 aa to 475 aa, 200 aa to 450 aa, 200 aa to 425 aa, 200 aa to 400 aa, 200 aa to 375 aa, 200 aa to 350 aa, 200 aa to 325 aa, 200 aa to 300 aa, 200 aa to 275 aa, 200 aa to 250 aa, 200 aa to 225 aa, 250 aa to 600 aa, 250 aa to 575 aa, 250 aa to 550 aa, 250 aa to 525 aa, 250 aa to 500 aa, 250 aa to 475 aa, 250 aa to 450 aa, 250 aa to 425 aa, 250 aa to 400 aa, 250 aa to 375 aa, 250 aa to 350 aa, 250 aa to 325 aa, 250 aa to 300 aa, 250 aa to 275 aa, 300 aa to 600 aa, 300 aa to 575 aa, 300 aa to 550 aa, 300 aa to 525 aa, 300 aa to 500 aa, 300 aa to 475 aa, 300 aa to 450 aa, 300 aa to 425 aa, 300 aa to 400 aa, 300 aa to 375 aa, 300 aa to 350 aa, 300 aa to 325 aa, 325 aa to 600 aa, 325 aa to 575 aa, 325 aa to 550 aa, 325 aa to 525 aa, 325 aa to 500 aa, 325 aa to 475 aa, 325 aa to 450 aa, 325 aa to 425 aa, 325 aa to 400 aa, 325 aa to 375 aa, 325 aa to 350 aa, 350 aa to 600 aa, 350 aa to 575 aa, 350 aa to 550 aa, 350 aa to 525 aa, 350 aa to 500 aa, 350 aa to 475 aa, 350 aa to 450 aa, 350 aa to 425 aa, 350 aa to 400 aa, 350 aa to 375 aa, etc.

In some instances, the length of a domain, e.g., an alpha helix domain, of a polypeptide or domain thereof may range from 2 amino acid residues to 300 amino acid residues or more, including but not limited to e.g., 2 aa to 300 aa, 2 aa to 250 aa, 2 aa to 200 aa, 2 aa to 150 aa, 2 aa to 100 aa, 2 aa to 50 aa, 5 aa to 300 aa, 5 aa to 250 aa, 5 aa to 200 aa, 5 aa to 150 aa, 5 aa to 100 aa, 5 aa to 50 aa, 10 aa to 300 aa, 10 aa to 250 aa, 10 aa to 200 aa, 10 aa to 150 aa, 10 aa to 100 aa, 10 aa to 50 aa, 20 aa to 300 aa, 20 aa to 250 aa, 20 aa to 200 aa, 20 aa to 150 aa, 20 aa to 100 aa, 20 aa to 90 aa, 20 aa to 80 aa, 20 aa to 70 aa, 20 aa to 60 aa, 20 aa to 50 aa, 20 aa to 40 aa, 20 aa to 30 aa, 30 aa to 300 aa, 30 aa to 250 aa, 30 aa to 200 aa, 30 aa to 150 aa, 30 aa to 100 aa, 30 aa to 90 aa, 30 aa to 80 aa, 30 aa to 70 aa, 30 aa to 60 aa, 30 aa to 50 aa, 30 aa to 40 aa, 40 aa to 300 aa, 40 aa to 250 aa, 40 aa to 200 aa, 40 aa to 150 aa, 40 aa to 100 aa, 40 aa to 90 aa, 40 aa to 80 aa, 40 aa to 70 aa, 40 aa to 60 aa, 40 aa to 50 aa, 50 aa to 300 aa, 50 aa to 250 aa, 50 aa to 200 aa, 50 aa to 150 aa, 50 aa to 100 aa, 50 aa to 90 aa, 50 aa to 80 aa, 50 aa to 70 aa, 50 aa to 60 aa, etc.

In some instances, the length of one or more, including each of the, helices of a locker domain and/or a helix of a latch domain may range from 20 amino acid residues or less to 60 amino acids or more, including but not limited to e.g., 20 aa to 60 aa, 25 aa to 60 aa, 25 aa to 55 aa, 30 aa to 60 aa, 30 aa to 55 aa, 30 aa to 50 aa, 30 aa to 45 aa, 35 aa to 60 aa, 35 aa to 55 aa, 35 aa to 50 aa, 35 aa to 45 aa, etc.

In some instances, a latch domain may include a toehold truncation and/or a key polypeptide may include toehold amino acids. The term "toehold", as used herein, generally refers to a number of amino acid residues present in a key polypeptide, e.g., that are absent in a corresponding latch polypeptide, that provide the key polypeptide with a toehold to outcompete the latch domain for binding of the locker domain. The term "toehold truncation", as used herein, generally refer to amino acid residues removed from a latch domain, e.g., an alpha helix of a latch domain and/or the c-terminus of a latch domain, to reduce the affinity of the latch domain for the locker domain, e.g., to reduce the affinity of the latch domain for the locker domain relative to the affinity of the key polypeptide for the locker domain. Accordingly, a latch polypeptide without a toehold truncation will have a higher affinity for the locker domain as compared to a latch domain with a toehold truncation. Correspondingly, the difference in affinity to a locker domain of a corresponding latch and key pair will be greater when the pair includes a toehold than when the pair does not include a toehold. The length of toeholds and toehold truncations will vary and may range from 2 amino acid residues to 20 amino acid residues or more, including but not limited to e.g., 2 aa to 20 aa, 2 aa to 18 aa, 2 aa to 16 aa, 2 aa to 14 aa, 2 aa to 12 aa, 2 aa to 10 aa, 2 aa to 8 aa, 4 aa to 20 aa, 4 aa to 18 aa, 4 aa to 16 aa, 4 aa to 14 aa, 4 aa to 14 aa, 4 aa to 10 aa, 4 aa to 9 aa, 4 aa to 8 aa, 2 aa, 3 aa, 4 aa, 5 aa, 6 aa, 7 aa, 8 aa, 9 aa, 10 aa, 11 aa, 12 aa, 13 aa, 14 aa, 15 aa, 16 aa, 17 aa, 18 aa, etc.

In some instances, the length of a toehold may be indicated in the naming of a particular construct, e.g., as included as a suffix to the design name: For example "–t0" may indicate no toehold, and "–t9" means a toehold of 9 residues (i.e. Latch truncated by 9 residues).

In some instances, one or more portions of a caged degron and/or key polypeptide may be mutated or otherwise made to contain a mutation, including were such mutations may be made relative to various starting amino acid sequences, such as e.g., an initial locker domain sequence, an initial latch domain sequence, an initial alpha helix sequence, an initial key polypeptide. In some instances, mutations in a domain of a polypeptide may be made relative to a corresponding structure in another domain of the polypeptide or a corresponding domain in another polypeptide. For example, in some instances, a latch domain may be mutated relative to locker domain, a locker domain may be mutated relative to a latch domain, a latch domain may be mutated relative to a key polypeptide, a key polypeptide may be mutated relative to a latch domain, a locker domain may be mutated relative to a key polypeptide, a key polypeptide may be mutated relative to a locker domain, and the like.

Useful mutations include amino acid substitutions, amino acid insertions, truncations, deletions, and the like. In some instances, an introduced mutation may increase or decrease the relative affinity of an intra- or intermolecular interaction between two domains of a polypeptide or two domains of two polypeptides. In some instances, mutation may be employed to modify and/or tune the affinity of components of a caged degron and key polypeptide system for one another. Essentially any mutation may find use in modifying one or more polypeptides of, or encoded by, a circuit of the present disclosure. The number of mutations in a subject polypeptide or domain thereof may vary and may range from one to 20 or more, including but not limited to e.g., at least 1, at least 2, at least 3, at least 4, at least 5, no more than 20, no more than 15, no more than 10, no more than 5, 5 to 20, 10 to 20, 15 to 20, 1 to 15, 1 to 10, 1 to 5, 2 to 20, 2 to 15, 2 to 20, 2 to 5, 1, 2, 3, 4, 5, 6, 7, 8, 9, 10, 11, 12, 13, 14, 15, 16, 17, 18, 19, 20, etc.

Useful mutations include destabilizing mutations. The term "destabilizing mutation", as used herein, generally refers to a mutation that destabilizes the formation of a structure or interaction. A polypeptide having one or more destabilizing mutations may form a subject structure less readily than the corresponding polypeptide without the destabilizing mutation(s). Structures that may be destabilized by the presence of a destabilizing mutation include secondary and tertiary protein structures, including e.g., alpha helices, helix bundles, and the like. A polypeptide having one or more destabilizing mutations may form an interaction, including intermolecular and intramolecular interactions, less readily than the corresponding polypeptide without the destabilizing mutation(s). For example, in some instances, a latch domain may include one or more destabilizing mutations that destabilize the formation of a helix bundle structure, that includes the latch domain and a corresponding locker domain, relative to the formation of the structure, or an interaction necessary to form the structure, in the absence of the destabilizing mutations.

Mutation useful as destabilizing mutations will vary an may include, but are not limited to, e.g., substitution mutations. Non-limiting examples of useful substitution mutations include substitution of a hydrophobic amino acid (e.g., alanine, valine, isoleucine, leucine, methionine, phenylalanine, proline, tyrosine or tryptophan) for a less hydrophobic, non-hydrophobic or polar amino acid (e.g., serine, threonine, asparagine, glutamine, arginine, histidine, lysine, aspartic acid, glutamic acid, cystine, etc.); substitution of a large hydrophobic amino acid (e.g., phenylalanine, tyrosine or tryptophan) for a smaller amino acid (e.g., an alanine, a serine, etc.); substitution of a small hydrophobic amino acid (e.g., an alanine, valine, etc.) for a large hydrophobic amino acid (e.g., phenylalanine, tyrosine or tryptophan), and the like. In some instances, a useful destabilizing mutation may be a serine substitution or an alanine substitution. In some instances, useful serine substitutions may include e.g., a valine to serine substitution, an isoleucine to serine substitution, or the like.

In some instances, components of a helical bundle may be asymmetrized, e.g., an employed LOCKR may be an asymmetrized LOCKR switch. For example, initial LOCKR switch design were built starting from a de novo designed symmetric homotrimer, 5L6HC3_1, which contains 6 helices. In some instance, the symmetric designs may be redesigned to be asymmetric (such examples provided herein include those with the prefix "asym"). For example, a symmetric LOCKR may be redesigned using computational software; where residues known to be important for LOCKR function are kept fixed, and remaining residues are optimized to preserve hydrophobic packing while introducing sequence diversity that minimizes the number of repeating amino acid sequences and motifs. Synthetic DNA coding for the designs may then be obtained and designs may be expressed, purified, and biophysically characterized. Asymmetrized LOCKR switches are described in more detail in U.S. Provisional Patent Application Nos. 62/700,681; 62/785,537; and 62/788,398, the disclosures of which are incorporated herein by reference in their entirety.

In some instances, a cage of a caged degron employed in a circuit of the present disclosure may include a polypeptide having at least 40%, 45%, 50%, 55%, 60%, 65%, 70%, 75%, 80%, 85%, 90%, 91%, 92%, 93%, 94%, 95%, 96%, 97%, 98%, 99%, or 100% sequence identity along its length to the amino acid sequence of a cage polypeptide disclosed in U.S. Provisional Patent Application Nos. 62/700,681, 62/785, 537, 62/788,398 (the disclosures of which are incorporated herein by reference in their entirety), and/or disclosed herein, not including optional amino acid residues, and optionally not including amino acid residues in the latch region, such as a cage polypeptide provided by SEQ ID NOS. 63-1169 and/or Table 3 (inclusive of any appendices therein). As noted in the disclosure, cage polypeptides may include residues that are optional; in some instances these residues are indicated in parentheses, and in some embodiments such residues are not included in determining percent sequence identity. In some embodiments, optional residues may be included in determining percent sequence identity.

In some instances, nomenclature for the cage may be identified by 1fix-short and 1fix-latch, indicating similar, yet distinct, embodiments of cage polypeptides as described above. A cage polypeptide (e.g., Cage$_a$) may be activated by a corresponding key polypeptide (e.g., Key$_a$) as outlined in the following "Cage/Key Correspondence" table. The functional groups encoded in the latch may be identified by the third portion of the name while the suffix may indicate the presence of a toehold. For example, 1fix-short-Bim-t0 encodes Bim on the 1fix-short scaffold with no toehold. In another example, 1fix-latch_Mad1SID_T0_2 indicates that the 1fix-latch scaffold was used to encode Mad1SID with no residues. The suffix 2 indicates that there are two versions where the functional sequence is encoded in different locations on the latch region.

Cage/Key Correspondence Table:

| Row number | Cage (column 1) | Key (column 2) |
|---|---|---|
| 1 | SB76L SB76L_17, SB76L_18, LOCKR_extend5, LOCKR_extend9, LOCKR_extend18, miniLOCKRa_1, miniLOCKRa_2, aBc12LOCKR, pBimLOCKR, BimLOCKR_extend5, BimLOCKR_extend9, BimLOCKR_extend18, strepLOCKRa (all variants), SB13_LOCKR (and extend18), ZCX12_LOCKR (and extend18), fretLOCKRa, 1fix_302_L3455_t9_Mad1SID, 1fix_302_t5_Mad1SID, 1fix_302_t0_latch_Mad1SID, 1fix_302_I329S_Mad1SID_t9, 1fix_302_I328S_L3455_Mad1SID_t9, 1fix_309_Mad1SID_t9, 1fix_302_Mad1SID_t9, 1fix-long-Bim-t0, 1fix-long-GFP-t0, 1fix-short-BIM-t0, 1fix-short-GFP-t0, 1fix-short-noBim-t0, 1fix-short-noBim(AYYA)-t0, 1fix-short-Bim-t0-relooped, 1fix-short-spytag-t0_2, 1fix-short-spytag-t0_8, 1fix-short-TEV-t0_1 , 1fix-short-TEV-t0_6, 1fix-short-nanoBit-t0_1, 1fix-short-nanoBit-t0_3, 1fix-short-RHIM-t0_8, 1fix-short-RHIM-t0_19, 1fix-short-RHIM-t0_22, 1fix-short-gcn4-t0_4, 1fix-short-ccDi-t0_6, 1fix-short-cc-a-t0_6, 1fix-short-cc-b-t0_6 | SB76_C-helix, SB76_C-helix-biotin, p5_MBP, p9_MBP, p18_MBP, p76-long, p76-short, k76-long, k76-short, p76_GLISE, p76_GSSEKIS, p76_R26G, p76-short_E19G, p76-short_GLISE_E01_EGFR, p76-short_AE_EGFR, p76-short_AAE_EGFR, p76-short_EE_EGFR |
| 2 | LOCKRb, BimLOCKRb, fretLOCKRb | key_b |
| 3 | LOCKRc, miniLOCKRc_1, miniLOCKRc_2, BimLOCKRc, fretLOCKRc | key_c |
| 4 | LOCKRd, BimLOCKRd, fretLOCKRd | key_d |
| 5 | LOCKRe | key_e |
| 6 | LOCKRf | key_f |
| 7 | Histag_TEV_1fix_VMAc_C_BIMlatcht9 | HIStag_sfGFP_VMAn_p18 |
| 8 | HIStag_sfGFP_VMAn_1fix_BIM_t0_latch | Histag_p18_VMAc_mCherry |
| 9 | Spycatcher-1fix-long-GFP-t0, Spycatcher-1fix-short-GFP-t0 | p76-spytag, p76-short-spytag |
| 10 | STREPII-2plus1_LOCK_1 | 2plus1_Key_1 |
| 11 | STREPII-2plus1_LOCK_2 | 2plus1_Key_2 |
| 12 | STREPII-2plus1_LOCK_3, STREPII-2plus1_LOCK_3-relooped | 2plus1_Key_3 |
| 13 | STREPII-2plus1_LOCK_4C | 2plus1_Key_4C |
| 14 | STREPII-2plus1_LOCK_4N | 2plus1_Key_4N |
| 15 | STREPII-3plus1_LOCK_1 | 3plus1_Key_1 |
| 16 | STREPII-3plus1_LOCK_2 | 3plus1_Key_2 |
| 17 | STREPII-3plus1_LOCK 3, STREPII-3plus1_LOCK_3-relooped | 3plus1_Key_3 |
| 18 | STREPII-3plus1_LOCK_4 | 3plus1_Key_4 |

-continued

| Cage/Key Correspondence Table: | | |
|---|---|---|
| Row number | Cage (column 1) | Key (column 2) |
| 19 | 1fix-short_cODC_t11, 1fix-short_cODC_t8, 1fix-short_cODC_t5, 1 fix-short_cODC, 1fix-short_cODC_mut_t6, 1fix-short_cODC_mut, degron-miniLOCKRa_t12, degron-miniLOCKRa_2_t9, degron-miniLOCKRa_l_t12, degron-miniLOCKRa_l_t9, degronLOCKRa_320_t16, degronLOCKRa_324_t12, degronLOCKRa_CAonly, degronLOCKRa_327_noPro, degronLOCKRa_327 | key_a, key_a_m4, key_a_m9, key_a_m12, key_a_m15 |
| 20 | degronLOCKRb, degronLOCKRb_t13 | key_b |
| 21 | degronLOCKRc, degronLOCKRc_t13, degron-miniLOCKRc_l_t9, miniLOCKRc_l_t13, miniLOCKRc_2_t9, miniLOCKRc_t13, | key_c degron- degron- degron- degronLOCKRc_1fix_t13 |
| 22 | degronLOCKRd | key_d, key_d_m4, key_d_m7 |

As noted above, orthogonal LOCKR designs are denoted by lowercase letter subscripts: LOCKR$_a$ includes Cage$_a$ and Key$_a$, and LOCKR$_b$ includes Cage$_b$ and Key$_b$, etc. such that Cage$_a$ is only activated by Key$_a$, and Cage$_b$ is only activated by Key$_b$, etc. Prefixes in the polypeptide and LOCKR names denote the functional group that is encoded and controlled by the LOCKR switch. In one embodiment, all 3plus1 (3+1) and 2plus1 (2+1) cage and key polypeptides disclosed herein and in the attached appendices are matched by identification numbers. In some examples additional features of cage and key polypeptide sequences are enumerated. For example in the provided tables, the prefix 2plus1 or 3plus1 defines the helix architecture with the first number defining the number of helices in the structural region, with the second number defining the number of helices in the latch region. The N-term or C-term suffix defines if the latch on the cage component of the kit encompasses the N or C terminus respectively, as is denoted by brackets [ ] in certain sequences. The N-term versus C-term and numerical suffix in some examples corresponds to the same suffix on the key with which it is activated. For example, cage 2plus1_Cage_Cterm_26 in is activated by 2plus2_Key_Cterm_26.

In some instances, a caged degron of the present disclosure may share at least 70% sequence identity, including e.g., at least 75%, at least 80%, at least 85%, at least 90%, at least 95%, at least 96%, at least 97%, at least 98%, at least 99%, or 100% sequence identity with the following amino acid sequence of degronLOCKR_a_327:

(SEQ ID NO: 1)
SKEAVTKLQALNIKLAEKLLEAVTKLQALNIKLAEKLLEALARLQELNIA

LVYLAVELTDPKRIADEIKKVKDKSKEIVERAEEEIARAAAESKKILDEA

EEEIARAAAESKKILDEGSGSGSDAVAELQALNLKLAELLLEAVAELQAL

NLKLAELLLEAIAKLQELNIKLVELLTKLTDPATIREAIRKVKEDSERIV

AEAERLIAAAKAESERIIREAERLIAAAKAESERIIREGSGSGDPDVARL

QELNIELARELLRDVARLQELNIELARELLRAAAELQELNIKLVELASEL

TDPDEARKAIARVKRESKRIVEDAERLPMSCAQESEKISREAERLIREA

A.

In some instances, a caged degron of the present disclosure may share at least 70% sequence identity, including e.g., at least 75%, at least 80%, at least 85%, at least 90%, at least 95%, at least 96%, at least 97%, at least 98%, at least 99%, or 100% sequence identity with the following amino acid sequence of degronLOCKR_a_327_noPro:

(SEQ ID NO: 2)
SKEAVTKLQALNIKLAEKLLEAVTKLQALNIKLAEKLLEALARLQELNIA

LVYLAVELTDPKRIADEIKKVKDKSKEIVERAEEEIARAAAESKKILDEA

EEEIARAAAESKKILDEGSGSGSDAVAELQALNLKLAELLLEAVAELQAL

NLKLAELLLEAIAKLQELNIKLVELLTKLTDPATIREAIRKVKEDSERIV

AEAERLIAAAKAESERIIREAERLIAAAKAESERIIREGSGSGDPDVARL

QELNIELARELLRDVARLQELNIELARELLRAAAELQELNIKLVELASEL

TDPDEARKAIARVKRESKRIVEDAERLAMSCAQESEKISREAERLIR

EAA.

In some instances, a caged degron of the present disclosure may share at least 70% sequence identity, including e.g., at least 75%, at least 80%, at least 85%, at least 90%, at least 95%, at least 96%, at least 97%, at least 98%, at least 99%, or 100% sequence identity with the following amino acid sequence of degronLOCKR_a_CAonly:

(SEQ ID NO: 3)
SKEAVTKLQALNIKLAEKLLEAVTKLQALNIKLAEKLLEALARLQELNIA

LVYLAVELTDPKRIADEIKKVKDKSKEIVERAEEEIARAAAESKKILDEA

EEEIARAAAESKKILDEGSGSGSDAVAELQALNLKLAELLLEAVAELQAL

NLKLAELLLEAIAKLQELNIKLVELLTKLTDPATIREAIRKVKEDSERIV

AEAERLIAAAKAESERIIREAERLIAAAKAESERIIREGSGSGDPDVARL

QELNIELARELLRDVARLQELNIELARELLRAAAELQELNIKLVELASEL

TDPDEARKAIARVKRESKRIVEDAERLIRECAAASEKISREAERLIR

EAA.

In some instances, a caged degron of the present disclosure may share at least 70% sequence identity, including e.g., at least 75%, at least 80%, at least 85%, at least 90%, at least 95%, at least 96%, at least 97%, at least 98%, at least 99%, or 100% sequence identity with the following amino acid sequence of degronLOCKR_a_324_t12:

```
                                           (SEQ ID NO: 4)
SKEAVTKLQALNIKLAEKLLEAVTKLQALNIKLAEKLLEALARLQELNIA

LVYLAVELTDPKRIADEIKKVKDKSKEIVERAEEEIARAAAESKKILDEA

EEEIARAAAESKKILDEGSGSGSDAVAELQALNLKLAELLLEAVAELQAL

NLKLAELLLEAIAKLQELNIKLVELLTKLTDPATIREAIRKVKEDSERIV

AEAERLIAAAKAESERIIREAERLIAAAKAESERIIREGSGSGDPDVARL

QELNIELARELLRDVARLQELNIELARELLRAAAELQELNIKLVELASEL

TDPDEARKAIARVKRESKRIVEDLIMSCAQESAASEKISREAERLIR.
```

In some instances, a caged degron of the present disclosure may share at least 70% sequence identity, including e.g., at least 75%, at least 80%, at least 85%, at least 90%, at least 95%, at least 96%, at least 97%, at least 98%, at least 99%, or 100% sequence identity with the following amino acid sequence of degronLOCKR_a_320_t16:

```
                                           (SEQ ID NO: 5)
SKEAVTKLQALNIKLAEKLLEAVTKLQALNIKLAEKLLEALARLQELNIA

LVYLAVELTDPKRIADEIKKVKDKSKEIVERAEEEIARAAAESKKILDEA

EEEIARAAAESKKILDEGSGSGSDAVAELQALNLKLAELLLEAVAELQAL

NLKLAELLLEAIAKLQELNIKLVELLTKLTDPATIREAIRKVKEDSERIV

AEAERLIAAAKAESERIIREAERLIAAAKAESERIIREGSGSGDPDVARL

QELNIELARELLRDVARLQELNIELARELLRAAAELQELNIKLVELASEL

TDPDEARKAIARVKRESKRLVMSCAQESREAAAASEKISREAE.
```

In some instances, a caged degron of the present disclosure may share at least 70% sequence identity, including e.g., at least 75%, at least 80%, at least 85%, at least 90%, at least 95%, at least 96%, at least 97%, at least 98%, at least 99%, or 100% sequence identity with the following amino acid sequence of mini-degronLOCKRa_1_t9:

```
                                           (SEQ ID NO: 6)
NKEDATEAOKKAIRAAEELLKDVTRIOERAIREAEKALERLARVQEEAIR

RVYEAVESKNKEELKKVKEEIEELLRRLKRELDELEREIRELLKEIKEKA

DRLEKEIRDLIERIRRDRNASDEVVTRLARLNEELIRELREDVRRLAELN

KELLRELERAARELARLNEKLLELADRVETEEEARKAIARVKRESKRIVE

DAERLAMSCAQESEKISREAERLIREAA.
```

In some instances, a caged degron of the present disclosure may share at least 70% sequence identity, including e.g., at least 75%, at least 80%, at least 85%, at least 90%, at least 95%, at least 96%, at least 97%, at least 98%, at least 99%, or 100% sequence identity with the following amino acid sequence of mini-degronLOCKRa_1_t12:

```
                                           (SEQ ID NO: 7)
NKEDATEAQKKAIRAAEELLKDVTRIQERAIREAEKALERLARVQEEAIR

RVYEAVESKNKEELKKVKEEIEELLRRLKRELDELEREIRELLKEIKEKA
```

```
DRLEKEIRDLIERIRRDRNASDEVVTRLARLNEELIRELREDVRRLAELN

KELLRELERAARELARLNEKLLELADRVETEEEARKAIARVKRESKRIVE

DLIMSCAQESAASEKISREAERLIR.
```

In some instances, a caged degron of the present disclosure may share at least 70% sequence identity, including e.g., at least 75%, at least 80%, at least 85%, at least 90%, at least 95%, at least 96%, at least 97%, at least 98%, at least 99%, or 100% sequence identity with the following amino acid sequence of mini-degronLOCKRa_2_t9:

```
                                           (SEQ ID NO: 8)
DERLKRLNERLADELDKDLERLLRLNEELARELTRAAEELRELNEKLVEL

AKKLQGGRSREVAERAEKEREKIRRKLEEIKKEIKEDADRIKKRADELRR

RLEKTLEDAARELEKLKREPRTEELKRKATELQKEAIRRAEELLKEVTDV

QRRAIERAEELLEKLARLQEEAIRTVYLLVELNKVDRARKAIARVKRESK

RIVEDAERLAMSCAQESEKISREAERLIREAA.
```

In some instances, a caged degron of the present disclosure may share at least 70% sequence identity, including e.g., at least 75%, at least 80%, at least 85%, at least 90%, at least 95%, at least 96%, at least 97%, at least 98%, at least 99%, or 100% sequence identity with the following amino acid sequence of mini-degronLOCKRa_t12:

```
                                           (SEQ ID NO: 9)
DERLKRLNERLADELDKDLERLLRLNEELARELTRAAEELRELNEKLVEL

AKKLQGGRSREVAERAEKEREKIRRKLEEIKKEIKEDADRIKKRADELRR

RLEKTLEDAARELEKLKREPRTEELKRKATELQKENIRRAEELLKEVTDV

QRRNIERAEELLEKLARLQEENIRTVYLLVELNKVDRARKAIARVKRESK

RIVEDLIMSCAQESAASEKISREAERLIR.
```

In some instances, a caged degron of the present disclosure may share at least 70% sequence identity, including e.g., at least 75%, at least 80%, at least 85%, at least 90%, at least 95%, at least 96%, at least 97%, at least 98%, at least 99%, or 100% sequence identity with the following amino acid sequence of asym-degronLOCKR_a_mut:

```
                                           (SEQ ID NO: 10)
SKEAAKKLQDLNIELARKLLEASTKLQRLNIRLAEALLEAIARLQELNLE

LVYLAVELTDPKR1RDEIKEVKDKSKEIIRRAEKEIDDAAKESKKILEEA

RKAIRDAAEESRKILEEGSGSGSDALDELQKLNLELAKLLLKAIAETQDL

NLRAAKAFLEAAAKLQELNIRAVELLVKLTDPATIRRALEHAKRRSKEII

DEAERAIRAAKRESERIIEEARRLIEKAKEESERIIREGSGSGDPDIKKL

QDLNIELARELLRAHAQLQRLNLELLRELLRALAQLQELNLDLLRLASEL

TDPDEARKAIARVKRESKRIVEDAERLSREAAALSMSCAQESERSIREAA

AASEKISRE.
```

In some instances, a caged degron of the present disclosure may share at least 70% sequence identity, including e.g., at least 75%, at least 80%, at least 85%, at least 90%, at least 95%, at least 96%, at least 97%, at least 98%, at least 99%, or 100% sequence identity with the following amino acid sequence of asym-degronLOCKR_a_mut_t6:

(SEQ ID NO: 11)
SKEAAKKLQDLNIELARKLLEASTKLQRLNIRLAEALLEAIARLQELNLE

LVYLAVELTDPKR1RDEIKEVKDKSKEIIRRAEKEIDDAAKESKKILEEA

RKAIRDAAEESRKILEEGSGSGSDALDELQKLNLELAKLLLKAIAETQDL

NLRAAKAFLEAAAKLQELNIRAVELLVKLTDPATIRRALEHAKRRSKEII

DEAERAIRAAKRESERIIEEARRLIEKAKEESERIIREGSGSGDPDIKKL

QDLNIELARELLRAHAQLQRLNLELLRELLRALAQLQELNLDLLRLASEL

TDPDEARKAIARVKRESKRIVEDAERLSMSCAQESEKISREAERSIREAA

AAS.

In some instances, a caged degron of the present disclosure may share at least 70% sequence identity, including e.g., at least 75%, at least 80%, at least 85%, at least 90%, at least 95%, at least 96%, at least 97%, at least 98%, at least 99%, or 100% sequence identity with the following amino acid sequence of asym-degronLOCKR_a_short:

(SEQ ID NO: 12)
SELARKLLEASTKLQRLNIRLAEALLEAIARLQELNLELVYLAVELTDPK

RIRDEIKEVKDKSKEIIRRAEKEIDDAAKESEKILEEAREAISGSGSELA

KLLLKAIAETQDLNLRAAKAFLEAAAKLQELNIRAVELLVKLTDPATIRE

ALEHAKRRSKEIIDEAERAIRAAKRESERIIEEARRLIEKGSGSGSELAR

ELLRAHAQLQRLNLELLRELLRALAQLQELNLDLLRLASELTDPDEARKA

IARVKRESKRIVEDLEMSCAQESAASEKISREAERLIR.

In some instances, a caged degron of the present disclosure may share at least 70% sequence identity, including e.g., at least 75%, at least 80%, at least 85%, at least 90%, at least 95%, at least 96%, at least 97%, at least 98%, at least 99%, or 100% sequence identity with the following amino acid sequence of asym_degronLOCKR_a_short_t5:

(SEQ ID NO: 13)
SELARKLLEASTKLQRLNIRLAEALLEAIARLQELNLELVYLAVELTDPK

RIRDEIKEVKDKSKEIIRRAEKEIDDAAKESEKILEEAREAISGSGSELA

KLLLKAIAETQDLNLRAAKAFLEAAAKLQELNIRAVELLVKLTDPATIRE

ALEHAKRRSKEIIDEAERAIRAAKRESERIIEEARRLIEKGSGSGSELAR

ELLRAHAQLQRLNLELLRELLRALAQLQELNLDLLRLASELTDPDEARKA

IARVKRESKRLVMSCAQESREAAAASEKISREA.

In some instances, a caged degron of the present disclosure may share at least 70% sequence identity, including e.g., at least 75%, at least 80%, at least 85%, at least 90%, at least 95%, at least 96%, at least 97%, at least 98%, at least 99%, or 100% sequence identity with the following amino acid sequence of asym-degronLOCKR_a_short_t8:

(SEQ ID NO: 14)
SELARKLLEASTKLQRLNIRLAEALLEAIARLQELNLELVYLAVELTDPK

RIRDEIKEVKDKSKEIIRRAEKEIDDAAKESEKILEEAREAISGSGSELA

KLLLKAIAETQDLNLRAAKAFLEAAAKLQELNIRAVELLVKLTDPATIRE

ALEHAKRRSKEIIDEAERAIRAAKRESERIIEEARRLIEKGSGSGSELAR

ELLRAHAQLQRLNLELLRELLRALAQLQELNLDLLRLASELTDPDEARKA

IARVKRLSMSCAQESERLIREAAAASEKIK.

In some instances, a caged degron of the present disclosure may share at least 70% sequence identity, including e.g., at least 75%, at least 80%, at least 85%, at least 90%, at least 95%, at least 96%, at least 97%, at least 98%, at least 99%, or 100% sequence identity with the following amino acid sequence of asym-degronLOCKR_a_short_t11:

(SEQ ID NO: 15)
SELARKLLEASTKLQRLNIRLAEALLEAIARLQELNLELVYLAVELTDPK

RIRDEIKEVKDKSKEIIRRAEKEIDDAAKESEKILEEAREAISGSGSELA

KLLLKAIAETQDLNLRAAKAFLEAAAKLQELNIRAVELLVKLTDPATIRE

ALEHAKRRSKEIIDEAERAIRAAKRESERIIEEARRLIEKGSGSGSELAR

ELLRAHAQLQRLNLELLRELLRALAQLQELNLDLLRLASELTDPDEARKA

IARLKMSCAQESEDAERLIREAAAASE.

In some instances, a caged degron of the present disclosure may share at least 70% sequence identity, including e.g., at least 75%, at least 80%, at least 85%, at least 90%, at least 95%, at least 96%, at least 97%, at least 98%, at least 99%, or 100% sequence identity with the following amino acid sequence of degronLOCKR_b:

(SEQ ID NO: 16)
SHAAVIKLSDLNIRLLDKLLQAVIKLTELNAELNRKLIEALQRLFDLNVA

LVHLAAELTDPKRIADEIKKVKDKSKEIVERAEEEIARAAAESKKILDEA

EEEIARAAAESKKILDEGSGSGSDAVAELQALNLKLAELLLEAVAELQAL

NLKLAELLLEAIAKLQELNIKLVELLTKLTDPATIREAIRKVKEDSERIV

AEAERLIAAAKAESERIIREAERLIAAAKAESERIIREGSGSNDPQVAQN

QETFIELARDALRLVAENQEAFIEVARLTLRAAALAQEVAIKAVEAASEG

GSGSGPNKEEIEKLAKEAREKLKKAEKEHKMSCAQERKKNKKAREDLKKK

ADK.

In some instances, a caged degron of the present disclosure may share at least 70% sequence identity, including e.g., at least 75%, at least 80%, at least 85%, at least 90%, at least 95%, at least 96%, at least 97%, at least 98%, at least 99%, or 100% sequence identity with the following amino acid sequence of degronLOCKR_b_t13:

(SEQ ID NO: 17)
SHAAVIKLSDLNIRLLDKLLQAVIKLTELNAELNRKLIEALQRLFDLNVA

LVHLAAELTDPKRIADEIKKVKDKSKEIVERAEEEIARAAAESKKILDEA

EEEIARAAAESKKILDEGSGSGSDAVAELQALNLKLAELLLEAVAELQAL

NLKLAELLLEAIAKLQELNIKLVELLTKLTDPATIREAIRKVKEDSERIV

AEAERLIAAAKAESERIIREAERLIAAAKAESERIIREGSGSNDPQVAQN

QETFIELARDALRLVAENQEAFIEVARLTLRAAALAQEVAIKAVEAASEG

GSGSGPNKEEIEKLAKEAREKLKKAEMSCAQEHDKLRKKNKKAREDLKK.

In some instances, a caged degron of the present disclosure may share at least 70% sequence identity, including e.g., at least 75%, at least 80%, at least 85%, at least 90%, at least 95%, at least 96%, at least 97%, at least 98%, at least 99%, or 100% sequence identity with the following amino acid sequence of degronLOCKR_c:

(SEQ ID NO: 18)
SLEAVLKLAELNLKLSDKLAEAVQKLAALLNKLLEKLSEALQRLFELNVA

LVTLAIELTDPKRIADEIKKVKDKSKEIVERAEEEIARAAAESKKILDEA

EEEIARAAAESKKILDEGSGSGSDAVAELQALNLKLAELLLEAVAELQAL

NLKLAELLLEAIAKLQELNIKLVELLTKLTDPATIREAIRKVKEDSERIV

AEAERLIAAAKAESERIIREAERLIAAAKAESERIIREGSGSNDPLVARL

QELLIEHARELLRLVATSQEIFIELARAFLANAAQLQEAAIKAVEAASEN

GSGSGPSSEKVRRELKESLKENHKQNQKLLMSCAQEQEKLNRELEELKKK

HKK.

In some instances, a caged degron of the present disclosure may share at least 70% sequence identity, including e.g., at least 75%, at least 80%, at least 85%, at least 90%, at least 95%, at least 96%, at least 97%, at least 98%, at least 99%, or 100% sequence identity with the following amino acid sequence of degronLOCKR_c_t13:

(SEQ ID NO: 19)
SLEAVLKLAELNLKLSDKLAEAVQKLAALLNKLLEKLSEALQRLFELNVA

LVTLAIELTDPKRIADEIKKVKDKSKEIVERAEEEIARAAAESKKILDEA

EEEIARAAAESKKILDEGSGSGSDAVAELQALNLKLAELLLEAVAELQAL

NLKLAELLLEAIAKLQELNIKLVELLTKLTDPATIREAIRKVKEDSERIV

AEAERLIAAAKAESERIIREAERLIAAAKAESERIIREGSGSNDPLVARL

QELLIEHARELLRLVATSQEIFIELARAFLANAAQLQEAAIKAVEAASEN

GSGSGPSSEKVRRELKESLKENHKQNMSCAQEHKRAQEKLNRELEELKK.

In some instances, a caged degron of the present disclosure may share at least 70% sequence identity, including e.g., at least 75%, at least 80%, at least 85%, at least 90%, at least 95%, at least 96%, at least 97%, at least 98%, at least 99%, or 100% sequence identity with the following amino acid sequence of mini-degronLOCKR_c_1_t9:

(SEQ ID NO: 20)
LIERLTRLEKEHVRELKRLLDTSLEILRRLVEAFETNLRQLKEALKRALE

AANLHNEEVEEVLRKLEEDLRRLEEELRKTLDDVRKEVKRLKEELDKRIK

EVEDELRKIKEKLKKGDKNEKRVLEEILRLAEDVLKKSDKLAKDVQERAR

ELNEILEELSRKLQELFERVVEEVTRNVPTTERIEKVRRELKESLKENHK

QNQKLLMSCAQEQEKLNRELEELKKKHKK.

In some instances, a caged degron of the present disclosure may share at least 70% sequence identity, including e.g., at least 75%, at least 80%, at least 85%, at least 90%, at least 95%, at least 96%, at least 97%, at least 98%, at least 99%, or 100% sequence identity with the following amino acid sequence of miniLOCKR_c_1_t13:

(SEQ ID NO: 21)
LIERLTRLEKEHVRELKRLLDTSLEILRRLVEAFETNLRQLKEALKRALE

AANLHNEEVEEVLRKLEEDLRRLEEELRKTLDDVRKEVKRLKEELDKRIK

EVEDELRKIKEKLKKGDKNEKRVLEEILRLAEDVLKKSDKLAKDVQERAR

ELNEILEELSRKLQELFERVVEEVTRNVPTTERIEKVRRELKESLKENHK

LNMSCAQEHKRAQEKLNRELEELKK.

In some instances, a caged degron of the present disclosure may share at least 70% sequence identity, including e.g., at least 75%, at least 80%, at least 85%, at least 90%, at least 95%, at least 96%, at least 97%, at least 98%, at least 99%, or 100% sequence identity with the following amino acid sequence of mini-degronLOCKR_c_2_t9:

(SEQ ID NO: 22)
SEERVLELAEEALRLSDEAAKEIQELARRLNEELEKLSKELQDLFERIVE

TVTRLIDADEETLKRAAEEIKKRLEDARKKAKEAADKAREELDRARKKLK

ELVDEIRKKAKDALEKAGADEELVARLLRLLEEHARELERLLRTSARIIE

RLLDAFRRNLEQLKEAADKAVEAAEEAVRRVEDVRVWSEKVRRELKESLK

ENHKQNQKLLMSCAQEQEKLNRELEELKKKHKK.

In some instances, a caged degron of the present disclosure may share at least 70% sequence identity, including e.g., at least 75%, at least 80%, at least 85%, at least 90%, at least 95%, at least 96%, at least 97%, at least 98%, at least 99%, or 100% sequence identity with the following amino acid sequence of miniLOCKR_c_t13:

(SEQ ID NO: 23)
SEERVLELAEEALRLSDEAAKEIQELARRLNEELEKLSKELQDLFERIV

ETVTRLIDADEETLKRAAEEIKKRLEDARKKAKEAADKAREELDRARKK

LKELVDEIRKKAKDALEKAGADEELVARLLRLLEEHARELERLLRTSAR

IIERLLDAFRRNLEQLKEAADKAVEAAEEAVRRVEDVRVWSEKVRRELK

ESLKENHKLNMSCAQEHKRAQEKLNRELEELKK.

In some instances, a caged degron of the present disclosure may share at least 70% sequence identity, including e.g., at least 75%, at least 80%, at least 85%, at least 90%, at least 95%, at least 96%, at least 97%, at least 98%, at least 99%, or 100% sequence identity with the following amino acid sequence of asym-degronLOCKR_c_t13:

(SEQ ID NO: 24)
SLEAALKLAELNLKLSDKLAEASQKLAALLNKLLEKLSEAIQRLFELNLA

LVTLAIELTDPKRIADEIKKVKDKSKEIIERAEEEIARAAAESKKILDEA

EEEIARAAAESKKILDEGSGSGSDALAELQALNLKLAELLLEAIAETQAL

NLKAAEAFLEAAAKLQELNIKAVELLVKLTDPATIREALRKAKEDSERII

AEAERAIAAAKAESERIIREAERLIAAAKAESERIIREGSGSNDPLIARL

QELLIEHARELLRLHATSQEIFVELLRAFLANLAQLQEAALKALEAASEN

GSGSGPSSEKVRRELKESLKENHKQNQKLLMSCAQEQEKLNRELEELKKK

HKK.

In some instances, a caged degron of the present disclosure may share at least 70% sequence identity, including e.g., at least 75%, at least 80%, at least 85%, at least 90%, at least 95%, at least 96%, at least 97%, at least 98%, at least 99%, or 100% sequence identity with the following amino acid sequence of degronLOCKR_d:

(SEQ ID NO: 25)
SLEAVLKLFELNHKLSEKLLEAVLKLHALNQKLSQKLLEALARLLELNVA

LVELAIELTDPKRIADEIKKVKDKSKEIVERAEEEIARAAAESKKILDEA

EEEIARAAAESKKILDEGSGSGSDAVAELQALNLKLAELLLEAVAELQAL

NLKLAELLLEAIAKLQELNIKLVELLTKLTDPATIREAIRKVKEDSERIV

AEAERLIAAAKAESERIIREAERLIAAAKAESERIIREGSGSGDPEVARL

QEAFIEQAREILRNVAAAQEALIEQARRLLALAALAQEAAIKAVELASEH

GSGSGPDTVKRILEELRRRFEKLAKDLDDIAMSCAQEHKKHNKELKDKQR

KIK.

In some instances, a caged degron of the present disclosure may share at least 70% sequence identity, including e.g., at least 75%, at least 80%, at least 85%, at least 90%, at least 95%, at least 96%, at least 97%, at least 98%, at least 99%, or 100% sequence identity with any of the degron-LOCKR cage polypeptide amino acid sequences of SEQ ID NOS. 63-1169.

As summarized above, caged degrons of the circuits of the present disclosure include a degron. The location of the degron within a caged degron polypeptide may vary and, in some instances, the degron may be located within a latch region. Degrons include portions of proteins that signal and/or target for degradation (or otherwise increase the degradation rate of) the protein to which the degron is attached or otherwise associated (e.g., grafted onto). Non-limiting examples of degrons include short amino acid sequences, structural motifs, exposed amino acids, and the like. Degrons may be prokaryote or eukaryote derived and may be employed in naturally occurring or non-naturally occurring (i.e., recombinant) forms. Degrons may be post-translationally modified to target a protein for degradation where such post-translational modifications include but are not limited to e.g., ubiquitination, proteolytic cleavage, phosphorylation, methylation, ADP-ribosylation, ampy-lation, lipidation, alkylation, nitrosylation, succinylation, sumoylation, neddylation, isgylation, etc.

In some instances, the degron may be added to the latch region without removing any residues of the latch region, or may replace one or more (1, 2, 3, 4, 5, 6, 7, 8, 9, 10, or more) amino acid residues in the cage scaffold latch region to produce the final polypeptide. Thus, the latch region may be significantly modified upon inclusion of the degron. In some embodiments, the optional residues are not included in determining percent sequence identity. In some embodiments, the latch region residues may be included in deter-mining percent sequence identity. In some embodiments, each of the optional residues and the latch residues may or may not be included in determining percent sequence identity.

In some instances, the degron may be present within about 100, 99, 98, 97, 96, 95, 94, 93, 92, 91, 90, 89, 88, 87, 86, 85, 84, 83, 82, 81, 80, 79, 78, 77, 76, 75, 74, 73, 72, 71, 70, 69, 68, 67, 66, 65, 64, 63, 62, 61, 60, 59, 58, 57, 56, 55, 54, 53, 52, 51, 50, 49, 48, 47, 46, 45, 44, 43, 42, 41, 40, 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1, or 0 amino acids from either the N-terminus or the C-terminus of the latch region, and/or within about 100, 99, 98, 97, 96, 95, 94, 93, 92, 91, 90, 89, 88, 87, 86, 85, 84, 83, 82, 81, 80, 79, 78, 77, 76, 75, 74, 73, 72, 71, 70, 69, 68, 67, 66, 65, 64, 63, 62, 61, 60, 59, 58, 57, 56, 55, 54, 53, 52, 51, 50, 49, 48, 47, 46, 45, 44, 43, 42, 41, 40, 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1, or 0 amino acids from either the N-terminus or the C-terminus of the cage polypeptide. In some embodiments, where the latch region is at the terminus of the cage polypeptide, the recited distance in amino acids of the degron from that terminus and from the terminus of the latch region may both be met. In other embodiments, such as where one or more polypeptide functional domains are added to the N-terminus or C-terminus of the cage polypeptide (as described below), the degron may be within the recited distance in amino acids from the terminus of the latch region but not from the terminus of the cage polypeptide.

In some embodiments, the latch region is N-terminal to the structural region, and the degron may be located within about 100, 99, 98, 97, 96, 95, 94, 93, 92, 91, 90, 89, 88, 87, 86, 85, 84, 83, 82, 81, 80, 79, 78, 77, 76, 75, 74, 73, 72, 71, 70, 69, 68, 67, 66, 65, 64, 63, 62, 61, 60, 59, 58, 57, 56, 55, 54, 53, 52, 51, 50, 49, 48, 47, 46, 45, 44, 43, 42, 41, 40, 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1, or 0 amino acid residues of the N-terminus of the latch region. In some embodiments, the degron may be located within about 100, 99, 98, 97, 96, 95, 94, 93, 92, 91, 90, 89, 88, 87, 86, 85, 84, 83, 82, 81, 80, 79, 78, 77, 76, 75, 74, 73, 72, 71, 70, 69, 68, 67, 66, 65, 64, 63, 62, 61, 60, 59, 58, 57, 56, 55, 54, 53, 52, 51, 50, 49, 48, 47, 46, 45, 44, 43, 42, 41, 40, 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1, or 0 amino acid residues of the N-terminus of the cage polypeptide.

In some embodiments, the latch region is C-terminal to the structural region, and the degron may be located within about 100, 99, 98, 97, 96, 95, 94, 93, 92, 91, 90, 89, 88, 87, 86, 85, 84, 83, 82, 81, 80, 79, 78, 77, 76, 75, 74, 73, 72, 71, 70, 69, 68, 67, 66, 65, 64, 63, 62, 61, 60, 59, 58, 57, 56, 55, 54, 53, 52, 51, 50, 49, 48, 47, 46, 45, 44, 43, 42, 41, 40, 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1, or 0 amino acid residues or less of the C-terminus of the latch region. In some embodiments, the degron may be located within about 100, 99, 98, 97, 96, 95, 94, 93, 92, 91, 90, 89, 88, 87, 86, 85, 84, 83, 82, 81, 80, 79, 78, 77, 76, 75, 74, 73, 72, 71, 70, 69, 68, 67, 66, 65, 64, 63, 62, 61, 60, 59, 58, 57, 56, 55, 54, 53, 52, 51, 50, 49, 48, 47, 46, 45, 44, 43, 42, 41, 40, 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1, or 0 amino acid residues of the C-terminus of the cage polypeptide. In some embodiments, the degron may comprise a ubiquitin-inde-pendent degradation signal. In some embodiments, the degron comprises a CA dipeptide located between 10-30 residues from the C-terminus of the cage polypeptide; in this embodiment, the "C" residue in the CA dipeptide is between 10-30 residues from the C-terminus of the cage polypeptide. The CA dipeptide is the minimal domain for degradation activity of the murine ornithine decarboxylase (cODC) degron, as described below. In other embodiments employ-ing a cODC degron, the degron may comprise the peptide sequence MSCAQES (SEQ ID NO: 26) or L(X)MSCAQES (SEQ ID NO: 27), wherein X can be any amino acid residue, wherein X is optionally not proline.

In some embodiments, the degron may comprise an amino acid sequence or peptide selected from the group consisting of -GG; -RG; -KG; -QG; -WG; -PG; -AG; -RxxG; -EE; -R; -Rxx; -Vx; -Ax; -A, wherein "x" can be any amino acid residue. In some embodiments, the degron may be located within about 10-30 amino acid residues, or within about 20 amino acid residues, of the C-terminus of the cage polypeptide.

In some embodiments, the degron may comprise or consist of a peptide sequence selected from the group consisting of the following (residues within brackets are optional):

```
                                         (SEQ ID NO: 28)
[[KTRGVEEVAEGVVLL]]RRRG [[NK(FAM)KKK]], (SEQ ID NO: 29)
[[KPFLNGGPY]] HSREQSTDSG [[LGLGSYK(FAM)KKK]], (SEQ ID NO: 30)
ASADLDLEALAPYIPADDDFQLRK(FAM)KKK, (SEQ ID NO: 31)
[[K-(PEG)-KEEK]] DINNN [[VKKTK(FAM)KKK]], (SEQ ID NO: 32)
[[K-(PEG)]] DVQKADVSST [[GQGIDSK(FAM)KKK]], (SEQ ID NO: 33)
KAAEEEEVSLASTPTDVRDVDIK(FAM)KKK, (SEQ ID NO: 34)
[[KKYSSQTSQ]] DSGNYS [[NK(FAM)KKK]], (SEQ ID NO: 35)
KPLSSSVPSQKTYQGSYGFRLGK(FAM)KKK,
and (SEQ ID NO: 36)
[[KAWQQQSYL]] DSGIHSG [[ATTTAPK(FAM)KKK]].
```

In some embodiments, useful degrons may include a polypeptide sequence that recruits an ubiquitin ligase. Such degrons (e.g., proteolysis-targeting chimeric molecules, PROTACs) have been previously described by Sakamoto et al. (2001) PNAS (15) 8554-8559 and Schneekloth et al. (2004) JACS 126(12):3748-54; the disclosures of which are incorporated herein by reference in their entirety. Ubiquibodies and peptide PROTACs are described in, e.g., Ludwicki et al, ACS Central Science 2019 5: 852-866; Portnoff et al, J. Biol. Chem. 2014 289: 7844-7855; Fan et al Nature Neuroscience 2014 17: 471 480; and Hines et al Proc. Natl. Acad. Sci. 2013 110: 8942-8947.

Useful degrons include ubiquitin-dependent degrons and ubiquitin-independent degrons. For example, in some instances, a protein may be targeted for ubiquitin-independent proteasomal degradation by attachment of an ornithine decarboxylase (ODC) degron, including but not limited to e.g., a mammalian ODC such as e.g., a rodent ODC, including but not limited to e.g., the c-terminal mouse ODC (cODC). In some instances, useful degrons include those described in Takeuchi et al., Biochem. J (2008) 410:401-407 and/or Matsuzawa et al., PNAS (2005) 102(42):14982-7; the disclosures of which are incorporated herein by reference in their entirety. In some instances, a protein may be targeted for ubiquitin-independent proteasomal degradation by post-translational modification (including but not limited to e.g., proteolytic cleavage, phosphorylation, methylation, ADP-ribosylation, ampylation, lipidation, alkylation, nitrosylation, succinylation, sumoylation, neddylation, isgylation, etc.) of a degron, where such modification leads, directly or indirectly, to partial or complete unfolding of the protein or other mechanisms that lead to degradation of the protein.

In some instances, a degron employed in the herein described circuits may include a ubiquitin-independent degradation signal, where such signals may vary. For example, in some instances, a ubiquitin-independent degradation signal may include a dipeptide motif, such as e.g., a cysteine-alanine (i.e., CA) dipeptide motif. In some instances, a ubiquitin-independent degradation signal may include only a dipeptide motif. In some instances, a ubiquitin-independent degradation signal may include amino acid residues in addition to a dipeptide motif, such as but not limited to e.g., a LXMSCAQE (SEQ ID NO: 37) motif, where X may be any amino acid or a LXMSCAQES (SEQ ID NO: 27) motif, where X may be any amino acid. In some instances, a LXMSCAQE motif or a LXMSCAQES motif may include where X is any amino acid except proline.

Accordingly, in some instances, a degradation signal of a degron may include a sequence selected from: LPMSCAQES (SEQ ID NO: 38) where the final S is present or absent, LAMSCAQES (SEQ ID NO: 39) where the final S is present or absent, LVMSCAQES (SEQ ID NO: 40) where the final S is present or absent, LSMSCAQES (SEQ ID NO: 41) where the final S is present or absent, LEMSCAQES (SEQ ID NO: 42) where the final S is present or absent, and LKMSCAQES (SEQ ID NO: 43) where the final S is present or absent. In some instances, a degradation signal of a degron may include a MSCAQE (SEQ ID NO: 44) sequence or a MSCAQES (SEQ ID NO: 26) sequence.

Ubiquitin-dependent degrons include, but are not limited to, e.g., PEST (SEQ ID NO: 45) (proline (P), glutamic acid (E), serine (S), and threonine (T)) sequence-containing degrons, as well as those degrons described in Melvin et al. (PLoS One. (2013) 29; 8: e78082; the disclosure of which is incorporated herein by reference in its entirety, including degrons identified as Bonger and those described as derived from TAZ, HIF-1α, iNOS, SRC3, Cyclin D1, IFNAR1, p53, and β-Catenin.

Useful degrons may also include E3 ubiquitin ligase domains. Such degrons are often defined as the substrate site that is recognized by E3 ubiquitin ligases and a variety of such degrons, including short peptide motifs and specific structural elements, have been characterized. Non-limiting examples of E3 ligase/degrons and the corresponding motif patterns include: APC/C (DBOX), primary motif .R . . . L . . . [LIVM].; APC/C (KEN), primary motif .KEN.; APC/C (ABBA), primary motif [FIVL].[ILMVP][FHY].[DE].{0,3}[DEST]; APCC_TPR_1, primary motif .[ILM]R$; CBL (PTK), primary motif [DN].Y[ST] . . . P; CBL (MET), primary motif DYR; COP1, primary motif [DE][DE].{2,3}VP[DE]; CRL4_CDT2_1, primary motif [NQ]{0,1} . . . [ILMV][ST][DEN][FY][FY].{2,3}[KR]{2,3}[ˆDE]; CRL4_CDT2_2, primary motif [NQ]{0,1} . . . [ILMV]T[DEN][HMFY][FMY].{2,3}[KR]{2,3}[ˆDE]; Kelch_KEAP1_1, primary motif [DNS].[DES][TNS]GE; Kelch_KEAP1_2, primary motif QD.DLGV; Kelch_actinfilin, primary motif [AP]P[MV][IM]V; Kelch_KLHL3, primary motif E.EE.E[AV]DQH; MDM2_SWIB, primary motif F[ˆP]{3}W[ˆP]{2,3}[VIL]; Nend_Nbox_1, primary motif ˆM{0,1}[FYLIW][ˆP]; Nend_UBRbox_1, primary motif ˆM{0,1}[RK][ˆP].; Nend_UBRbox_2, primary motif ˆM{0,1}([ED]).; Nend_UBRbox_3, primary motif ˆM{0,1}([NQ]).; Nend_UBRbox_4, primary motif ˆM{0,1}(C).; ODPH_VHL_1, primary motif [IL]A(P).{6,8}[FLIVM].[FLIVM]; SCF_COI1_1, primary motif . . . [RK][RK].SL . . . F[FLM].[RK]R[HRK].[RK].; SCF_FBW7_1, primary motif [LIVMP].{0,2}(T)P . . . ([ST]); SCF_FBW7_2, primary motif [LIVMP].{0,2}(T)P . . . E; SCF_SKP2-CKS1_1, primary motif . . . [DE].(T)P.K; SCF_TIR1_1, primary motif .[VLIA][VLI]GWPP[VLI] . . . R.; SCF-TRCP1, primary motif D(S)G.{2,3}([ST]); SIAH, primary motif .P.A.V.P[^P]; SPOP, primary motif [AVP].[ST][ST][ST]; where '.' specifies any amino acid type, '[X]' specifies the allowed amino acid type(s) at that position, '^X' at the beginning of the pattern specifies that the sequence starts with amino acid type X, '[^X]' means that the position can have any amino acid other than type X, numbers specified as the following 'X{x,y}', where x and y specify the minimum and maximum number of 'X' amino acid type required at that position. '$' sign implies the C-terminal of the protein chain. Degrons that include E3 ubiquitin ligase domains are described in Guharoy et al., Nature Communications (2016) 7:10239; the disclosure of which is incorporated herein by reference in its entirety. In some instances, useful degrons may include those degrons that contain signals for ER-associated degradation (ERAD), including but not limited to e.g., those described in Maurer et al., Genes Genomes & Genetics (2016) 6:1854-1866; the disclosure of which is incorporated herein by reference in its entirety. In some instances, useful degrons may also include drug-inducible degrons, such as but not limited to e.g., the auxin inducible degron (AID) which utilizes a specific E3 ubiquitin ligase (e.g., as described in Nishimura et al., Nature Methods (2009) 6(12):917-922; the disclosure of which is incorporated herein by reference in its entirety).

As will be readily understood, degrons that include E3 ubiquitin ligase domains will vary and circuit of the present disclosure may not be limited to use of those E3 ubiquitin degrons specifically described herein.

Other useful examples of degrons that may be employed in inducible degradation strategies adapted for use in the circuits of the present disclosure include but are not limited to e.g., N-end degrons (such as but not limited to e.g., those described in Tasaki & Kwon, Trends in Biochemical Sciences (2007) 32(11):520-528, the disclosure of which is incorporated herein by reference in its entirety); unstructured regions (such as but not limited to e.g., those described in Chung et al., Nat Chem Biol. 2015; 11(9): 713-720, the disclosure of which is incorporated herein by reference in its entirety); ligand induced degradation (LID) and destabilization domain (DD) domains (such as but not limited to e.g., those described in Bonger et al., Nat Chem Biol. 2012; 7(8): 531-537; Grimley et al., Bioorg. Med. Chem. Lett. (2008) 18: 759-761; and Chu et al. Bioorg. Med. Chem. Lett. (2008) 18: 5941-5944; Iwamoto et al., Chemistry & Biology (2010) 17: 981-988; the disclosures of which are incorporated herein by reference in their entirety); prokaryotic proteasome recognition sequences such as, e.g., ssrA and mf-Lon (such as those described in Cameron et al., (2014) Nature biotechnology 32(12): 1276-1281, the disclosure of which is incorporated herein by reference in its entirety); and the like.

As summarized above, circuits of the present disclosure may include a key polypeptide, the expression of which may be controlled by a regulatory sequence to which a sequence encoding the key polypeptide is operably linked. The term "key polypeptide", as used herein, generally refers to a polypeptide that, when expressed in the presence of a corresponding caged degron, uncages the degron. The key polypeptide can be used in conjunction with a cage polypeptides to displace the latch through competitive intermolecular binding that induces conformational change, exposing the degron and thus activating the system. Uncaging of the degron thereby triggers degradation of the polypeptide to which it is linked or otherwise incorporated and any other attached proteins, such as e.g., an attached signaling protein. The configuration of key polypeptides will vary, e.g., depending on the "cage" or "switch" component which the key is designed to uncage or actuate.

Key polypeptides configured to function with a particular caged degron may, in some instances, be configured as an orthogonal system. By "orthogonal system" is generally meant that a particular key polypeptide functions together with a particular caged degron, but the key polypeptide does not necessarily function with other caged degrons and/or the caged degron does not necessarily function with other key polypeptides. Accordingly, two or more different orthogonal systems of key polypeptide and caged degron may function together, e.g., simultaneously, in the same organism or cell without interfering. Put another way, a first key polypeptide of a first orthogonal system may function to uncage a first caged degron of the first system, while the key polypeptide does not substantially interfere with the function of any component of a second orthogonal system (e.g., second key polypeptide, second caged degron, etc.). Orthogonal systems may be employed, in some instances, to allow for the parallel operation of two or more molecular feedback circuits, including e.g., two or more molecular feedback circuits that each modulate a different signaling pathway, two or more molecular feedback circuits that each modulate a different component of the same signaling pathway, and the like.

Each key polypeptide and caged degron need not necessarily be configured into orthogonal pairs. For example, in some instances, two or more different key polypeptides may function to uncage the same caged degron. Correspondingly, in some instances, two or more different caged degrons may be configured to be uncaged by the same key polypeptide.

In some instances, a key polypeptide may be configured to bind a locker domain of a caged degron. In some instances, the intermolecular binding of a key polypeptide to a locker domain may be of higher affinity than the intramolecular binding of a latch domain to the locker protein. A key polypeptide may include an alpha helix. In some instances, a key polypeptide, or an alpha helix thereof, may be longer than the latch domain, or an alpha helix thereof, which the key polypeptide displaces to bind a locker domain of a caged degron. In some instances, a key polypeptide, or an alpha helix thereof, may be shorter than the latch domain, or an alpha helix thereof, which the key polypeptide displaces to bind a locker domain of a caged degron. In some instances, a key polypeptide, or an alpha helix thereof, may be the same length as the latch domain, or an alpha helix thereof, which the key polypeptide displaces to bind a locker domain of a caged degron.

The length of the key polypeptide, or an alpha helix thereof, may vary and may range from 25 amino acid residues or less to 80 amino acid residues or more, including but not limited to e.g., 25 aa to 80 aa, 25 aa to 75 aa, 25 aa to 70 aa, 25 aa to 65 aa, 25 aa to 60 aa, 25 aa to 55 aa, 25 aa to 50 aa, 25 aa to 45 aa, 25 aa to 40 aa, 25 aa to 35 aa, 30 aa to 80 aa, 30 aa to 75 aa, 30 aa to 70 aa, 30 aa to 65 aa, 30 aa to 60 aa, 30 aa to 55 aa, 30 aa to 50 aa, 30 aa to 45 aa, 30 aa to 40 aa, 35 aa to 80 aa, 35 aa to 75 aa, 35 aa to 70 aa, 35 aa to 65 aa, 35 aa to 60 aa, 35 aa to 55 aa, 35 aa to 50 aa, 35 aa to 45 aa, 40 aa to 80 aa, 40 aa to 75 aa, 40 aa to 70 aa, 40 aa to 65 aa, 40 aa to 60 aa, 40 aa to 55 aa, 40 aa to 50 aa, etc., amino acid residues in length.

In some instances, a key polypeptide may be truncated. Truncation of a subject key polypeptide may be relative to e.g., an untruncated version of the key polypeptide, the length of a corresponding latch domain, etc. The size of a truncation of a key polypeptide, where present, may vary and may range from e.g., 2 to 20 or more amino acid residues, including but not limited to e.g., 2 aa to 20 aa, 2 aa to 18 aa, 2 aa to 16 aa, 2 aa to 14 aa, 2 aa to 12 aa, 2 aa to 10 aa, 2 aa to 8 aa, 2 aa to 6 aa, 2 aa to 4 aa, etc., amino acid residues. In some instances, a key polypeptide may be untruncated, i.e., full-length.

In some instances, a key polypeptide of the present disclosure may share at least 70% sequence identity, including e.g., at least 75%, at least 80%, at least 85%, at least 90%, at least 95%, at least 96%, at least 97%, at least 98%, at least 99%, or 100% sequence identity with Key$_a$, having the following amino acid sequence:

```
                                    (SEQ ID NO: 46)
EARKAIARVKRESKRIVEDAERLIREAAAASEKISREAERLIREAAAASE

KISRE.
```

In some instances, a key polypeptide of the present disclosure may share at least 70% sequence identity, including e.g., at least 75%, at least 80%, at least 85%, at least 90%, at least 95%, at least 96%, at least 97%, at least 98%, at least 99%, or 100% sequence identity with Key$_b$, having the following amino acid sequence:

```
                                    (SEQ ID NO: 47)
NKEEIEKLAKEAREKLKKAEKEHKEIHDKLRKKNKKAREDLKKKADELRE

TNKRVN.
```

In some instances, a key polypeptide of the present disclosure may share at least 70% sequence identity, including e.g., at least 75%, at least 80%, at least 85%, at least 90%, at least 95%, at least 96%, at least 97%, at least 98%, at least 99%, or 100% sequence identity with Key$_c$, having the following amino acid sequence:

```
                                    (SEQ ID NO: 48)
SSEKVRRELKESLKENHKQNQKLLKDHKRAQEKLNRELEELKKKHKKTLD

DIRRES.
```

In some instances, a key polypeptide of the present disclosure may share at least 70% sequence identity, including e.g., at least 75%, at least 80%, at least 85%, at least 90%, at least 95%, at least 96%, at least 97%, at least 98%, at least 99%, or 100% sequence identity with Key$_d$, having the following amino acid sequence:

```
                                    (SEQ ID NO: 49)
DTVKRILEELRRRFEKLAKDLDDIARKLLEDHKKHNKELKDKQRKIKKEA

DDAARS.
```

In some instances, a key polypeptide of the present disclosure may share at least 70% sequence identity, including e.g., at least 75%, at least 80%, at least 85%, at least 90%, at least 95%, at least 96%, at least 97%, at least 98%, at least 99%, or 100% sequence identity with a key polypeptide having an amino acid sequence set forth in Table 3 (inclusive of any appendices included therein).

Polypeptides employed in the circuits of the present disclosure may or may not include additional residues at the N-terminus, C-terminus, internal to the polypeptide, or a combination thereof; these additional residues may or may not be included in determining the percent identity of the polypeptides of the invention relative to the reference polypeptide. Such residues may be any residues suitable for an intended use, including but not limited to tags. As used herein, "tags" may include general detectable moieties (i.e.: fluorescent proteins, antibody epitope tags, etc.), therapeutic agents, purification tags (His tags, etc.), linkers, ligands suitable for purposes of purification, ligands to drive localization of the polypeptide, peptide domains that add functionality to the polypeptides, etc.

Linkers

Polypeptides employed in the circuits of the present disclosure may or may not include peptide linkers. For example, in some instances, two domains of a subject polypeptide may be joined by a peptide linker. Correspondingly, nucleic acid sequences encoding components of the circuits of the present disclosure may be joined by sequence encoding a peptide linker.

A peptide linker can vary in length of from about 3 amino acids (aa) or less to about 200 aa or more, including but not limited to e.g., from 3 aa to 10 aa, from 5 aa to 15 aa, from 10 aa to 25 aa, from 25 aa to 50 aa, from 50 aa to 75 aa, from 75 aa to 100 aa, from 100 aa to 125 aa, from 125 aa to 150 aa, from 150 aa to 175 aa, or from 175 aa to 200 aa. A peptide linker can have a length of from 3 aa to 30 aa, e.g., 3, 4, 5, 6, 7, 8, 9, 10, 11, 12, 13, 14, 15, 16, 17, 18, 19, 20, 21, 22, 23, 24, 25, 26, 27, 28, 29, or 30 aa. A peptide linker can have a length of from 5 aa to 50 aa, e.g., from 5 aa to 40 aa, from 5 aa to 35 aa, from 5 aa to 30 aa, from 5 aa to 25 aa, from 5 aa to 20 aa, from 5 aa to 15 aa or from 5 aa to 10 aa.

Suitable linkers can be readily selected and can be of any of a number of suitable lengths, such as from 1 amino acid (e.g., Gly) to 20 amino acids, from 2 amino acids to 15 amino acids, from 3 amino acids to 12 amino acids, including 4 amino acids to 10 amino acids, 5 amino acids to 9 amino acids, 6 amino acids to 8 amino acids, or 7 amino acids to 8 amino acids, and can be 1, 2, 3, 4, 5, 6, or 7 amino acids.

Exemplary linkers include glycine polymers (G)n, glycine-serine polymers (including, for example, (GS)n, (GSGGS)n (SEQ ID NO: 50) and (GGGS)n (SEQ ID NO: 51), where n is an integer of at least one), glycine-alanine polymers, alanine-serine polymers, and other flexible linkers known in the art. Glycine and glycine-serine polymers can be used; both Gly and Ser are relatively unstructured, and therefore can serve as a neutral tether between components. Glycine polymers can be used; glycine accesses significantly more phi-psi space than even alanine, and is much less restricted than residues with longer side chains (see Scheraga, Rev. Computational Chem. 11173-142 (1992)). Exemplary linkers can comprise amino acid sequences including, but not limited to, GGSG (SEQ ID NO: 52), GGSGG (SEQ ID NO: 53), GSGSG (SEQ ID NO: 54), GSGGG (SEQ ID NO: 55), GGGSG (SEQ ID NO: 56), GSSSG (SEQ ID NO: 57), and the like.

Amino acid linkers connecting alpha helices, include each alpha helix, can be of any suitable length or amino acid composition as appropriate for an intended use. In some embodiments, each amino acid linker is independently between 2 and 10 amino acids in length in embodiments in which no functional polypeptide domain is inserted within a linker. In various embodiments, each amino acid linker is independently 3-10, 4-10, 5-10, 6-10, 7-10, 8-10, 9-10, 2-9, 3-9, 4-9, 5-9, 6-9, 7-9, 8-9, 2-8, 3-8, 4-8, 5-8, 6-8, 7-8, 2-7, 3-7, 4-7, 5-7, 6-7, 2-6, 3-6, 4-6, 5-6, 2-5, 3-5, 4-5, 2-4, 3-4, 2-3, 2, 3, 4, 5, 6, 7, 8, 9, or 10 amino acids in length. As described below linkers may further comprise one or more functional polypeptide domains-in this embodiment, the linkers may be of any size suitable to include the one or more functional polypeptide domains, while maintaining the ability of the structural region and the latch region to interact.

Signaling Pathways

As summarized above, various signaling pathways, including native and synthetic signaling pathways may be modulated using the herein described molecular circuits. Suitable signaling pathways include those that are modulated (e.g., activated, repressed, etc.) by one or more inputs to produce one or more outputs. Inputs and outputs of signaling pathways may vary and may include endogenous (e.g., native) inputs or outputs of signaling pathways and heterologous (e.g., engineered or synthetic) signaling pathway inputs and outputs.

In some instances, an input of a signaling pathway relevant to a circuit of the present disclosure may include an intracellular signal, including e.g., where the output of the pathway may be intracellular or intercellular. In some instances, an output of a signaling pathway relevant to a circuit of the present disclosure may include an intracellular signal, including e.g., where the input of the pathway may be intracellular or intercellular. In some instances, an input of a signaling pathway relevant to a circuit of the present disclosure may include an intercellular signal, including e.g., where the output of the pathway may be intracellular or intercellular. In some instances, an output of a signaling pathway relevant to a circuit of the present disclosure may include an intercellular signal, including e.g., where the input of the pathway may be intracellular or intercellular.

In some instances, both the input and the output of a signaling pathway relevant to a circuit of the present disclosure may include intracellular signals. In some instances, both the input and the output of a signaling pathway relevant to a circuit of the present disclosure may include intercellular signals.

Suitable non-limiting examples of native signaling pathways that may be modulated using a circuit of the present disclosure include but are not limited to e.g., the AKT signaling pathway, the Akt/PKB signaling pathway, the AMPK signaling pathway, the apoptosis signaling pathway, the BMP signaling pathway, the cAMP-dependent pathway, the estrogen signaling pathway, the hedgehog signaling pathway, the hippo signaling pathway, an immune activation pathway, an immune suppression pathway, an immune cell differentiation pathway, an insulin signal transduction pathway, the JAK-STAT signaling pathway, the MAPK/ERK signaling pathway, the mTOR signaling pathway, the NF-κB signaling pathway, the nodal signaling pathway, the notch signaling pathway, the p53 signaling pathway, the PI3K signaling pathway, the TGF beta signaling pathway, the TLR signaling pathway, the TNF signaling pathway, the VEGF signaling pathway, the Wnt signaling pathway, and the like.

Suitable non-limiting examples of pathways, the components of which may be modified to include a caged degron as described herein, also include those PANTHER (Protein ANalysis THrough Evolutionary Relationships) pathways described as part of the Gene Ontology Phylogenetic Annotation Project, descriptions of which (including descriptions of the components of such pathways) are available online at www(dot)pantherdb(dot)org. Non-limiting examples include 2-arachidonoylglycerol biosynthesis, the 5HT1 type receptor mediated signaling pathway, the 5HT2 type receptor mediated signaling pathway, the 5HT3 type receptor mediated signaling pathway, the 5HT4 type receptor mediated signaling pathway, 5-Hydroxytryptamine biosynthesis, 5-Hydroxytryptamine degredation, Acetate utilization, the Activin beta signaling pathway, the Adenine and hypoxanthine salvage pathway, Adrenaline and noradrenaline biosynthesis, Alanine biosynthesis, Allantoin degradation, the ALP23B signaling pathway, the Alpha adrenergic receptor signaling pathway, the Alzheimer disease-amyloid secretase pathway, the Alzheimer disease-presenilin pathway, Aminobutyrate degradation, Anandamide biosynthesis, Anandamide degradation, Androgen/estrogene/progesterone biosynthesis, the Angiogenesis pathway, Angiotensin II-stimulated signaling through G proteins and beta-arrestin, the Apoptosis signaling pathway, Arginine biosynthesis, Ascorbate degradation, Asparagine and aspartate biosynthesis, ATP synthesis, Axon guidance mediated by netrin, Axon guidance mediated by semaphorins, Axon guidance mediated by Slit/Robo, the B cell activation pathway, the Beta1 adrenergic receptor signaling pathway, the Beta2 adrenergic receptor signaling pathway, the Beta3 adrenergic receptor signaling pathway, Biotin biosynthesis, Blood coagulation, the BMP/activin signaling pathway, Bupropion degradation, the Cadherin signaling pathway, Coenzyme A linked carnitine metabolism, Carnitine metabolism, CCKR signaling, the Cell cycle, Cholesterol biosynthesis, Chorismate biosynthesis, Circadian clock system, Cobalamin biosynthesis, Coenzyme A biosynthesis, the Cortocotropin releasing factor receptor signaling pathway, Cysteine biosynthesis, Cytoskeletal regulation by Rho GTPase, De novo purine biosynthesis, De novo pyrimidine deoxyribonucleotide biosynthesis, De novo pyrimidine ribonucleotides biosythesis, DNA replication, the Dopamine receptor mediated signaling pathway, the DPP-SCW signaling pathway, the DPP signaling pathway, the EGF receptor signaling pathway, the Endogenous cannabinoid signaling, the Endothelin signaling pathway, Enkephalin release, the FAS signaling pathway, the FGF signaling pathway, Flavin biosynthesis, Tetrahydrofolate biosynthesis, Formyltetrahydroformate biosynthesis, Fructose galactose metabolism, GABA-B receptor II signaling, Gamma-aminobutyric acid synthesis, the GBB signaling pathway, General transcription by RNA polymerase I, General transcription regulation, Glutamine glutamate conversion, Glycolysis, the Gonadotropin-releasing hormone receptor pathway, the Hedgehog signaling pathway, Heme biosynthesis, the Heterotrimeric G-protein signaling pathway-Gi alpha and Gs alpha mediated pathway, the Heterotrimeric G-protein signaling pathway-Gq alpha and Go alpha mediated pathway, Heterotrimeric G-protein signaling pathway-rod outer segment phototransduction, the Histamine H1 receptor mediated signaling pathway, the Histamine H2 receptor mediated signaling pathway, Histamine synthesis, Histidine biosynthesis, the Huntington disease pathway, Hypoxia response via HIF activation, the Inflammation mediated by chemokine and cytokine signaling pathway, Insulin/IGF pathway-mitogen activated protein kinase kinase/MAP kinase cascade, Insulin/IGF pathway-protein kinase B signaling cascade, the Integrin signalling pathway, the Interferon-gamma signaling pathway, the Interleukin signaling pathway, the Ionotropic glutamate receptor pathway, Isoleucine biosynthesis, the JAK/STAT signaling pathway, Leucine biosynthesis, Lipoate_biosynthesis, Lysine biosynthesis, Mannose metabolism, the Metabotropic glutamate receptor group III pathway, the Metabotropic glutamate receptor group II pathway, the Metabotropic glutamate receptor group I pathway, Methionine biosynthesis, Methylcitrate cycle, the Methylmalonyl pathway, mRNA splicing, the Muscarinic acetylcholine receptor 1 and 3 signaling pathway, the Muscarinic acetylcholine receptor 2 and 4 signaling pathway, the MYO signaling pathway, N-acetylglucosamine metabolism, Nicotine degradation, the Nicotine pharmacodynamics pathway, the Nicotinic acetylcholine receptor signaling pathway, the Notch signaling pathway, O-antigen biosynthesis, the Opioid pro-dynorphin pathway, the Opioid proenkephalin pathway, the Opioid proopiomelanocortin pathway, Ornithine degradation, Oxidative stress response, the Oxytocin receptor mediated signaling pathway, the p38 MAPK pathway, the p53 pathway, p53 pathway by glucose deprivation, P53 pathway feedback loops 1, p53 pathway feedback loops 2, Pantothenate biosynthesis, Parkinson disease, the PDGF signaling pathway, the Pentose phosphate pathway, Peptidoglycan biosynthesis, Phenylacetate degradation, Phenylalanine biosynthesis, Phenylethylamine degradation, Phenylpropionate degradation, the PI3 kinase pathway, Plasminogen activating cascade, Pyridoxal-5-phosphate biosynthesis, Proline biosynthesis, PRPP biosynthesis, Purine metabolism, the Pyridoxal phosphate salvage pathway, Pyrimidine Metabolism, Pyruvate metabolism, the Ras Pathway, S-adenosyl-methionine biosynthesis, Salvage pyrimidine deoxyribonucleotides, Salvage pyrimidine ribonucleotides, the SCW signaling pathway, Serine glycine biosynthesis, Succinate to proprionate conversion, Sulfate assimilation, Synaptic vesicle trafficking, TCA cycle, the T cell activation pathway, the TGF-beta signaling pathway, Thiamin biosynthesis, Thiamin metabolism, Threonine biosynthesis, the Thyrotropin-releasing hormone receptor signaling pathway, the Toll pathway, the Toll receptor signaling pathway, Transcription regulation by bZIP transcription factor, Triacylglycerol metabolism, Tryptophan biosynthesis, Tyrosine biosynthesis, the Ubiquitin proteasome pathway, Valine biosynthesis, Vasopressin synthesis, the VEGF signaling pathway, Vitamin B6 biosynthesis, Vitamin B6 metabolism, the Vitamin D metabolism and pathway, the Wnt signaling pathway, the Xanthine and guanine salvage pathway, and the like.

Further non-limiting examples of signaling pathways, and description thereof, include the following: AKT Signaling Pathway (AKT is a serine/threonine kinase that is involved in mediating various biological responses, such as inhibition of apoptosis), Angiopoietin-TIE2 Signaling (The angiopoietins are a new family of growth factor ligands that bind to TIE2/TEK RTK (Receptor Tyrosine Kinase)), Antigen Processing and Presentation by MHCs (Antigen processing and presentation are the processes that result in association of proteins with major histocompatibility complex (MHC) molecules for recognition by a T-cell), Apoptosis Through Death Receptors (Certain cells have unique sensors, termed death receptors (DRs), which detect the presence of extracellular death signals and rapidly ignite the cell's intrinsic apoptosis machinery), APRIL Pathway (In immune responses, APRIL acts as a co-stimulator for B-cell and T-cell proliferation and supports class switch), B-Cell Development Pathway (The B-cell receptor (BCR) complex usually consists of an antigen-binding subunit that is composed of two Ig heavy chains, two Ig light chains, and a signaling subunit), BMP Pathway (Bone morphogenetic proteins (BMPs) are a large subclass of the transforming growth factor-beta (TGF-beta) superfamily), Cancer Immunoediting (The immune system attempts to constrain tumor growth, but sometimes tumor cells might escape or attenuate this immune pressure), CCR5 Pathway in Macrophages (C-C motif chemokine receptor type 5 (CCR5) is a member of the chemokine receptor subclass of the G protein-coupled receptor (GPCR) superfamily), CD4 and CD8 T-Cell Lineage (Each mature T-cell generally retains expression of the co-receptor molecule (CD4 or CD8) that has a major histocompatibility complex (MHC)-binding property that matches that of its T-cell receptor (TCR)), Cellular Apoptosis Pathway (Apoptosis is a naturally occurring process by which a cell is directed to programmed cell death), CTL- Mediated Apoptosis (The cytotoxic T lymphocytes (CTLs), also known as killer T-cells, are produced during cell-mediated immunity designed to remove body cells displaying a foreign epitope), CTLA4 Signaling Pathway (The co-stimulatory CTLA4 pathway attenuates or down-regulates T-cell activation CTLA4 is designed to remove body cells displaying a foreign epitope), Cytokine Network (Cytokines have been classified on the basis of their biological responses into pro- or anti-inflammatory cytokines, depending on their effects on immunocytes), ErbB Family Pathway (The ErbB family of transmembrane receptor tyrosine kinases (RTKs) plays an important role during the growth and development of organs), Fas Signaling (FAS (also called APO1 or CD95) is a death domain—containing member of the tumor necrosis factor (TNF) receptor superfamily), FGF Pathway (One of the most well characterized modulators of angiogenesis is the heparin-binding fibroblast growth factor (FGF)), Granulocyte Adhesion and Diapedesis (Adhesion and diapedesis of granulocytes have mostly been analyzed in context to non-lymphoid endothelium), Granzyme Pathway (Granzyme A (GzmA) activates a caspase-independent cell death pathway with morphological features of apoptosis), GSK3 Signaling (GSK3 is a ubiquitously expressed, highly conserved serine/threonine protein kinase found in all eukaryotes), Hematopoiesis from Multipotent Stem Cells (Hematopoietic stem cells are classified into long-term, short-term and multipotent progenitors, based on the extent of their self-renewal abilities), Hematopoiesis from Pluripotent Stem Cells (Pluripotent stem cells are capable of forming virtually all of the possible tissue types found in human beings), IL-2 Gene Expression in Activated and Quiescent T-Cells (IL-2 is a cytokine that stimulates the growth, proliferation, and differentiation of T-cells, B-cells, NK cells, and other immune cells), IL-6 Pathway (IL-6 is a pleiotropic cytokine that affects the immune system and many physiological events in various organs), IL-10 Pathway (IL-10 is a pleiotropic cytokine with important immunoregulatory functions and whose activities influence many immune cell types), IL-22 Pathway (IL-22 is a member of the IL-10 family of cytokines and exerts multiple effects on the immune system), Interferon Pathway (Interferons are pleiotropic cytokines best known for their ability to induce cellular resistance to viral infection), JAK/STAT Pathway (The JAK/STAT pathway is a signaling cascade whose evolutionarily conserved roles include cell proliferation and hematopoiesis), MAPK Family Pathway (Mitogen-activated protein kinases (MAPKs) belong to a large family of serine/threonine protein kinases that are conserved in organisms as diverse as yeast and humans), Nanog in Mammalian ESC Pluripotency (NANOG is a transcription factor transcribed in pluripotent stem cells and is down-regulated upon cell differentiation), p53-Mediated Apoptosis Pathway (Tumor protein p53 is a nuclear transcription factor that regulates the expression of a wide variety of genes involved in apoptosis, growth arrest, or senescence in response to genotoxic or cellular stress), Pathogenesis of Rheumatoid Arthritis (Rheumatoid arthritis (RA) is a chronic symmetric polyarticular joint disease that primarily affects the small joints of the hands and feet), PI3K Signaling in B Lymphocytes (The phosphoinositide 3-kinases (PI3Ks) regulate numerous biological processes, including cell growth, differentiation, survival, proliferation, migration, and metabolism), RANK Pathway (RANKL and its receptor RANK are key regulators of bone remodeling, and are essential for the development and activation of osteoclasts), RANK Signaling in Osteoclasts (RANKL induces the differentiation of osteoclast precursor cells and stimulates the resorption function and survival of mature osteoclasts), TGF-Beta Pathway (Members of the transforming growth factor (TGF)-beta family play an important role in the development, homeostasis, and repair of most tissues), THC Differentiation Pathway (T-helper cells of type 1 (TH1) and type 2 (TH2) are derived from T-helper cells and provide help to cells of both the innate and adaptive immune systems), TNF Signaling Pathway (Tumor necrosis factor (TNF) is a multifunctional pro-inflammatory cytokine with effects on lipid metabolism, coagulation, insulin resistance, and endothelial function), TNF Superfamily Pathway (The tumor necrosis factor (TNF) superfamily consists of 19 members that signal through 29 receptors that are members of the TNF receptor (TNFR) superfamily), Transendothelial Migration of Leukocytes (Transport of plasma proteins and solutes across the endothelium involves two different routes: transcellular and paracellular junctions), Tumoricidal Effects of Hepatic NK Cells (The liver is a major site for the formation and metastasis of tumors), TWEAK Pathway (TWEAK is a cell surface-associated protein belonging to the tumor necrosis factor (TNF) superfamily and has multiple biological activities), VEGF Family of Ligands and Receptor Interactions (Vascular endothelial growth factor (VEGF) is a highly-conserved genetic pathway that has evolved from simple to complex systems), and the like.

As summarized above, a component of a signaling pathway, including but not limited to a pathway described herein, may be modified to include a caged degron such that degradation of the signaling pathway member may be controlled by expression of a key polypeptide. Suitable pathway components that may be employed include e.g., input-receiving members, intermediate members, and output-producing members, including but not limited to e.g., the corresponding member of the pathways listed above.

Similarly, essentially any synthetic pathway may modulated using a molecular circuit as described herein. Suitable non-limiting examples of synthetic signaling pathways that may be modulated using a circuit of the present disclosure include, but are not limited to, those pathways controlled by a synthetic or engineered receptor, such as but not limited to e.g., a CAR, an engineered TCR, a synNotch, etc.

In some instances, a pathway modulated using a circuit of the present disclosure may include an immune modulation pathway, such as e.g., an immune activation pathway or an immune suppression pathway. Such immune modulation pathways may be natural or synthetic and may be endogenous to the cell in which the circuit is employed or heterologous to the cell in which the circuit is employed.

Suitable non-limiting examples of synthetic signaling pathways that may be modulated using a circuit of the present disclosure also include biosynthesis and/or bioproduction pathways. Biosynthesis and/or bioproduction pathways may be natural or synthetic and may be employed in cells and/or organisms where the pathway is endogenous or heterologous.

Non-limiting examples of biosynthesis pathways that may be modulated using a circuit of the present disclosure include, but are not limited to, hormone production pathways (e.g., an insulin production pathway, an estrogen/progesterone production pathway, an androgen production pathway, a growth hormone production pathway, and the like), opioid production pathways, isobutanol production pathways, non-ribosomal polyketide synthetase (NRPS) production pathways, antibiotic production pathways, chemotherapeutic production pathways, artemisinic acid production pathways, terpenoid production pathways, polyketide production pathways, and the like.

Non-limiting examples of synthetic biosynthesis pathways include but are not limited to e.g., synthetic hormone production pathways, synthetic opioid production pathways, synthetic antibiotic production pathways, synthetic chemotherapeutic production pathways, synthetic artemisinic acid production pathways, synthetic terpenoid production pathways, synthetic polyketide production pathways, and the like Nucleic Acids As summarized above, the present disclosure also provides nucleic acids encoding molecular feedback circuits. The subject nucleic acids may include, e.g., a sequence encoding a key polypeptide, sequence encoding a signaling protein that includes a caged degron, and the like. Such nucleic acids may be configured such that one or more of the sequences are operably linked to a regulatory sequence. For example, a nucleic acid may be configured such that the sequence encoding the key polypeptide is operably linked to a regulatory sequence responsive to an output of the signaling pathway. Provided are nucleic acids encoding essentially any circuit employing a caged degron, including but not limited to those circuits specifically described herein. Encompassed are isolated nucleic acids encoding the subject circuits as well as various configurations containing such nucleic acids, such as vectors, e.g., expression cassettes, recombinant expression vectors, viral vectors, and the like.

Recombinant expression vectors of the present disclosure include those comprising one or more of the described nucleic acids. A nucleic acid comprising a nucleotide sequence encoding all or a portion of the components of a circuit of the present disclosure will in some embodiments be DNA, including, e.g., a recombinant expression vector. A nucleic acid comprising a nucleotide sequence encoding all or a portion of the components of a circuit of the present disclosure will in some embodiments be RNA, e.g., in vitro synthesized RNA.

As summarized above, in some instances, the subject circuits may make use of an encoding nucleic acid (e.g., a nucleic acid encoding a key polypeptide or a caged degron-linked signaling protein) that is operably linked to a regulatory sequence such as a transcriptional control element (e.g., a promoter; an enhancer; etc.). In some cases, the transcriptional control element is inducible. In some cases, the transcriptional control element is constitutive. In some cases, the promoters are functional in eukaryotic cells. In some cases, the promoters are functional in prokaryotic cells. In some cases, the promoters are cell type-specific promoters. In some cases, the promoters are tissue-specific promoters.

Depending on the host/vector system utilized, any of a number of suitable transcription and translation control elements, including constitutive and inducible promoters, transcription enhancer elements, transcription terminators, etc. may be used in the expression vector (see e.g., Bitter et al. (1987) *Methods in Enzymology,* 153:516-544).

A promoter can be a constitutively active promoter (i.e., a promoter that is constitutively in an active/"ON" state), it may be an inducible promoter (i.e., a promoter whose state, active/"ON" or inactive/"OFF", is controlled by an external stimulus, e.g., the presence of a particular temperature, compound, or protein.), it may be a spatially restricted promoter (i.e., transcriptional control element, enhancer, etc.)(e.g., tissue specific promoter, cell type specific promoter, etc.), and it may be a temporally restricted promoter (i.e., the promoter is in the "ON" state or "OFF" state during specific stages of embryonic development or during specific stages of a biological process, e.g., the cell cycle, the hair follicle cycle in mammals, circadian cycles in mammals, etc.).

Suitable promoter and enhancer elements are known in the art. For expression in a bacterial cell, suitable promoters include, but are not limited to, lacI, lacZ, T3, T7, gpt, lambda P and trc. For expression in a eukaryotic cell, suitable promoters include, but are not limited to, yeast promoters (e.g., promoters of yeast mating pathway genes, yeast galactose-inducible promoters, etc.), light and/or heavy chain immunoglobulin gene promoter and enhancer elements; cytomegalovirus immediate early promoter; herpes simplex virus thymidine kinase promoter; early and late SV40 promoters; promoters present in long terminal repeats from a retrovirus; mouse metallothionein-I promoter; and various art-known tissue specific promoters.

In some instances, transcriptional control elements of varied strength may be employed. For example, promoters, e.g., constitutive or inducible promoters, of varied strength, such as e.g., weak, intermediate, and strong promoters, such as but not limited to e.g., constitutive promoters pREV1, pRNR2, pRET2, etc. may be employed. In some instances, the strength of a promoter may be modulated, e.g., made weaker or made stronger, by decreasing or increasing, respectively, the number of binding sites (e.g., DBD binding sites) within the promoter. Accordingly, the number of binding sites present in a subject promoter may vary and may range from 1 to 6 or more, including but not limited to e.g., 1, 2, 3, 4, 5, 6, etc.

In some instances, a transcriptional control element of a herein described nucleic acid may include a cis-acting regulatory sequence. Any suitable cis-acting regulatory sequence may find use in the herein described nucleic acids. For example, in some instances a cis-acting regulatory sequence may be or include an upstream activating sequence or upstream activation sequence (UAS). In some instances, a UAS of a herein described nucleic acid may be a Gal4 responsive UAS.

In some instances, transcriptional control of a circuit of the present disclosure may include the use of one or more regulatory elements responsive to a synthetic transcription factor. Synthetic transcription factors, and regulatory elements responsive thereto, will vary and may include but are not limited to e.g., estradiol ligand binding domain (LBD) based synthetic transcription factors, progesterone LBD based synthetic transcription factors, zinc-finger based synthetic transcription factors, and the like. Synthetic transcription factors may by chimeric and may include various domains, e.g., a DNA binding domain (DBD), activation domain, zinc-finger domain(s), and the like. Useful domains, e.g., LBDs, DBDs, activation domains, etc., will vary and may include but are not limited to e.g., the Gal4p DBD, the Zif268 transcription factor DBD, viral activation domains (e.g., VP16, VP64, etc.), Msn2p activation domains, and the like. Non-limiting examples of useful synthetic transcription factors include but are not limited to e.g., GEM (Gal4 DNA binding domain-Estradiol hormone binding domain-Msn2 activation domain), Z3PM (Z3 zinc finger-Progesterone hormone binding domain-Msn2 activation domain), and the like. Correspondingly, useful regulatory elements will vary and may include promoters responsive to synthetic transcription factors, including but not limited to e.g., pZ promoters, pZ3 promoters, pGAL1 promoters, and the like. Examples of suitable promoters and synthetic transcription factors include, but are not limited to e.g., those described herein, those described in Aranda-Diaz et al. ACS Synth Biol. (2017) 6(3): 545-554; the disclosure of which is incorporated herein by reference in its entirety, and the like.

Suitable promoters may, in some instances, include suitable reversible promoters. Reversible promoters may be isolated and derived from many organisms, e.g., eukaryotes and prokaryotes. Modification of reversible promoters derived from a first organism for use in a second organism, e.g., a first prokaryote and a second a eukaryote, a first eukaryote and a second a prokaryote, etc., is well known in the art. Such reversible promoters, and systems based on such reversible promoters but also comprising additional control proteins, include, but are not limited to, alcohol regulated promoters (e.g., alcohol dehydrogenase I (alcA) gene promoter, promoters responsive to alcohol transactivator proteins (AlcR), etc.), tetracycline regulated promoters, (e.g., promoter systems including TetActivators, TetON, TetOFF, etc.), steroid regulated promoters (e.g., rat glucocorticoid receptor promoter systems, human estrogen receptor promoter systems, retinoid promoter systems, thyroid promoter systems, ecdysone promoter systems, mifepristone promoter systems, etc.), metal regulated promoters (e.g., metallothionein promoter systems, etc.), pathogenesis-related regulated promoters (e.g., salicylic acid regulated promoters, ethylene regulated promoters, benzothiadiazole regulated promoters, etc.), temperature regulated promoters (e.g., heat shock inducible promoters (e.g., HSP-70, HSP-90, soybean heat shock promoter, etc.), light regulated promoters, synthetic inducible promoters, and the like.

Inducible promoters suitable for use include any inducible promoter described herein or known to one of ordinary skill in the art. Examples of inducible promoters include, without limitation, chemically/biochemically-regulated and physically-regulated promoters such as alcohol-regulated promoters, tetracycline-regulated promoters (e.g., anhydrotetracycline (aTc)-responsive promoters and other tetracycline-responsive promoter systems, which include a tetracycline repressor protein (tetR), a tetracycline operator sequence (tetO) and a tetracycline transactivator fusion protein (tTA)), steroid-regulated promoters (e.g., promoters based on the rat glucocorticoid receptor, human estrogen receptor, moth ecdysone receptors, and promoters from the steroid/retinoid/thyroid receptor superfamily), metal-regulated promoters (e.g., promoters derived from metallothionein (proteins that bind and sequester metal ions) genes from yeast, mouse and human), pathogenesis-regulated promoters (e.g., induced by salicylic acid, ethylene or benzothiadiazole (BTH)), temperature/heat-inducible promoters (e.g., heat shock promoters), and light-regulated promoters (e.g., light responsive promoters from plant cells).

In some instances, a useful promoter may be an immune cell promoter. For example, in embodiments were components of a circuit are expressed in an immune cell, an immune cell promoter may be employed. Suitable immune cell promoters include but are not limited to e.g., CD8 cell-specific promoters, CD4 cell-specific promoters, neutrophil-specific promoters, and NK-specific promoters. For example, a CD4 gene promoter can be used; see, e.g., Salmon et al. (1993) *Proc. Natl. Acad. Sci. USA* 90: 7739; and Marodon et al. (2003) *Blood* 101:3416. As another example, a CD8 gene promoter can be used. NK cell-specific expression can be achieved by use of an Ncr1 (p46) promoter; see, e.g., Eckelhart et al. (2011) *Blood* 117:1565.

In some instances, an immune cell specific promoter of a nucleic acid of the present disclosure may be a promoter of a B29 gene promoter, a CD14 gene promoter, a CD43 gene promoter, a CD45 gene promoter, a CD68 gene promoter, a IFN-β gene promoter, a WASP gene promoter, a T-cell receptor β-chain gene promoter, a V9 γ (TRGV9) gene promoter, a V2 δ (TRDV2) gene promoter, and the like.

In some cases, a nucleic acid comprising a nucleotide sequence encoding a circuit of the present disclosure, or one or more components thereof, is a recombinant expression vector or is included in a recombinant expression vector. In some embodiments, the recombinant expression vector is a viral construct, e.g., a recombinant adeno-associated virus (AAV) construct, a recombinant adenoviral construct, a recombinant lentiviral construct, a recombinant retroviral construct, etc. In some cases, a nucleic acid comprising a nucleotide sequence encoding a circuit of the present disclosure, or one or more components thereof, is a recombinant lentivirus vector. In some cases, a nucleic acid comprising a nucleotide sequence encoding a circuit of the present disclosure, or one or more components thereof, is a recombinant AAV vector.

Suitable expression vectors include, but are not limited to, viral vectors (e.g. viral vectors based on vaccinia virus; poliovirus; adenovirus (see, e.g., Li et al., Invest Opthalmol Vis Sci 35:2543 2549, 1994; Borras et al., Gene Ther 6:515 524, 1999; Li and Davidson, PNAS 92:7700 7704, 1995; Sakamoto et al., Hum Gene Ther 5:1088 1097, 1999; WO 94/12649, WO 93/03769; WO 93/19191; WO 94/28938; WO 95/11984 and WO 95/00655); adeno-associated virus (see, e.g., Ali et al., Hum Gene Ther 9:81 86, 1998, Flannery et al., PNAS 94:6916 6921, 1997; Bennett et al., Invest Opthalmol Vis Sci 38:2857 2863, 1997; Jomary et al., Gene Ther 4:683 690, 1997, Rolling et al., Hum Gene Ther 10:641 648, 1999; Ali et al., Hum Mol Genet 5:591 594, 1996; Srivastava in WO 93/09239, Samulski et al., J. Vir. (1989) 63:3822-3828; Mendelson et al., Virol. (1988) 166:154-165; and Flotte et al., PNAS (1993) 90:10613-10617); SV40; herpes simplex virus; human immunodeficiency virus (see, e.g., Miyoshi et al., PNAS 94:10319 23, 1997; Takahashi et al., J Virol 73:7812 7816, 1999); a retroviral vector (e.g., Murine Leukemia Virus, spleen necrosis virus, and vectors derived from retroviruses such as Rous Sarcoma Virus, Harvey Sarcoma Virus, avian leukosis virus, a lentivirus, human immunodeficiency virus, myeloproliferative sarcoma virus, and mammary tumor virus); and the like. In some cases, the vector is a lentivirus vector. Also suitable are transposon-mediated vectors, such as piggyback and sleeping beauty vectors.

In some instances, nucleic acids of the present disclosure may have a single sequence encoding two or more polypeptides where expression of the two or more polypeptides is made possible by the presence of a sequence element between the individual coding regions that facilitates separate expression of the individual polypeptides. Such sequence elements, may be referred to herein as bicistronic-facilitating sequences, where the presence of a bicistronic-facilitating sequence between two coding regions makes possible the expression of a separate polypeptide from each coding region present in a single nucleic acid sequence. In some instances, a nucleic acid may contain two coding regions encoding two polypeptides present in a single nucleic acid with a bicistronic-facilitating sequence between the coding regions. Any suitable method for separate expression of multiple individual polypeptides from a single nucleic acid sequence may be employed and, similarly, any suitable method of bicistronic expression may be employed.

In some instances, a bicistronic-facilitating sequence may allow for the expression of two polypeptides from a single nucleic acid sequence that are temporarily joined by a cleavable linking polypeptide. In such instances, a bicistronic-facilitating sequence may include one or more encoded peptide cleavage sites. Suitable peptide cleavage sites include those of self-cleaving peptides as well as those cleaved by a separate enzyme. In some instances, a peptide cleavage site of a bicistronic-facilitating sequence may include a furin cleavage site (i.e., the bicistronic-facilitating sequence may encode a furin cleavage site).

In some instances, the bicistronic-facilitating sequence may encode a self-cleaving peptide sequence. Useful self-cleaving peptide sequences include but are not limited to e.g., peptide 2A sequences, including but not limited to e.g., the T2A sequence.

In some instances, a bicistronic-facilitating sequence may include one or more spacer encoding sequences. Spacer encoding sequences generally encode an amino acid spacer, also referred to in some instances as a peptide tag. Useful spacer encoding sequences include but are not limited to e.g., V5 peptide encoding sequences, including those sequences encoding a V5 peptide tag.

Multi- or bicistronic expression of multiple coding sequences from a single nucleic acid sequence may make use of but is not limited to those methods employing furin cleavage, T2A, and V5 peptide tag sequences. For example, in some instances, an internal ribosome entry site (IRES) based system may be employed. Any suitable method of bicistronic expression may be employed including but not limited to e.g., those described in Yang et al. (2008) Gene Therapy. 15(21):1411-1423; Martin et al. (2006) BMC Biotechnology. 6:4; the disclosures of which are incorporated herein by reference in their entirety.

Cells

As summarized above, the present disclosure also provides cells containing nucleic acids encoding molecular feedback circuits. Cells modified to include one or more nucleic acids encoding one or more molecular feedback circuits and/or one or more components thereof may be referred to herein as having been genetically modified, where such modification may be stable or transient as desired. Useful cells may include prokaryotic and eukaryotic cells, including but not limited to e.g., bacterial cells, plant cells, animal cells, yeast cells, mammalian cells, rodent cells, non-human primate cells, human cells, and the like.

Suitable cells include stem cells, progenitor cells, as well as partially and fully differentiated cells. Suitable cells include, neurons, liver cells; kidney cells; immune cells; cardiac cells; skeletal muscle cells; smooth muscle cells; lung cells; and the like.

Suitable cells include a stem cell (e.g. an embryonic stem (ES) cell, an induced pluripotent stem (iPS) cell; a germ cell (e.g., an oocyte, a sperm, an oogonia, a spermatogonia, etc.); a somatic cell, e.g. a fibroblast, an oligodendrocyte, a glial cell, a hematopoietic cell, a neuron, a muscle cell, a bone cell, a hepatocyte, a pancreatic cell, etc.

Suitable cells include human embryonic stem cells, fetal cardiomyocytes, myofibroblasts, mesenchymal stem cells, autotransplated expanded cardiomyocytes, adipocytes, totipotent cells, pluripotent cells, blood stem cells, myoblasts, adult stem cells, bone marrow cells, mesenchymal cells, embryonic stem cells, parenchymal cells, epithelial cells, endothelial cells, mesothelial cells, fibroblasts, osteoblasts, chondrocytes, exogenous cells, endogenous cells, stem cells, hematopoietic stem cells, bone-marrow derived progenitor cells, myocardial cells, skeletal cells, fetal cells, undifferentiated cells, multi-potent progenitor cells, unipotent progenitor cells, monocytes, cardiac myoblasts, skeletal myoblasts, macrophages, capillary endothelial cells, xenogenic cells, allogenic cells, and post-natal stem cells.

In some cases, the cell is a stem cell. In some cases, the cell is an induced pluripotent stem cell. In some cases, the cell is a mesenchymal stem cell. In some cases, the cell is a hematopoietic stem cell. In some cases, the cell is an adult stem cell.

Suitable cells include bronchioalveolar stem cells (BASCs), bulge epithelial stem cells (bESCs), corneal epithelial stem cells (CESCs), cardiac stem cells (CSCs), epidermal neural crest stem cells (eNCSCs), embryonic stem cells (ESCs), endothelial progenitor cells (EPCs), hepatic oval cells (HOCs), hematopoetic stem cells (HSCs), keratinocyte stem cells (KSCs), mesenchymal stem cells (MSCs), neuronal stem cells (NSCs), pancreatic stem cells (PSCs), retinal stem cells (RSCs), and skin-derived precursors (SKPs).

In some instances, a cell is an immune cell. Suitable mammalian immune cells include primary cells and immortalized cell lines. Suitable mammalian cell lines include human cell lines, non-human primate cell lines, rodent (e.g., mouse, rat) cell lines, and the like. In some instances, the cell is not an immortalized cell line, but is instead a cell (e.g., a primary cell) obtained from an individual. For example, in some cases, the cell is an immune cell, immune cell progenitor or immune stem cell obtained from an individual. As an example, the cell is a lymphoid cell, e.g., a lymphocyte, or progenitor thereof, obtained from an individual. As another example, the cell is a cytotoxic cell, or progenitor thereof, obtained from an individual. As another example, the cell is a stem cell or progenitor cell obtained from an individual.

As used herein, the term "immune cells" generally includes white blood cells (leukocytes) which are derived from hematopoietic stem cells (HSC) produced in the bone marrow. "Immune cells" includes, e.g., lymphoid cells, i.e., lymphocytes (T cells, B cells, natural killer (NK) cells), and myeloid-derived cells (neutrophil, eosinophil, basophil, monocyte, macrophage, dendritic cells). "T cell" includes all types of immune cells expressing CD3 including T-helper cells (CD4+ cells), cytotoxic T-cells (CD8+ cells), T-regulatory cells (Treg) and gamma-delta T cells. A "cytotoxic cell" includes CD8+ T cells, natural-killer (NK) cells, and neutrophils, which cells are capable of mediating cytotoxicity responses. "B cell" includes mature and immature cells of the B cell lineage including e.g., cells that express CD19 such as Pre B cells, Immature B cells, Mature B cells, Memory B cells and plasmablasts. Immune cells also include B cell progenitors such as Pro B cells and B cell lineage derivatives such as plasma cells.

Cells encoding a circuit of the present disclosure may be generated by any convenient method. Nucleic acids encoding one or more components of a subject circuit may be stably or transiently introduced into the subject immune cell, including where the subject nucleic acids are present only temporarily, maintained extrachromosomally, or integrated into the host genome. Introduction of the subject nucleic acids and/or genetic modification of the subject immune cell can be carried out in vivo, in vitro, or ex vivo.

In some cases, the introduction of the subject nucleic acids and/or genetic modification is carried out ex vivo. For example, an immune cell, a stem cell, etc., is obtained from an individual; and the cell obtained from the individual is modified to express components of a circuit of the present disclosure. The modified cell can thus be modified with control feedback to one or more signaling pathways of choice, as defined by the one or more molecular feedback circuits present on the introduced nucleic acids. In some cases, the modified cell is modulated ex vivo. In other cases, the cell is introduced into (e.g., the individual from whom the cell was obtained) and/or already present in an individual; and the cell is modulated in vivo, e.g., by administering a nucleic acid or vector to the individual in vivo.

In some instances, cells employing a feedback circuit of the present disclosure may be therapeutic cells useful in cellular therapy of a subject. For example, in an application such as cellular therapy employing immune cells, the immune cells are engineered to deliver a therapeutic payload of interest in the human body. If the output of these engineered cells is too high, toxic effects may occur (such as e.g., cytokine release syndrome (CRS) as observed in CAR T cell therapies), but on the other hand an output that is too low then the therapy may be ineffective. Therapeutic cells can be fine-tuned to achieve a desired level of output (i.e., a setpoint) under well-controlled laboratory conditions. However, the dynamic environments in which engineered therapeutic cells function make guaranteeing that the output will remain constant over time difficult. Using the molecular circuits described herein for implementing feedback control, engineered cells have the ability to automatically correct against disturbances encountered the environment, including e.g., disturbances that cause the output to drift. In one aspect, self-regulating engineered cells are more robust in in vivo scenarios, thus improving existing cell therapy applications of synthetic biology.

In some instances, cellular therapeutics such as CAR T cells or synthetic receptor (e.g., SynNotch) enabled T cells greatly benefit from feedback control as a safety mechanism. A feedback controller in a CAR T cell may regulate the level of T cell activation and prevents toxic effects such as CRS which result from overstimulation of immune cells. Similarly, in SynNotch T cells, e.g., feedback control may enable delivery of a precise concentration of a payload of interest regardless of any disturbances to the engineered cell that are present or introduced. As will be readily understood, use of feedback control in therapeutic cells is not limited to these approaches and include other approaches as well.

Figures 8, 9:
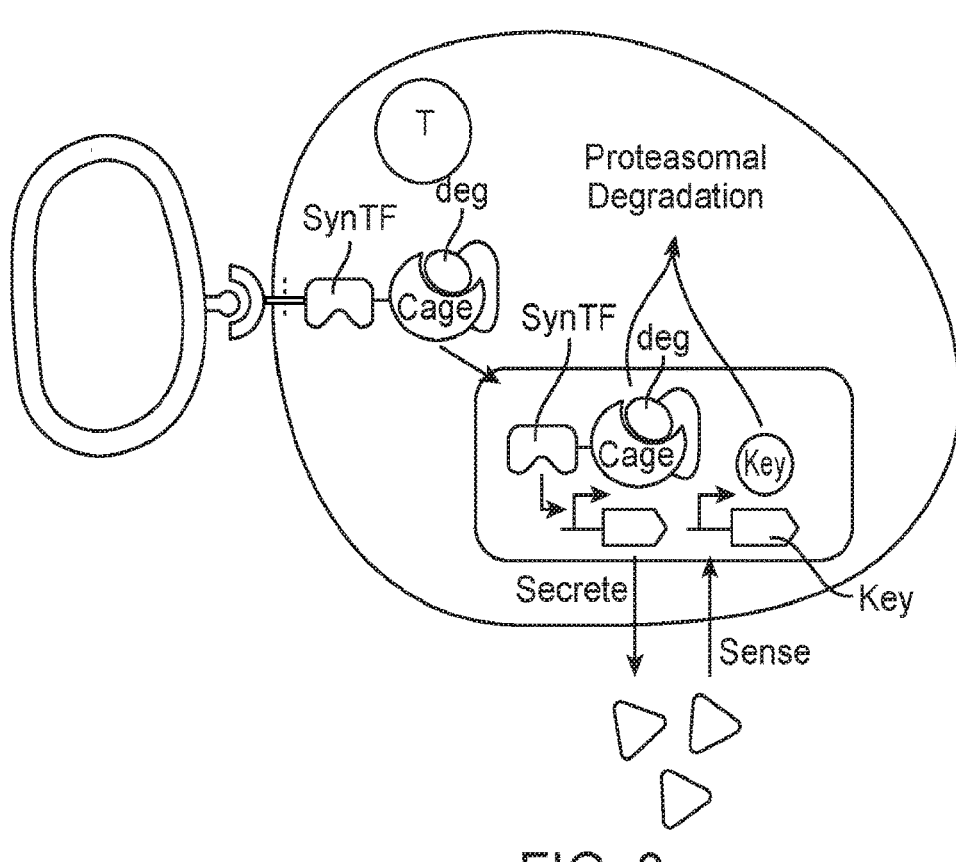
FIG. 8 schematically depict a T lymphocyte employing a molecular feedback circuit of the present disclosure for intercellular control of cytokine signaling.
FIG. 9 schematically depict a T lymphocyte employing a molecular feedback circuit of the present disclosure for environmental control of T cell activation.

For example, the use of feedback control to provide for intercellular control of cytokine signaling in a T lymphocyte is depicted in FIG. 8. As shown, the T cell is modified to express a synNotch receptor responsive to an antigen present on a target cell. The synNotch receptor includes an intracellular portion including a synthetic transcription factor (SynTF) and a caged degron that includes a cage (Cage) and a degron (deg). The cell has been further modified to include a nucleic acid that includes a sequence encoding a cytokine (triangle) operably linked to a transcriptional regulator element responsive to the SynTF and a nucleic acid that that includes a sequence encoding a key polypeptide operably linked to a transcriptional regulator element responsive to the cytokine (or a signaling member downstream of the cytokine). Upon antigen binding, the synNotch is proteolytically cleaved, releasing the intracellular portion such that the SynTF induces production and secretion of the cytokine. When cytokine levels reach a predetermined threshold, e.g., determined by tuning components of the circuit, the cytokine, or a downstream component of a signaling pathway activated by the cytokine, induces expression of the key polypeptide (Key). Once expressed, the key polypeptide uncages the caged degron, resulting in proteasomal degradation of SynNotch receptor and the key polypeptide, thereby downregulating production of the cytokine.

As another example, FIG. 9 schematically depicts the environmental control of T cell activation in a T lymphocyte expressing a CAR. As shown, the T cell is modified to express a CAR responsive to an antigen present on a target cell. The CAR includes an intracellular portion that includes an immune activating portion (CD3z) and a caged degron that includes a cage (Cage) and a degron (deg). The cell has been further modified to include a nucleic acid that that includes a sequence encoding a key polypeptide operably linked to a transcriptional regulator element responsive to a cytokine (or a signaling member downstream of the cytokine) produced in response to activation of the native T-cell program by the CAR binding its antigen. Thus, upon antigen binding, the CAR activates the native T-cell program and the cytokine (IL-6), to which the transcriptional regulator is response, is produced and secreted. The level of IL-6 is sensed by the cell and when IL-6 levels reach a predetermined threshold, e.g., determined by tuning components of the circuit, IL-6, or a downstream component of a signaling pathway activated by IL-6, induces expression of the key polypeptide (Key). Once expressed, the key polypeptide uncages the caged degron, resulting in proteasomal degradation of the CAR and the key polypeptide, thereby downregulating production of the cytokine.

Useful cells, within which circuits of the present disclosure may be employed, are not limited to therapeutic cells. For example, in some instances cells used in bioproduction may be employed. By "bioproduction", as used herein, is generally meant processes by which a desired component is produced by cell for various applications, e.g., for industrial, commercial, biomedical, research, etc., applications. Biological products produced in bioproduction processes may vary and such products may be endogenous or heterologous to the cell and/or organism used in its production. In some instances, biological products of interest include, but are not limited to, recombinant therapeutic proteins, viruses (e.g. recombinant viruses for gene therapy), vaccines, antibodies, proteins and peptides (e.g., enzymes, growth factors, etc.), polysaccharides, nucleic acids (including DNA and RNA), cells, and nutritional products. Circuits and/or methods of the present disclosure may be used in conjunction with several different production techniques known in the art, such as the production of biological products using cells in a bioreactor (e.g., mammalian, yeast, bacteria, and/or insect cells), methods involving the use of transgenic animals (e.g. goats or chickens), methods involving the use of transgenic plants (e.g., tobacco, seeds or moss), and other methods known to those of skill in the art.

Where employed, suitable cells for bioproduction may include but are not limited to e.g., COS cells, NS0 cells, SP2/0 cells, YB2/0 cells, and the like. Useful cells may be of prokaryotic (e.g., bacterial) or eukaryotic origin (including e.g., mammalian, yeast, plant, etc.) and may, in some instances, be established cell culture lines. Suitable cells may, in some instances, also include HeLa cells (e.g., American Type Culture Collection (ATCC) No. CCL-2), CHO cells (e.g., ATCC Nos. CRL9618, CCL61, CRL9096), 293 cells (e.g., ATCC No. CRL-1573), Vero cells, NIH 3T3 cells (e.g., ATCC No. CRL-1658), Huh-7 cells, BHK cells (e.g., ATCC No. CCL10), PC12 cells (ATCC No. CRL1721), COS cells, COS-7 cells (ATCC No. CRL1651), RAT1 cells, mouse L cells (ATCC No. CCLI.3), human embryonic kidney (HEK) cells (ATCC No. CRL1573), HLHepG2 cells, and the like.

In some instances, useful bioproduction cells may include yeast cells. Suitable yeast cells include, but are not limited to, *Pichia pastoris, Pichia finlandica, Pichia trehalophila, Pichia koclamae, Pichia membranaefaciens, Pichia opuntiae, Pichia thermotolerans, Pichia salictaria, Pichia guercuum, Pichia pijperi, Pichia stiptis, Pichia methanolica, Pichia* sp., *Saccharomyces cerevisiae, Saccharomyces* sp.,

54

*Hansenula polymorpha, Kluyveromyces* sp., *Kluyveromyces lactis, Candida albicans, Aspergillus nidulans, Aspergillus niger, Aspergillus oryzae, Trichoderma reesei, Chrysosporium lucknowense, Fusarium* sp., *Fusarium gramineum, Fusarium venenatum, Neurospora crassa, Chlamydomonas reinhardtii,* and the like.

In some instances, useful bioproduction cells may include prokaryotic cells. Suitable prokaryotic cells include, but are not limited to, any of a variety of laboratory strains of *Escherichia coli, Lactobacillus* sp., *Salmonella* sp., *Shigella* sp., and the like. See, e.g., Carrier et al. (1992) *J. Immunol.* 148:1176-1181; U.S. Pat. No. 6,447,784; and Sizemore et al. (1995) Science 270:299-302. Examples of *Salmonella* strains which can be employed include, but are not limited to, *Salmonella typhi* and *S. typhimurium.* Suitable *Shigella* strains include, but are not limited to, *Shigella flexneri, Shigella sonnei,* and *Shigella disenteriae.* Typically, the laboratory strain is one that is non-pathogenic. Non-limiting examples of other suitable bacteria include, but are not limited to, *Bacillus subtilis, Pseudomonas pudita, Pseudomonas aeruginosa, Pseudomonas mevalonii, Rhodobacter sphaeroides, Rhodobacter capsulatus, Rhodospirillum rubrum, Rhodococcus* sp., and the like. In some embodiments, the cell is *Escherichia coli.*

In some instances, feedback control useful is cells employed for metabolic engineering, where the balance of enzymes in a metabolic pathway is essential to obtain an optimal titer of product. It is common for intermediates or even final products of metabolic pathways to have at least some level of toxicity to the host cell. Therefore, optimization of the ratios of enzymes is beneficial to maximizing the amount of product produced while maintaining effective cell growth. As an additional, due to the large size of reactors employed industrial fermentations, cells across a fermentation may experience highly variable environments and may be subjected to various different stressors at differing levels. These disturbances may cause the activity of enzymes to shift, necessitating "re-balancing" of pathway activity. A feedback controller employing a molecular circuit of the present disclosure mitigates the effects of disturbances, maximizing titers by dynamically rebalancing enzyme ratios.

Methods

As summarized above, the present disclosure also provides methods of using caged-degron-based molecular feedback circuits. Such methods include but are not limited to e.g., methods of modulating a signaling pathway of a cell where the cell is or has been genetically modified with a caged-degron-based molecular feedback circuit.

Methods employed for modulating signaling of a signaling pathway of a cell may serve various purposes. For example, in some instances, a circuit of the present disclosure may be employed in a method to provide feedback control of a signaling pathway of interest. In some instances, feedback control may include negative feedback control, which may, among other aspects, e.g., prevent the pathway from remaining active when a particular pathway output is produced and/or produced at or above a threshold level. In some instances, feedback control may include positive feedback control, which may, among other aspects, e.g., provide for amplification of a particular pathway output. In some instances, feedback control may provide for more stable output of a signaling pathway, including e.g., where the signaling output of the pathway is insulated from variables such as but not limited to e.g., environmental factors and inputs.

As described above, cells of the methods of the present disclosure may vary and may include in vitro and/or ex vivo cells genetically modified with one or more nucleic acids encoding one or more components of one or more circuits as described herein. In some instances, cells are primary cells obtained from a subject. In some instances, cells are obtained from a cell culture.

Accordingly, methods of the present disclosure may include obtaining cells used in the method, including where such cells are unmodified or have already been genetically modified to include a circuit of the present disclosure. In some instances, methods of the present disclosure may involves performing the genetic modification. In some instances, methods of the present disclosure may include collecting cells, including where cells are collected before and/or after genetic modification. Methods of collecting cells may vary and may include e.g., collecting cells from a cell culture, collecting a cellular sample from a subject that includes the cells of interest, and the like.

In some instances, methods of the present disclosure may include modulating (e.g., increasing and/or decreasing) signaling of a signaling pathway, where such modulating involves uncaging of a caged degron, such as e.g., a degron-LOCKR protein, to cause degradation of a signaling protein of the pathway. As described herein, the circuits of the present disclosure may include feedback, including positive and negative feedback. Feedback of the present methods may be dependent upon, at least in part, an output of the signaling pathway. Thus, once the circuit is initiated and/or a cell containing the circuit is delivered, modulation of the signaling pathway in accordance with the circuit may not necessitate further manipulation, i.e., feedback regulation of the signaling pathway by the circuit may be essentially automatic.

Accordingly, in methods employing cells that contain a molecular feedback circuit of the present disclosure, in some instances, the cells may be administered to the subject and no further manipulation of the circuit need be performed. For example, where a subject is treated with cells that contain a molecular feedback circuit of the present disclosure, the treatment may include administering the cells to the subject, including where such administration is the sole intervention to treat the subject.

In such methods, cells that may be administered may include, but are not limited to e.g., immune cells. In such methods, the circuit may be configured, in some instances, to modulate signaling of a native or synthetic signaling pathway of the immune cell, such as but not limited to e.g., an immune activation pathway or an immune suppression pathway. Non-limiting examples of suitable immune activation pathways, whether regulated by native or synthetic means, include cytokine signaling pathways, B cell receptor signaling pathways, T cell receptor signaling pathways, and the like. Non-limiting examples of suitable immune suppression pathways, whether regulated by native or synthetic means, include inhibitory immune checkpoint pathways, and the like.

Methods of the present disclosure may include administering to a subject cells that express a therapeutic agent. Such cells may include a molecular feedback circuit of the present disclosure and may or may not be immune cells. For example, in some instances, a method may include administering to a subject a non-immune cell that produces a therapeutic agent, either endogenously or heterologously, where production of the therapeutic is controlled, in whole or in part, by the molecular feedback circuit. In some instances, a method may include administering to a subject an immune cell that produces a therapeutic agent, either endogenously or heterologously, where production of the therapeutic is controlled, in whole or in part, by the molecular feedback circuit. Non-limiting examples of suitable encoded therapeutic agents, include but are not limited to e.g., hormones or components of hormone production pathways, such as e.g., insulins or a component of an insulin production pathway, estrogen/progesterone or a component of an estrogen/progesterone production pathway, testosterone or a component of an androgen production pathway, growth hormone or a component of a growth hormone production pathway, or the like.

Such methods may be employed, in some instances, to treat a subject for a condition, including e.g., where the condition is a deficiency in a metabolic or a hormone. In such instances, the molecular feedback circuit may be configured such that the output of the molecular feedback circuit controls, in whole or in part, production and/or secretion of a metabolic or a hormone.

In some instances, the instant methods may include contacting a cell with one or more nucleic acids encoding a circuit wherein such contacting is sufficient to introduce the nucleic acid(s) into the cell. Any convenient method of introducing nucleic acids into a cell may find use herein including but not limited viral transfection, electroporation, lipofection, bombardment, chemical transformation, use of a transducible carrier (e.g., a transducible carrier protein), and the like. Nucleic acids may be introduced into cells maintained or cultured in vitro or ex vivo. Nucleic acids may also be introduced into a cell in a living subject in vivo, e.g., through the use of one or more vectors (e.g., viral vectors) that deliver the nucleic acids into the cell without the need to isolate, culture or maintain the cells outside of the subject.

Any convenient method of delivering the circuit encoding components may find use in the subject methods. In some instances, the subject circuit may be delivered by administering to the subject a cell expressing the circuit. In some instances, the subject circuit may be delivered by administering to the subject a nucleic acid comprising one or more nucleotide sequences encoding the circuit. Administering to a subject a nucleic acid encoding the circuit may include administering to the subject a cell containing the nucleic acid where the nucleic acid may or may not yet be expressed. In some instances, administering to a subject a nucleic acid encoding the circuit may include administering to the subject a vector designed to deliver the nucleic acid to a cell.

The subject methods may include introducing into a subject in need thereof, cells that contain nucleic acid sequences encoding a therapeutic, the expression of which is controlled, at least in part by a molecular feedback circuit. The therapeutic may be a therapeutic for the treatment of cancer. The introduced cells may be immune cells, including e.g., myeloid cells or lymphoid cells.

Non-limiting examples of cancers that may be treated include, e.g., Acute Lymphoblastic Leukemia (ALL), Acute Myeloid Leukemia (AML), Adrenocortical Carcinoma, AIDS-Related Cancers (e.g., Kaposi Sarcoma, Lymphoma, etc.), Anal Cancer, Appendix Cancer, Astrocytomas, Atypical Teratoid/Rhabdoid Tumor, Basal Cell Carcinoma, Bile Duct Cancer (Extrahepatic), Bladder Cancer, Bone Cancer (e.g., Ewing Sarcoma, Osteosarcoma and Malignant Fibrous Histiocytoma, etc.), Brain Stem Glioma, Brain Tumors (e.g., Astrocytomas, Central Nervous System Embryonal Tumors, Central Nervous System Germ Cell Tumors, Craniopharyngioma, Ependymoma, etc.), Breast Cancer (e.g., female breast cancer, male breast cancer, childhood breast cancer, etc.), Bronchial Tumors, Burkitt Lymphoma, Carcinoid Tumor (e.g., Childhood, Gastrointestinal, etc.), Carcinoma of Unknown Primary, Cardiac (Heart) Tumors, Central Nervous System (e.g., Atypical Teratoid/Rhabdoid Tumor, Embryonal Tumors, Germ Cell Tumor, Lymphoma, etc.), Cervical Cancer, Childhood Cancers, Chordoma, Chronic Lymphocytic Leukemia (CLL), Chronic Myelogenous Leukemia (CML), Chronic Myeloproliferative Neoplasms, Colon Cancer, Colorectal Cancer, Craniopharyngioma, Cutaneous T-Cell Lymphoma, Duct (e.g., Bile Duct, Extrahepatic, etc.), Ductal Carcinoma In Situ (DCIS), Embryonal Tumors, Endometrial Cancer, Ependymoma, Esophageal Cancer, Esthesioneuroblastoma, Ewing Sarcoma, Extracranial Germ Cell Tumor, Extragonadal Germ Cell Tumor, Extrahepatic Bile Duct Cancer, Eye Cancer (e.g., Intraocular Melanoma, Retinoblastoma, etc.), Fibrous Histiocytoma of Bone (e.g., Malignant, Osteosarcoma, ect.), Gallbladder Cancer, Gastric (Stomach) Cancer, Gastrointestinal Carcinoid Tumor, Gastrointestinal Stromal Tumors (GIST), Germ Cell Tumor (e.g., Extracranial, Extragonadal, Ovarian, Testicular, etc.), Gestational Trophoblastic Disease, Glioma, Hairy Cell Leukemia, Head and Neck Cancer, Heart Cancer, Hepatocellular (Liver) Cancer, Histiocytosis (e.g., Langerhans Cell, etc.), Hodgkin Lymphoma, Hypopharyngeal Cancer, Intraocular Melanoma, Islet Cell Tumors (e.g., Pancreatic Neuroendocrine Tumors, etc.), Kaposi Sarcoma, Kidney Cancer (e.g., Renal Cell, Wilms Tumor, Childhood Kidney Tumors, etc.), Langerhans Cell Histiocytosis, Laryngeal Cancer, Leukemia (e.g., Acute Lymphoblastic (ALL), Acute Myeloid (AML), Chronic Lymphocytic (CLL), Chronic Myelogenous (CML), Hairy Cell, etc.), Lip and Oral Cavity Cancer, Liver Cancer (Primary), Lobular Carcinoma In Situ (LCIS), Lung Cancer (e.g., Non-Small Cell, Small Cell, etc.), Lymphoma (e.g., AIDS-Related, Burkitt, Cutaneous T-Cell, Hodgkin, Non-Hodgkin, Primary Central Nervous System (CNS), etc.), Macroglobulinemia (e.g., Waldenström, etc.), Male Breast Cancer, Malignant Fibrous Histiocytoma of Bone and Osteosarcoma, Melanoma, Merkel Cell Carcinoma, Mesothelioma, Metastatic Squamous Neck Cancer with Occult Primary, Midline Tract Carcinoma Involving NUT Gene, Mouth Cancer, Multiple Endocrine Neoplasia Syndromes, Multiple Myeloma/Plasma Cell Neoplasm, Mycosis Fungoides, Myelodysplastic Syndromes, Myelodysplastic/Myeloproliferative Neoplasms, Myelogenous Leukemia (e.g., Chronic (CML), etc.), Myeloid Leukemia (e.g., Acute (AML), etc.), Myeloproliferative Neoplasms (e.g., Chronic, etc.), Nasal Cavity and Paranasal Sinus Cancer, Nasopharyngeal Cancer, Neuroblastoma, Non-Hodgkin Lymphoma, Non-Small Cell Lung Cancer, Oral Cancer, Oral Cavity Cancer (e.g., Lip, etc.), Oropharyngeal Cancer, Osteosarcoma and Malignant Fibrous Histiocytoma of Bone, Ovarian Cancer (e.g., Epithelial, Germ Cell Tumor, Low Malignant Potential Tumor, etc.), Pancreatic Cancer, Pancreatic Neuroendocrine Tumors (Islet Cell Tumors), Papillomatosis, Paraganglioma, Paranasal Sinus and Nasal Cavity Cancer, Parathyroid Cancer, Penile Cancer, Pharyngeal Cancer, Pheochromocytoma, Pituitary Tumor, Pleuropulmonary Blastoma, Primary Central Nervous System (CNS) Lymphoma, Prostate Cancer, Rectal Cancer, Renal Cell (Kidney) Cancer, Renal Pelvis and Ureter, Transitional Cell Cancer, Retinoblastoma, Rhabdomyosarcoma, Salivary Gland Cancer, Sarcoma (e.g., Ewing, Kaposi, Osteosarcoma, Rhabdomyosarcoma, Soft Tissue, Uterine, etc.), Sézary Syndrome, Skin Cancer (e.g., Childhood, Melanoma, Merkel Cell Carcinoma, Nonmelanoma, etc.), Small Cell Lung Cancer, Small Intestine Cancer, Soft Tissue Sarcoma, Squamous Cell Carcinoma, Squamous Neck Cancer (e.g., with Occult Primary, Metastatic, etc.), Stomach (Gastric)

Cancer, T-Cell Lymphoma, Testicular Cancer, Throat Cancer, Thymoma and Thymic Carcinoma, Thyroid Cancer, Transitional Cell Cancer of the Renal Pelvis and Ureter, Ureter and Renal Pelvis Cancer, Urethral Cancer, Uterine Cancer (e.g., Endometrial, etc.), Uterine Sarcoma, Vaginal Cancer, Vulvar Cancer, Waldenström Macroglobulinemia, Wilms Tumor, and the like.

In some instances, methods of the present disclosure may be employed to treat a subject for an immune dysfunction, including but not limited to e.g., where the condition is an autoimmune disease. For example, in some instances, a molecular feedback circuit of the present disclosure may be configured to regulate the immune activation level of a subject having an autoimmune disease, thus controlling the subject's autoimmune response to treat the subject for the autoimmune disease. In some instances, a subject having an autoimmune disease may be administered cells configured to contain a molecular feedback circuit of the present disclosure where the output of the molecular feedback circuit is immune suppression.

The present disclosure further includes methods of making the nucleic acids, circuits, and cells employed in the herein described methods. In making the subject nucleic acids and circuits, and components thereof, any convenient methods of nucleic acid manipulation, modification and amplification (e.g., collectively referred to as "cloning") may be employed. In making the subject cells, containing the nucleic acids encoding the described circuits, convenient methods of transfection, transduction, culture, etc., may be employed.

A nucleotide sequence encoding all or a portion of the components of a circuit of the present disclosure can be present in an expression vector and/or a cloning vector. Where a subject circuit or component thereof is split between two or more separate polypeptides, nucleotide sequences encoding the two or more polypeptides can be cloned in the same or separate vectors. An expression vector can include a selectable marker, an origin of replication, and other features that provide for replication and/or maintenance of the vector. Suitable expression vectors include, e.g., plasmids, viral vectors, and the like.

Large numbers of suitable vectors and promoters are known to those of skill in the art; many are commercially available for generating a subject recombinant construct. The following vectors are provided by way of example. Bacterial: pBs, phagescript, PsiX174, pBluescript SK, pBs KS, pNH8a, pNH16a, pNH18a, pNH46a (Stratagene, La Jolla, Calif., USA); pTrc99A, pKK223-3, pKK233-3, pDR540, and pRIT5 (Pharmacia, Uppsala, Sweden). Eukaryotic: pWLneo, pSV2cat, pOG44, PXR1, pSG (Stratagene) pSVK3, pBPV, pMSG and pSVL (Pharmacia).

Expression vectors generally have convenient restriction sites located near the promoter sequence to provide for the insertion of nucleic acid sequences encoding heterologous proteins. A selectable marker operative in the expression host may be present. Suitable expression vectors include, but are not limited to, viral vectors (e.g. viral vectors based on vaccinia virus; poliovirus; adenovirus (see, e.g., Li et al., Invest Opthalmol Vis Sci 35:2543 2549, 1994; Borras et al., Gene Ther 6:515 524, 1999; Li and Davidson, PNAS 92:7700 7704, 1995; Sakamoto et al., H Gene Ther 5:1088 1097, 1999; WO 94/12649, WO 93/03769; WO 93/19191; WO 94/28938; WO 95/11984 and WO 95/00655); adeno-associated virus (see, e.g., Ali et al., Hum Gene Ther 9:81 86, 1998, Flannery et al., PNAS 94:6916 6921, 1997; Bennett et al., Invest Opthalmol Vis Sci 38:2857 2863, 1997; Jomary et al., Gene Ther 4:683 690, 1997, Rolling et al., Hum Gene Ther 10:641 648, 1999; Ali et al., Hum Mol Genet 5:591 594, 1996; Srivastava in WO 93/09239, Samulski et al., J. Vir. (1989) 63:3822-3828; Mendelson et al., Virol. (1988) 166:154-165; and Flotte et al., PNAS (1993) 90:10613-10617); SV40; herpes simplex virus; human immunodeficiency virus (see, e.g., Miyoshi et al., PNAS 94:10319 23, 1997; Takahashi et al., J Virol 73:7812 7816, 1999); a retroviral vector (e.g., Murine Leukemia Virus, spleen necrosis virus, and vectors derived from retroviruses such as Rous Sarcoma Virus, Harvey Sarcoma Virus, avian leukosis virus, human immunodeficiency virus, myeloproliferative sarcoma virus, and mammary tumor virus); and the like.

As noted above, in some embodiments, a nucleic acid comprising a nucleotide sequence encoding a circuit or component thereof of the present disclosure will in some embodiments be DNA or RNA, e.g., in vitro synthesized DNA, recombinant DNA, in vitro synthesized RNA, recombinant RNA, etc. Methods for in vitro synthesis of DNA/ RNA are known in the art; any known method can be used to synthesize DNA/RNA comprising a desired sequence. Methods for introducing DNA/RNA into a host cell are known in the art. Introducing DNA/RNA into a host cell can be carried out in vitro or ex vivo or in vivo. For example, a host cell (e.g., an NK cell, a cytotoxic T lymphocyte, etc.) can be transduced, transfected or electroporated in vitro or ex vivo with DNA/RNA comprising a nucleotide sequence encoding all or a portion of a circuit of the present disclosure.

Methods of the instant disclosure may further include culturing a cell genetically modified to encode a circuit of the instant disclosure including but not limited to e.g., culturing the cell prior to administration, culturing the cell in vitro or ex vivo (e.g., the presence or absence of one or more antigens), etc. Any convenient method of cell culture may be employed whereas such methods will vary based on various factors including but not limited to e.g., the type of cell being cultured, the intended use of the cell (e.g., whether the cell is cultured for research or therapeutic purposes), etc. In some instances, methods of the instant disclosure may further include common processes of cell culture including but not limited to e.g., seeding cell cultures, feeding cell cultures, passaging cell cultures, splitting cell cultures, analyzing cell cultures, treating cell cultures with a drug, harvesting cell cultures, etc.

Methods of the instant disclosure may, in some instances, further include receiving and/or collecting cells that are used in the subject methods. In some instances, cells are collected from a subject. Collecting cells from a subject may include obtaining a tissue sample from the subject and enriching, isolating and/or propagating the cells from the tissue sample. Isolation and/or enrichment of cells may be performed using any convenient method including e.g., isolation/enrichment by culture (e.g., adherent culture, suspension culture, etc.), cell sorting (e.g., FACS, microfluidics, etc.), and the like. Cells may be collected from any convenient cellular tissue sample including but not limited to e.g., blood (including e.g., peripheral blood, cord blood, etc.), bone marrow, a biopsy, a skin sample, a cheek swab, etc. In some instances, cells are received from a source including e.g., a blood bank, tissue bank, etc. Received cells may have been previously isolated or may be received as part of a tissue sample thus isolation/enrichment may be performed after receiving the cells and prior to use. In certain instances, received cells may be non-primary cells including e.g., cells of a cultured cell line. Suitable cells for use in the herein described methods are further detailed herein.

Kits

Aspects of the present disclosure also include kits. The kits may include, e.g., one or more of any of the reaction mixture components described above with respect to the subject methods. For example, the kits may include a caged degron polypeptide (or nucleic acid encoding the same), a key polypeptide (or nucleic acid encoding the same), components for delivery, cloning and/or expression, and the like, in various combinations.

Components of the kits may be present in separate containers, or multiple components may be present in a single container. In some instances, components of the subject kits may be presented as a "cocktail" where, as used herein, a cocktail refers to a collection or combination of two or more different but similar components in a single vessel.

In addition to the above-mentioned components, a subject kit may further include instructions for using the components of the kit, e.g., to practice the subject methods as described above. The instructions are generally recorded on a suitable recording medium. The instructions may be printed on a substrate, such as paper or plastic, etc. As such, the instructions may be present in the kits as a package insert, in the labeling of the container of the kit or components thereof (i.e., associated with the packaging or sub-packaging) etc. In other embodiments, the instructions are present as an electronic storage data file present on a suitable computer readable storage medium, e.g. CD-ROM, diskette, Hard Disk Drive (HDD) etc. In yet other embodiments, the actual instructions are not present in the kit, but means for obtaining the instructions from a remote source, e.g. via the internet, are provided. An example of this embodiment is a kit that includes a web address where the instructions can be viewed and/or from which the instructions can be downloaded. As with the instructions, this means for obtaining the instructions is recorded on a suitable substrate.

Examples of Non-Limiting Aspects of the Disclosure

Aspects, including embodiments, of the present subject matter described above may be beneficial alone or in combination, with one or more other aspects or embodiments. Without limiting the foregoing description, certain non-limiting aspects of the disclosure are provided below. As will be apparent to those of skill in the art upon reading this disclosure, each of the individually numbered aspects may be used or combined with any of the preceding or following individually numbered aspects. This is intended to provide support for all such combinations of aspects and is not limited to combinations of aspects explicitly provided below:

1. A molecular feedback circuit, the circuit comprising:
   a signaling protein that, when activated by an input of a signaling pathway, drives an output of the signaling pathway, wherein the signaling protein comprises a caged degron; and
   a regulatory sequence responsive to the output and operably linked to a nucleic acid sequence encoding a key polypeptide that, when expressed, uncages the degron thereby degrading the signaling protein.

2. The circuit according to aspect 1, wherein the caged degron comprises:
   a degron;
   a locker domain comprising five alpha helices; and
   a latch domain comprising an alpha helix that, in the absence of the key polypeptide, forms a six helix bundle with the locker domain to cage the degron.

3. The circuit according to aspect 2, wherein the key comprises an alpha helix that binds the locker domain with higher affinity than the latch domain.

4. The circuit according to aspects 2 or 3, wherein the degron is grafted within the latch domain.

5. The circuit according to any of aspects 2 to 4, wherein the helices of locker domain and the latch domain are 30 to 50 residues in length.

6. The circuit according to any of aspects 3 to 5, wherein the helix of the key polypeptide is 40 to 60 residues in length.

7. The circuit according to any of aspects 2 to 6, wherein the latch domain comprises a toehold truncation.

8. The circuit according to any of the preceding aspects, wherein the degron comprises a ubiquitin-independent degradation signal.

9. The circuit according to aspect 8, wherein the ubiquitin-independent degradation signal comprises a CA dipeptide motif.

10. The circuit according to aspect 9, wherein the ubiquitin-independent degradation signal comprises a LXMSCAQE motif, wherein X is any amino acid.

11. The circuit according to aspect 10, wherein X is any amino acid except proline.

12. The circuit according to any of the preceding aspects, wherein the caged degron comprises an asymmetrized locker domain.

13. The circuit according to any of the preceding aspects, wherein the caged degron shares at least 70% sequence identity with the amino acid sequence of one or more of: degronLOCKR_a_327, degronLOCKR_a_327_noPro, degronLOCKR_a_CAonly, degronLOCKR_a_324_t12, degronLOCKR_a_320_t16, degronLOCKR_b, degronLOCKR_b_t13, degronLOCKR_c, degronLOCKR_c_t13, and degronLOCKR_d.

14. The circuit according to any of the preceding aspects, wherein the caged degron shares at least 90% sequence identity with one or more of: degronLOCKR_a_327, degronLOCKR_a_327_noPro, degronLOCKR_a_CAonly, degronLOCKR_a_324_t12, and degronLOCKR_a_320_t16.

15. The circuit according to any of the preceding aspects, wherein the caged degron shares at least 90% sequence identity with one or more of: degronLOCKR_b, and degronLOCKR_b_t13.

16. The circuit according to any of the preceding aspects, wherein the caged degron shares at least 90% sequence identity with one or more of: degronLOCKR_c, and degronLOCKR_c_t13.

17. The circuit according to any of the preceding aspects, wherein the caged degron shares at least 90% sequence identity with degronLOCKR_d.

18. The circuit according to any of the preceding aspects, wherein the caged degron comprises an amino acid sequence selected from those set forth in SEQ ID NOS. 63-1169.

19. The circuit according to any of the preceding aspects, wherein the input, the output, or both comprise an intracellular signal.

20. The circuit according to any of aspects 1 to 18, wherein the input, the output, or both comprise an intercellular signal.

21. The circuit according to any of the preceding aspects, wherein the signaling protein is a positive regulator of the signaling pathway.

22. The circuit according to any of aspects 1 to 20, wherein the signaling protein is a negative regulator of the signaling pathway.

23. The circuit according to any of the preceding aspects, wherein the signaling protein is an intermediate member of the signaling pathway or a transcription factor.

24. The circuit according to aspect 23, wherein the transcription factor is a synthetic transcription factor.

25. The circuit according to aspects 23 or 24, wherein the regulatory sequence comprises a binding site for a transcription factor of the output.

26. The circuit according to aspect 25, wherein the regulatory sequence comprises a plurality of binding sites for the transcription factor.

27. The circuit according to aspect 26, wherein the plurality of binding sites is 2 to 10 binding sites.

28. The circuit according to any of aspects 23 to 27, wherein the output is expression of the transcription factor.

29. The circuit according to any of aspects 1 to 22, wherein the signaling protein is a receptor and the input is a ligand for the receptor.

30. The circuit according to any of the preceding aspects, wherein the signaling pathway is selected from the group consisting of: a AKT signaling pathway, an Akt/PKB signaling pathway, an AMPK signaling pathway, an apoptosis signaling pathway, a BMP signaling pathway, a cAMP-dependent pathway, an estrogen signaling pathway, a hedgehog signaling pathway, a hippo signaling pathway, an immune activation pathway, an immune suppression pathway, an immune cell differentiation pathway, an insulin signal transduction pathway, a JAK-STAT signaling pathway, a MAPK/ERK signaling pathway, a mTOR signaling pathway, an NF-κB signaling pathway, a nodal signaling pathway, a notch signaling pathway, a p53 signaling pathway, a PI3K signaling pathway, a TGF beta signaling pathway, a TLR signaling pathway, a TNF signaling pathway, a VEGF signaling pathway, and a Wnt signaling pathway.

31. The circuit according to any of the preceding aspects, wherein the circuit further comprises a regulatory sequence operably linked to a nucleic acid sequence encoding the signaling protein.

32. The circuit according to aspect 31, wherein the regulatory sequence operably linked to the nucleic acid sequence encoding the signaling protein is a native promoter of the signaling protein.

33. The circuit according to any of aspects 1 to 31, wherein the signaling pathway is a synthetic signaling pathway.

34. The circuit according to aspect 33, wherein the receptor is a synthetic receptor.

35. The circuit according to aspect 34, wherein the synthetic receptor is a synNotch receptor.

36. The circuit according to aspect 34, wherein the synthetic receptor is a chimeric antigen receptor (CAR) or an engineered T cell receptor (TCR).

37. The circuit according to aspect 36, wherein the output is immune activation or immune suppression.

38. The circuit according to any of the preceding aspects, wherein the key polypeptide is full-length.

39. The circuit according to any of the preceding aspects, wherein the key polypeptide is truncated.

40. The circuit according to any of the preceding aspects, wherein the key polypeptide is truncated by 2 to 20 amino acids.

41. The circuit according to any of the preceding aspects, wherein the key polypeptide shares at least 90% sequence identity with a key polypeptide sequence selected from those set forth in SEQ ID NOS. 1170-13903.

63

42. The circuit according to any of the preceding aspects, wherein the key polypeptide comprises a key polypeptide sequence selected from those set forth in SEQ ID NOS. 1170-13903.

43. One or more nucleic acid molecules encoding the molecular feedback circuit according to any of the preceding aspects.

44. A cell genetically modified to comprise the one or more nucleic acid molecules according to aspect 43.

45. The cell according to aspect 44, wherein the cell is a eukaryotic cell.

46. A method of treating a subject for a condition, the method comprising administering to the subject an effective amount of the eukaryotic cell according to aspect 41.

47. The method according to aspect 46, wherein the condition is a cancer and the output of the molecular feedback circuit is immune activation.

48. The method according to aspect 46, wherein the condition is an autoimmune disease and the output of the molecular feedback circuit is immune suppression.

49. The method according to aspect 46, wherein the condition is a deficiency in a metabolic or a hormone and the output of the molecular feedback circuit is production and/or secretion of the metabolic or the hormone.

50. A method of modulating signaling of a signaling pathway of a cell, the method comprising:

genetically modifying the cell with a molecular feedback circuit comprising:

a nucleic acid sequence encoding a signaling protein of the signaling pathway, the signaling protein comprising a caged degronLOCKR domain; and a regulatory sequence, responsive to an output of the signaling pathway, that is operably linked to a nucleic acid sequence encoding a key polypeptide that uncages the degronLOCKR domain, wherein the uncaged degronLOCKR domain causes degradation of the signaling protein thereby modulating signaling of the signaling pathway.

51. The method according to aspect 50, wherein the modulating comprises negative feedback.

52. The method according to aspect 50, wherein the modulating comprises positive feedback.

53. The method according to any of aspects 50 to 52, wherein the cell is an in vitro or ex vivo cell.

54. The method according to any of aspects 50 to 53, wherein the signaling pathway is a native signaling pathway of the cell.

55. The method according to aspect 54, wherein the native signaling pathway is a native biosynthesis pathway.

56. The method according to aspect 47, wherein the native biosynthesis pathway is a hormone production pathway.

57. The method according to aspect 48, wherein the hormone production pathway is selected from the group consisting of: an insulin production pathway, an estrogen/progesterone production pathway, an androgen production pathway, and a growth hormone production pathway.

58. The method according to aspect 54, wherein the cell is an immune cell and the native signaling pathway is an immune activation pathway or an immune suppression pathway.

59. The method according to aspect 58, wherein the immune activation pathway is selected from the group consisting of: a cytokine signaling pathway, a B cell receptor signaling pathway, and a T cell receptor signaling pathway.

60. The method according to aspect 58, wherein the immune suppression pathway is an inhibitory immune checkpoint pathway.

64

61. The method according to any of aspects 50 to 53, wherein the signaling pathway is a synthetic signaling pathway.

62. The method according to aspect 61, wherein the signaling protein is a synNotch receptor and the output is release of an intracellular domain of the synNotch receptor.

63. The method according to aspect 61, wherein the cell is an immune cell and the signaling pathway is a synthetic immune activation pathway or a synthetic immune suppression pathway.

64. The method according to aspect 63, wherein the immune cell is a myeloid cell or a lymphoid cell.

65. The method according to aspect 64, wherein the immune cell is a lymphoid cell selected from the group consisting of: a T lymphocyte, a B lymphocyte and a Natural Killer cell.

66. The method according to any of aspects 63 to 65, wherein the signaling protein is a synthetic immune receptor.

67. The method according to aspect 66, wherein the synthetic immune receptor is a chimeric antigen receptor (CAR) or an engineered T cell receptor (TCR).

68. The method according to any of aspects 58 to 67, wherein the output is immune activation or immune suppression.

69. The method according to aspect 50, wherein the synthetic signaling pathway is a synthetic biosynthesis pathway.

70. The method according to aspect 69, wherein the synthetic biosynthesis pathway is selected from the group consisting of: a hormone production pathway, an opioid production pathway, an antibiotic production pathway, a chemotherapeutic production pathway, an artemisinic acid production pathway, a terpenoid production pathway, and a polyketide production pathway.

EXAMPLES

The following examples are put forth so as to provide those of ordinary skill in the art with a complete disclosure and description of how to make and use the present invention, and are not intended to limit the scope of what the inventors regard as their invention nor are they intended to represent that the experiments below are all or the only experiments performed. Efforts have been made to ensure accuracy with respect to numbers used (e.g. amounts, temperature, etc.) but some experimental errors and deviations should be accounted for. Unless indicated otherwise, parts are parts by weight, molecular weight is weight average molecular weight, temperature is in degrees Celsius, and pressure is at or near atmospheric. Standard abbreviations may be used, e.g., bp, base pair(s); kb, kilobase(s); pl, picoliter(s); s or sec, second(s); min, minute(s); h or hr, hour(s); aa, amino acid(s); kb, kilobase(s); bp, base pair(s); nt, nucleotide(s); i.m., intramuscular(ly); i.p., intraperitoneal (ly); s.c., subcutaneous(ly); and the like.

Example 1: De Novo Design of Bioactive Protein Switches

Switchable protein systems were design de novo guided by the following general considerations. First, accounting for the free energy differences between a starting state and an induced conformational change is more straightforward in a system governed by inter- and intra-molecular competition at the same site rather than allosteric activation at distant sites. Second, a stable protein framework with an extended binding surface available for the competing interactions is more programmable and less likely to engage in off-target interactions than a framework that only becomes ordered upon binding. These features are described by the abstract system depicted in FIG. 10, panel a, which undergoes thermodynamically-driven switching between a binding incompetent and a binding competent state. A latch (blue) contains a peptide sequence (orange) that can bind a target (yellow) unless blocked by intramolecular interactions to a cage (cyan); a key (green) that binds more tightly to the cage outcompetes the latch, allowing the peptide to bind the target. The behavior of such a system is governed by the binding equilibrium constants for the individual subreactions (FIG. 10, panel a): $K_{open}$, the dissociation of latch from cage; $K_{LT}$, the binding of latch to target; and $K_{CK}$, the binding of key to cage. Solving this set of equations (FIG. 10, panel b) shows that when the latch-cage interaction is too weak (red and orange curves), the system binds target with little to no key and the fold induction by key is low, while when the latch-cage interaction is too strong (purple curve), the system only partially binds target, even at high key concentrations. The latch-cage interaction affinity that gives optimal switching (FIG. 10, panel b, blue curve left, green curve right) is a function of the latch-target binding affinity. This model was used to guide design of switchable protein systems, as described in the following sections.

LOCKR Design

Figure 10:
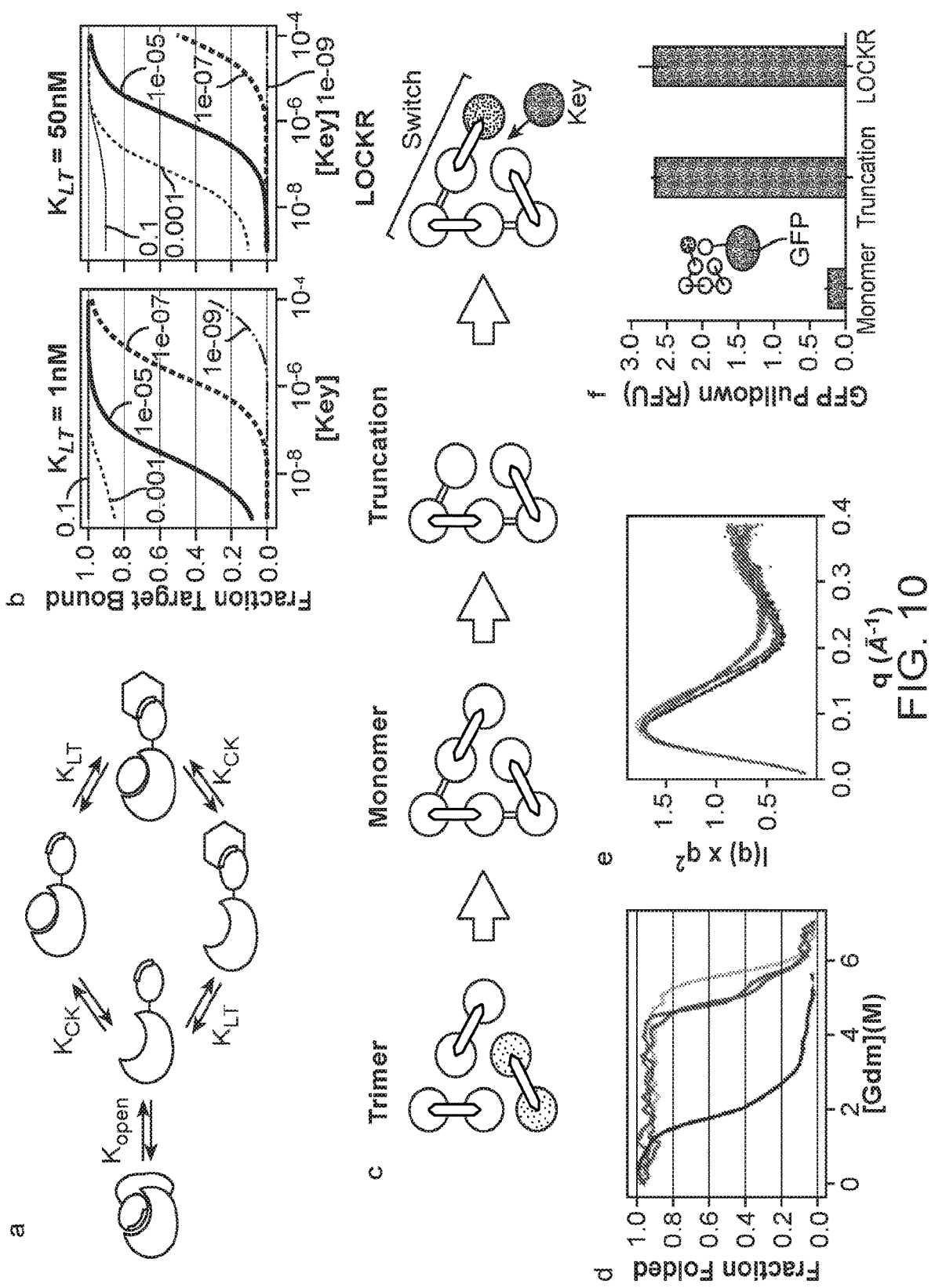
FIG. 10 depicts aspects related to design of the LOCKR switch system according to an embodiment of the disclosure. a, Thermodynamic model describing the design goal. The cage (cyan) and latch (blue) form the switch with some equilibrium in the open and closed states. The key (green) can bind the cage to promote the open state to allow target (yellow) binding to the latch. b, Plots from the model in (a) for two values of $K_{LT}$ showing how fraction target bound is affected by addition of key ($K_{CK}=1$ nM); the different colored curves show the effect of log-decreasing values of $K_{open}=$[open]/[closed]. c, Loops were added to homotrimer 5L6HC3 to form monomeric five- and six-helix frameworks; double mutant V217S/I232S weakens the Latch allowing it to be displaced by key, resulting in a LOCKR system able to bind an exogenous key. d, Chemical denaturation with guanidinium chloride (Gdm) of the trimer (dark blue), monomer (cyan), truncated five-helix framework (red), and LOCKR (green) monitoring mean residue ellipticity (MRE) at 222 nm. e, Small-angle x-ray scattering (SAXS) Kratky plots for the monomeric frameworks are similar to that of the input trimer, with the greatest deviation for the 5 helix framework. Colors continued from (d). f, Pulldown assay showing that Key binds to the truncation and LOCKR (V217S/I232S), but not the six-helix monomer; free GFP-Key was added to monomeric frameworks immobilized onto a plate via a hexahistidine tag; after a series of wash steps, binding was measured by GFP fluorescence (n=2, error bars indicate standard deviation).

To physically implement the switchable system of FIG. 10, panel a, structural features amenable to tuning the affinities of the cage-latch and cage-key interactions over a wide dynamic range were chosen. Alpha helices have advantages over beta strands in that inter-helical interfaces are dominated by sidechain-sidechain interactions, which can be more readily tuned than the backbone hydrogen bonding interactions between beta strands. To allow fine control over the specificity and relative affinities of the cage-latch and cage-key interactions, it was chosen to design interfaces containing buried hydrogen bond networks. As illustrated by Watson-Crick base pairing, considerable alterations of specificity can be obtained with relatively minor changes in the positions of hydrogen bond donors and acceptors. A designed homo-trimer of α-helical hairpins with hydrogen bond network-mediated subunit-subunit interaction specificity (5L6HC3_1 (Boyken, et al. Science 352, 680-687 (2016), the disclosure of which is incorporated herein by reference in its entirety); PDB ID: 5IZS) was chosen as a starting point. By designing short unstructured loops connecting the subunits, monomeric protein frameworks with five or six helices and 40 residues per helix were generated (FIG. 10, panel c). In the five-helix framework, there is an open binding site for a sixth helix added in trans, whereas this site is filled by a sixth helix in cis in the six-helix framework.

Figure 15:
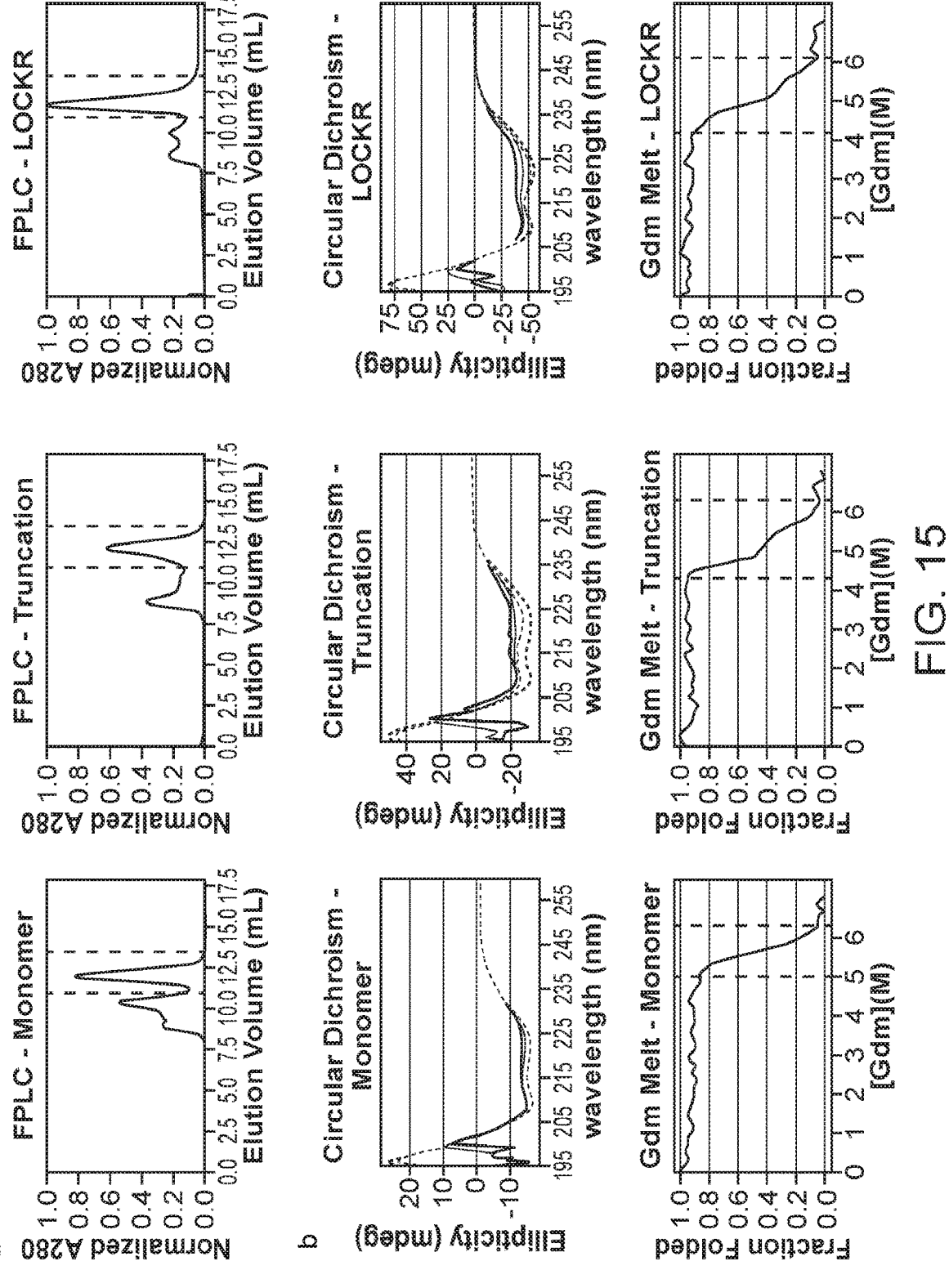
FIG. 15 provides biophysical data related to LOCKR design. a) Size Exclusion Chromatography for the Monomer, Truncation, and LOCKR designs on Superdex 75. Peaks indicated by vertical dashed lines represent monomeric protein used in downstream characterization and functional assays. b) Circular dichroism spectroscopy to determine protein stability upon heating and chemical denaturant, Guanidinium Chloride-HCl. Top row: full wavescan at 25° C. (blue), 75° C. (orange), 95° C. (red), then cooled to 25° C. (cyan). Middle row: guanidine melts also shown overlapped in FIG. 1d. Bottom row: fraction folded was converted to equilibrium constant, then to $\Delta G_{unfolding}$ value. The linear unfolding region, marked by vertical lines in middle row, was fit to determine the $\Delta G_{folding}$ for each design. c) SAXS spectra (black) referenced in FIG. 1e fit to Rosetta design models (red) using FoXS with chi-values referenced in the upper right.
Figure 15:
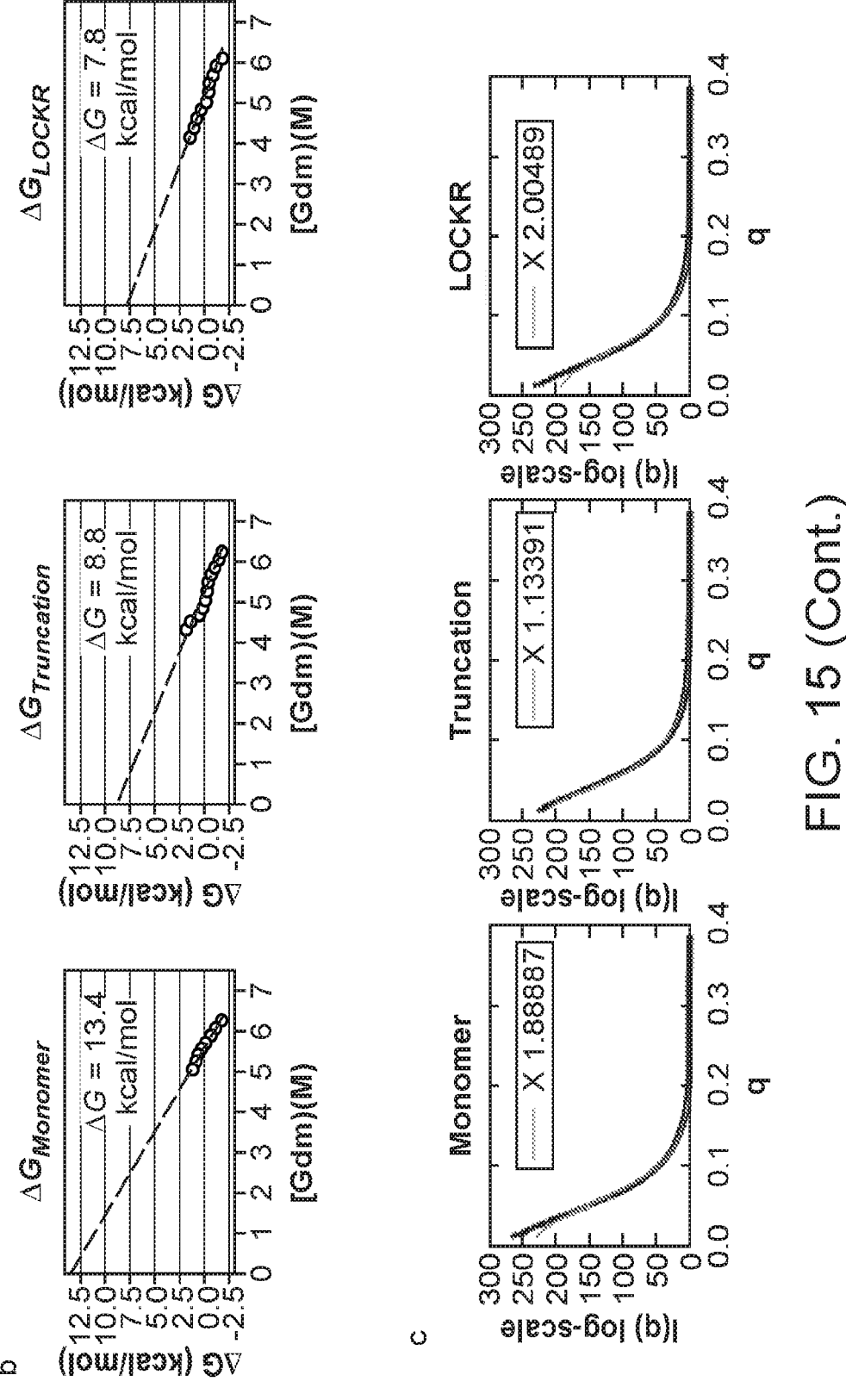

The five helix (cage) and six helix (cage plus latch) designs were soluble when recombinantly expressed in *E. coli*; the purified proteins were largely monomeric by size-exclusion chromatography (FIG. 15), and very stable, remaining folded up to 5 M guanidine hydrochloride (FIG. 10, panel d). Small-angle x-ray scattering (SAXS) spectra of the connected designs are similar to that of the starting trimer and indicative of a well folded protein (FIG. 10, panel e), suggesting that the structure is not altered by the loops. The five-helix framework, but not the six-helix framework, binds to the sixth helix fused to GFP in a pull-down assay (FIG. 10, panel f); the latter result is expected since if the interfaces are otherwise identical and the connecting linker unstrained, the intramolecular interaction should outcompete its intermolecular counterpart because of the reduced entropic cost of formation of intramolecular interactions. To enable the key to outcompete the latch, $K_{open}$ was tuned by incorporating mutations in the latch that weaken its interaction with the cage: large hydrophobics to alanine or serine, and alanine residues to larger hydrophobics or serine. A double mutant, V223S/I238S, bound key as strongly as the five-helix cage without the latch (FIG. 10, panel f; FIG. 16); the two serines likely weaken the cage-latch interaction by decreasing the helical propensity of the latch and increasing the cost of desolvating the latch when it binds the cage. In the absence of the key, the latch is bound to the cage as in the original monomer (their SAXS spectra are nearly identical and data closely matches the design models; FIG. 10, panel e; FIG. 15), but the guanidine hydrochloride denaturation midpoint and $\Delta G_{folding}$ are more similar to the truncated 5 helix design indicating the mutations are in fact destabilizing (FIG. 10, panels d and e; FIG. 15). Such cage-latch frameworks are referred to in some instances as switches, and the switch-key pair is, in some instances, referred to as LOCKR for Latching Orthogonal Cage-Key pRoteins.

LOCKR Inducible Bim-Bcl2 Binding

Figure 18:
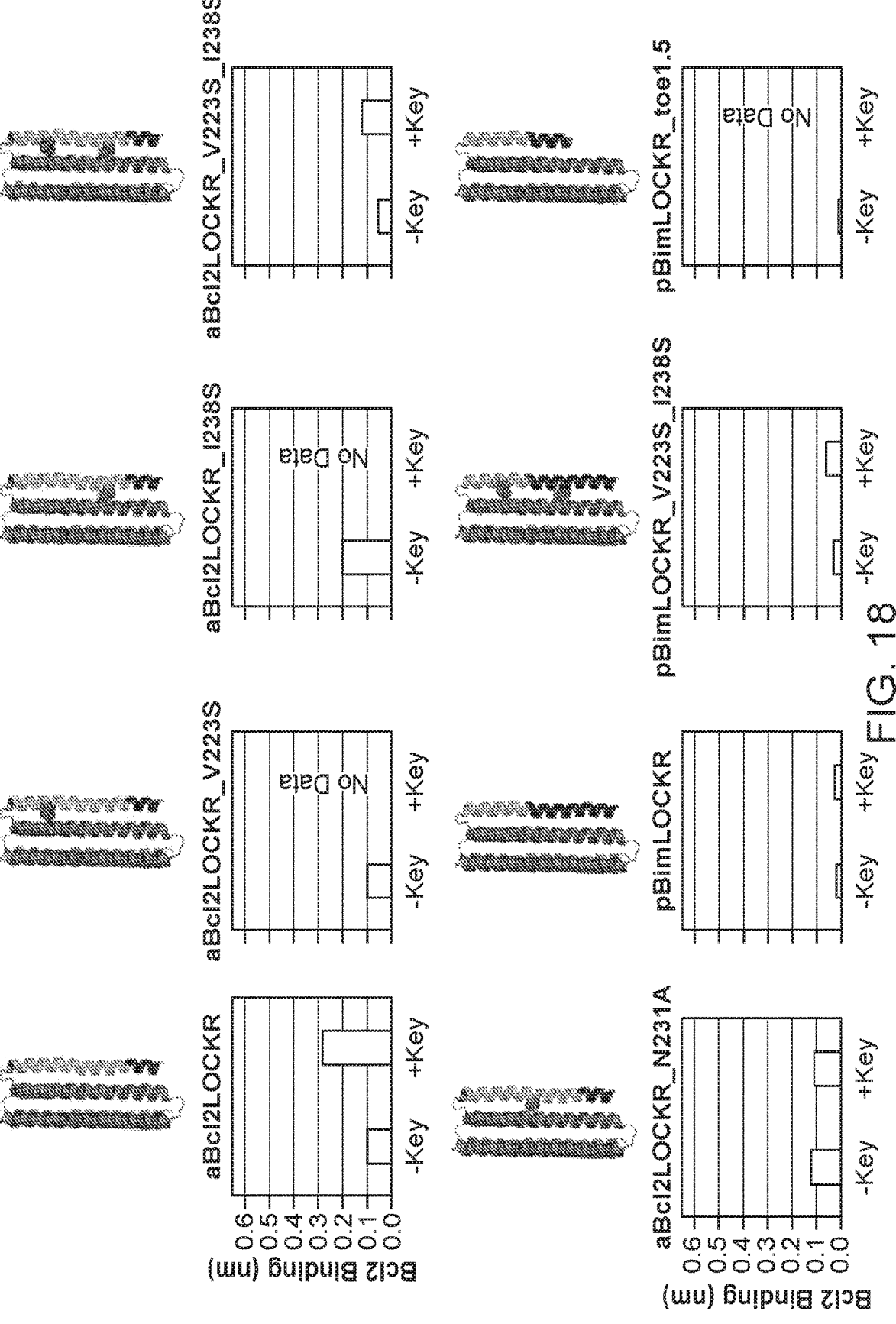
FIG. 18 demonstrate an example of tuning BimLOCKR.
Figure 18:
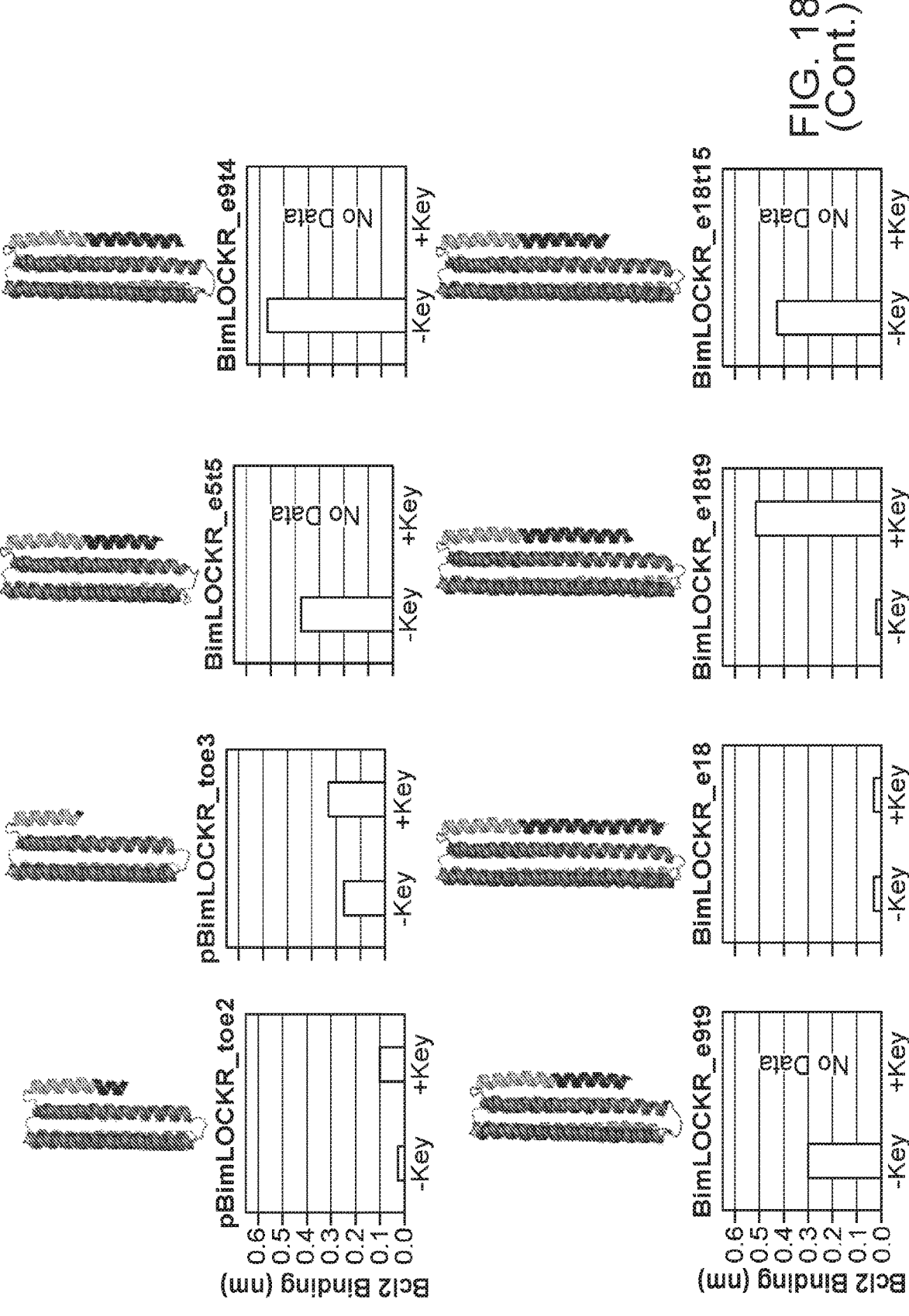

The latch, while folded, can cage a functional peptide sequence in an 'off' state such that the switch is active only once the key binds and the latch is released as per the model in FIG. 10, panel a. The system can then be tuned to the desired dynamic range based on the outlined thermodynamic parameters (FIG. 10, panel a). To install function into the initial LOCKR design, the Bim-Bcl2 interaction central to apoptosis was selected as a model system. Thus, the system was used to cage Bim such that binding to Bcl2 only occurred in the presence of key. Two Bim-related sequences were incorporated into the switch: the eight Bim residues which interact with Bcl2 (Delgado-Soler, et al. J. Chem. Inf. Model. 52, 2107-2118 (2012)) and a larger designed Bcl2 binding protein (Berger, et al. Elife 5, (2016)), to explore the effect of changes in $K_{open}$: the two sequences will have different interactions with the cage, destabilizing the latch in different ways. These sequences also bind Bcl2 differently providing sampling of $K_{LT}$. The two sequences were grafted onto the latch by sampling different helical registers such that residues involved in binding to Bcl2 are sequestered in the cage-latch interface (FIG. 17), optimizing for the burial of hydrophobic residues and surface exposure of polar residues. These initial designs either bound Bcl2 in the absence of key, or were not inducible (FIG. 18). The range of accessible $K_{open}$ and $K_{CK}$ values were evidently not matched to $K_{LT}$ as the key induced response was far from the ideal curves in FIG. 10, panel b.

Figure 11:
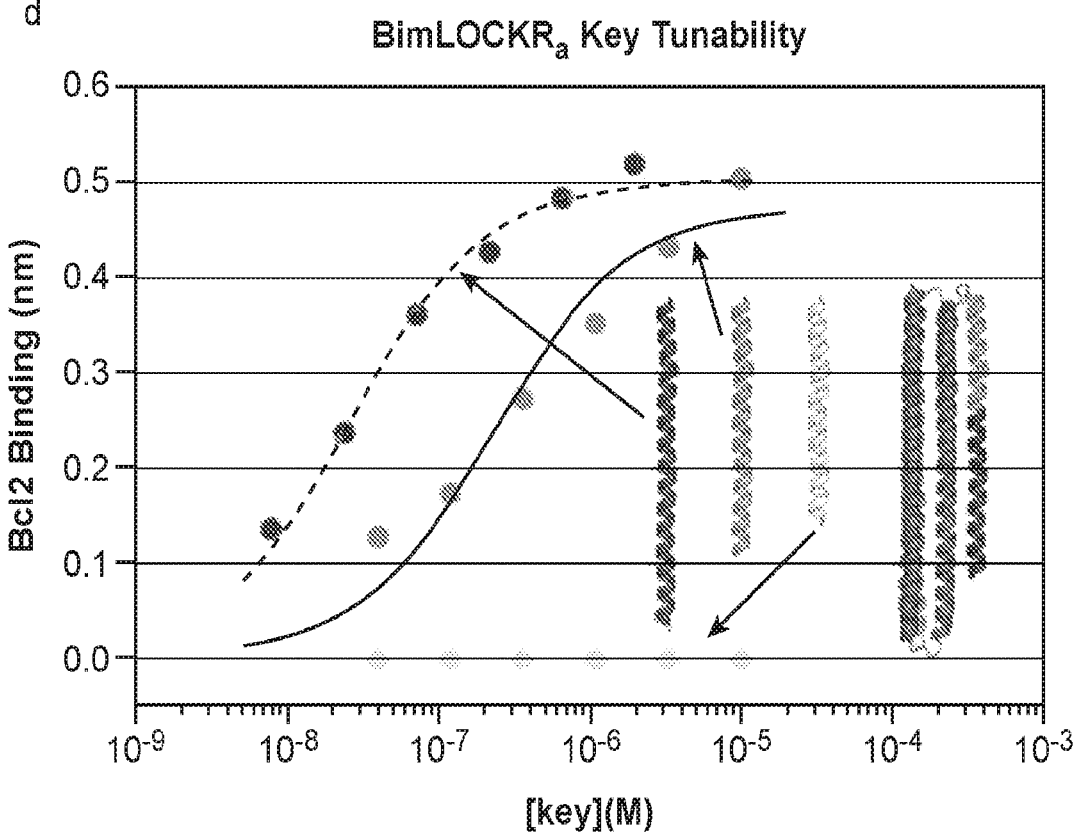
FIG. 11 depicts aspects related to BimLOCKR design and activation. a, Following incorporation of the BIM peptide into the LOCKR latch, the free energy of the latch-cage interface was reduced by introducing sub-optimal interactions (left, removal of a buried hydrogen bond) and by truncating the latch, leaving exposed hydrophobic residues in the cage available for key binding (right). b, The lengthened BimLOCKR constructs show tight caging of Bim in the absence of key while introduction of the toehold (right) allows activation of 250 nM BimLOCKR with addition of 5 µM key via Bio-layer interferometry. c, Bio-layer interferometry shows key-dependent binding to Bcl2 with 250 nM BimLOCKR. Association from 0-500 s, then dissociation from 500-1700 s. Purple is at 3 µM key, then a three fold dilution of the key through blue, cyan, green, yellow, and orange. Red line is 250 nM LOCKR without key added. d, Each point in dark green is a result of fitting data in (c) and extracting the response at equilibrium; the lighter green curves show binding response at equilibrium for shorter keys that alter $K_{CK}$ of LOCKR to tune its range of activation. Dashed lines are the data fit to a logistic curve.

A wider range of $K_{open}$ and $K_{CK}$ values could be accessed by lengthening the helices in the cage to provide more accessible interaction surface area: extending the latch:cage interface could then increase the interaction affinity (decrease $K_{open}$) to make the system more "off" in absence of key. At the same time, extending the key to increase its affinity to the cage could allow it to better outcompete the latch once $K_{open}$ is appropriately tuned (decrease $K_{CK}$ relative to $K_{open}$), making the system more inducible. Taking advantage of the modular nature of de novo parametric helical bundles, the cage, latch and key were each extended by 5, 9 or 18 residues. To enable the key to outcompete the latch, the latter was truncated by four to nine residues to generate a range of $K_{open}$ values (FIG. 18; this creates a "toehold" on the cage for the key to bind). Both the full length Bim containing latch and the truncated versions were fully off in the absence of key (no binding to Bcl2 was observed, left bars in FIG. 11, panel b). The most strongly inducible binding (FIG. 11, panel b, right bar in right panel)

was observed with the system with 18-residue extensions of the cage and the key, and a 9-residue shorter latch that leaves an exposed 9-residue toehold on the cage (the key does not interact directly with Bcl2 (FIG. 18)). This extended design with toehold exhibits an approximately 40-fold activation on addition of key in biolayer interferometry experiments (FIG. 11, panel c), comparable to or better than many naturally occurring protein interaction induced switches.

According to the model in FIG. 10, panel a, the range of key concentrations over which BimLOCKR is activated should be controllable by tuning $K_{CK}$ by altering the length of the key. A lower affinity of key for cage (higher $K_{CK}$) requires that more key must be added for activation to occur. Biolayer interferometry experiments in which different length keys were titrated against fixed concentrations of Bcl2 and BimSwitch demonstrate that the LOCKR system can be tuned in this manner to achieve a wide dynamic range of key-induced activation (FIG. 11, panel d). With Bcl2 present on the sensor tip, and BimSwitch at 250 nM, no binding to the sensor was observed in the absence of key. As keys of different length were titrated into the solution (key concentration on x axis), BimSwitch activated and bound to Bcl2 on the sensor (binding signal on y axis). The concentration at which activation occurred differs dramatically for the different length keys: a 40 residue key provided no activation (pale green), a 45 residue key activated with an $EC_{50}$ of 230+/−58 nM (green), and the full length 58 residue key activated with an $EC_{50}$ of 27.0+/−2.8 nM (dark green, FIG. 11, panels c and d). As expected from the model in FIG. 10, panel a, the equilibria involved in activation are indeed sensitive to small changes in binding free energy (FIG. 11, panel d).

To examine the function of BimLOCKR over a range of $K_{LT}$, key induced binding to the Bcl2 homologs BclB and Bak, which bind Bim with Kds of 0.17 nM (Bcl2), 20 nM (BclB), and 500 nM was studied. Bio-layer interferometry experiments were performed with different Bcl2 homologs immobilized on the tip, and BimLOCKR with and without key in solution. Consistent with the FIG. 10, panel a, model, activation of BclB binding requires higher key concentrations than activation of Bcl2 binding while Bak does not activate in this range of key concentrations. The formal symmetry of the FIG. 10, panel a, model with regard to key and target is observed experimentally: when the key is immobilized on the tip, binding of the switch to the tip is activated by addition of target just as binding of the switch to target is activated by addition of key (FIG. 19).

To enable independent caging and specific unlocking of different protein functions in the same compartment, orthogonal switch-key pairs were created by incorporating different hydrogen bond networks at the cage-latch/key interface. Alternative backbone conformations for the latch/key helix were generated by parametrically sampling the distance from the center of the bundle, helical phase, and z-offset relative to the 5 helix cage. New hydrogen bond networks were designed using HBNet (Boyken, et al. Science 352, 680-687 (2016)) to span the interface between the new sixth helix and the 5 helix cage with all buried polar atoms participating in hydrogen bonds; the remaining interface around the networks was subjected to full sequence and sidechain rotamer optimization using Rosetta design (Leaver-Fay et al. Chapter nineteen—Rosetta3: An Object-Oriented Software Suite for the Simulation and Design of Macromolecules. in Methods in Enzymology (eds. Johnson, M. L. & Brand, L.) 487, 545-574 (Academic Press, 2011)). Five well-packed and sequence-dissimilar designs with all buried polar atoms participating in hydrogen bonds (FIG.

Figure 21:
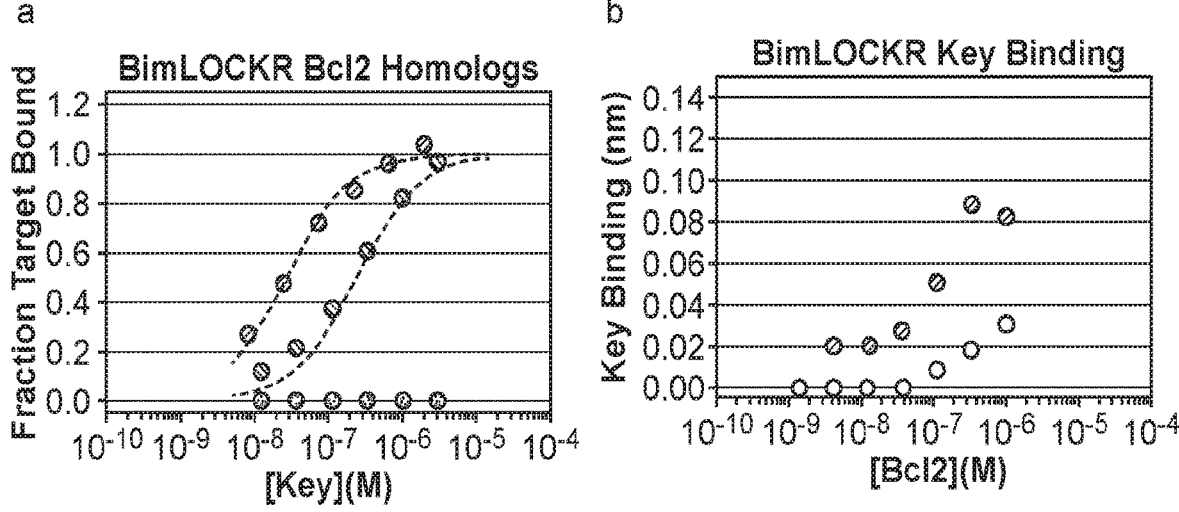
FIG. 21 provides validation of the model in depicted in FIG. 10. a) BLI measurement of BimLOCKR$_a$ (400 nM) binding to Bcl2 (gold), BclB (yellow), and Bak (lighter yellow-BimLOCKR at 1 µM) as key is added to solution. Normalized due to differences in $R_{max}$ for Bcl2 and BclB on the tip. b) BLI measurement of BimLOCKR$_a$ binding to key$_a$ immobilized on the tip. Open circles are with no Bcl2 present, gold points are with Bcl2 present at 500 nM.

20, FIG. 21) were selected for Bim switch assays. Bim-LOCKR$_b$ and BimLOCKR$_c$ show 22-fold and 8-fold activation with their cognate keys and a nine residue toehold on the latch (FIG. 12, panels a and b). The three LOCKR systems are orthogonal: each switch is activated only by its cognate key at concentrations up to 5 μM (FIG. 12, panel c), illustrating the power and consistency of the buried hydrogen bond network approach to achieving specificity.

LOCKR Inducible Protein Degradation

Figure 13:
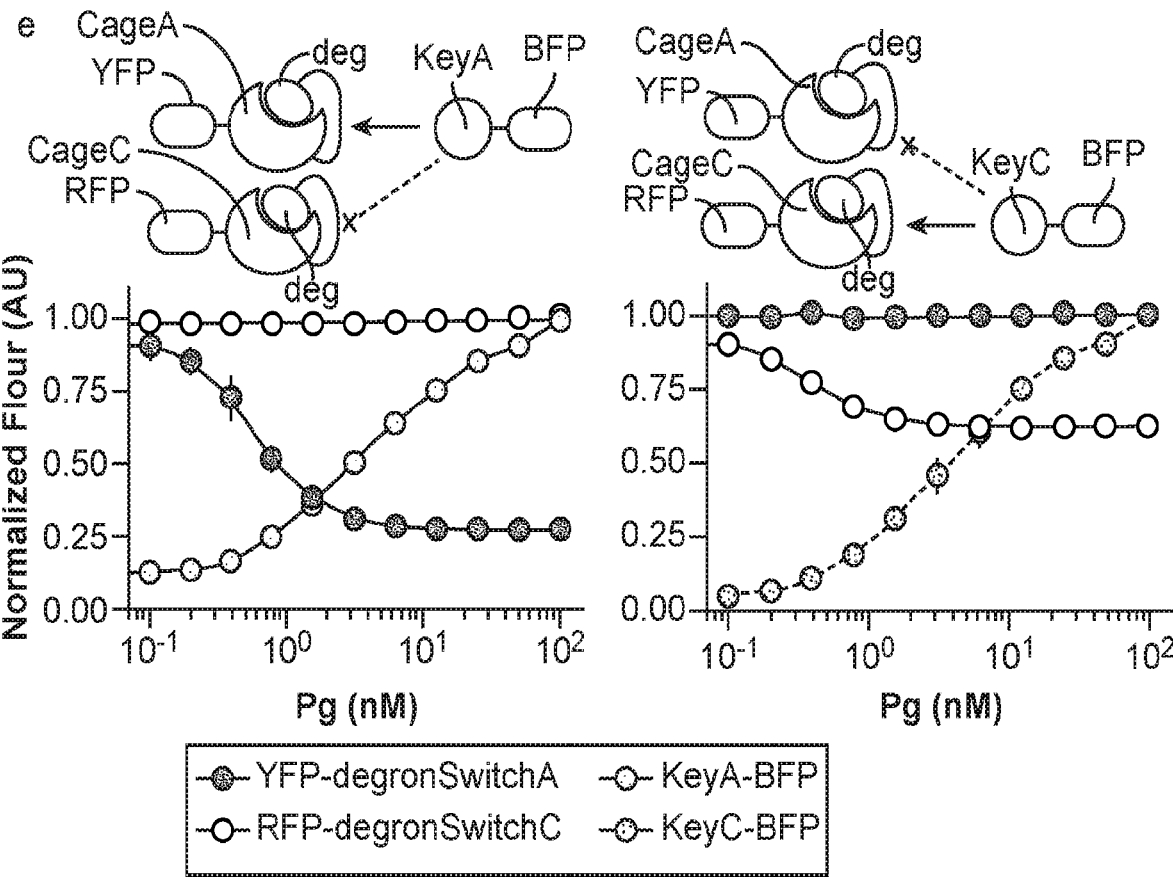
FIG. 13 depicts aspects related to design and in vivo testing of degronLOCKR. a, Schematic of dual inducible system used in *S. cerevisiae* to test functionality of degron-LOCKR. Progesterone (Pg) induces production of Key-BFP, and estradiol (E2) induces production of YFP-degron-Switch. b, Heatmaps of YFP fluorescence as a function of E2 (0-50 nM) and Pg (0-100 nM) for full length key (left) and a key that was truncated by 12 residues (right) as measured by flow cytometry. c, Line plot comparing the fluorescence of the YFP-degronSwitch$_a$ and Key$_a$-BFP at a max dose of E2 (black rectangle in (b) as a function of Pg induction. Fluorescence values were normalized to the maximum YFP or BFP fluorescence. Error bars represent s.d. of three biological replicates. d, Dynamic measurements of active degLOCKR using an automated flow cytometry platform. E2 was induced to activate expression of YFP-degronSwitch$_a$, and Pg was induced at $t_{4\ hrs}$ to activate expression of Key$_a$-BFP. Measurements were taken every 24 minutes. e, Coexpression of orthogonal LOCKRs in the same cell. YFP-degronSwitch$_a$ and RFP-degronSwitch$_c$ were expressed using constitutive promoters and either Key$_a$-BFP (left) or Key$_c$-BFP (right) were expressed using the pZ3 inducible promoter. Normalized fluorescence of YFP-degronSwitch$_a$, RFP-degronSwitch$_c$ and either Key$_a$-BFP or Key$_c$-BFP are plotted as a function of Pg induction. Error bars represent s.d. of biological replicates. f, Asymmetric RFP-degronSwitch$_a$ was expressed in HEK293T cells with and without Key. Flow cytometry distribution of RFP fluorescence for a representative sample indicates decreased RFP expression in the presence of Key. Geometric mean of RFP expression is quantified in the bar plot. Data in all panels represent mean±s.d. of three biological replicates.
Figure 22:
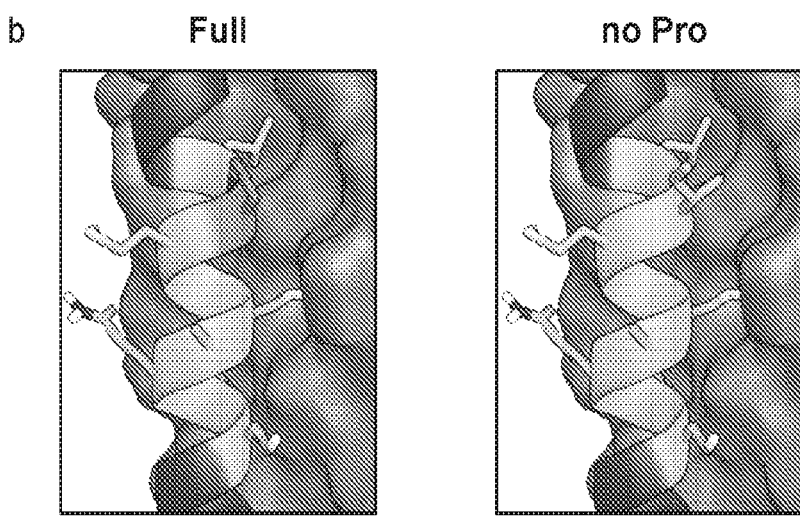
FIG. 22 demonstrates examples of caging cODC sequences. From top to bottom SEQ ID NOS. 28219-28220. a) Three variations of the cODC degron to cage. Variations meant to tune $K_{open}$ by removing the destabilizing proline (noPro) and minimizing mutations to the latch (CA only). b) Predicted models of the full and noPro cODC sequences (orange) threaded onto the latch (dark blue). Thread position chosen such that the cysteine residue needed for degradation is sequestered against the cage (light blue). Proline highlighted in red in the full cODC mutated to an isoleucine in the noPro variant.
Figure 23:
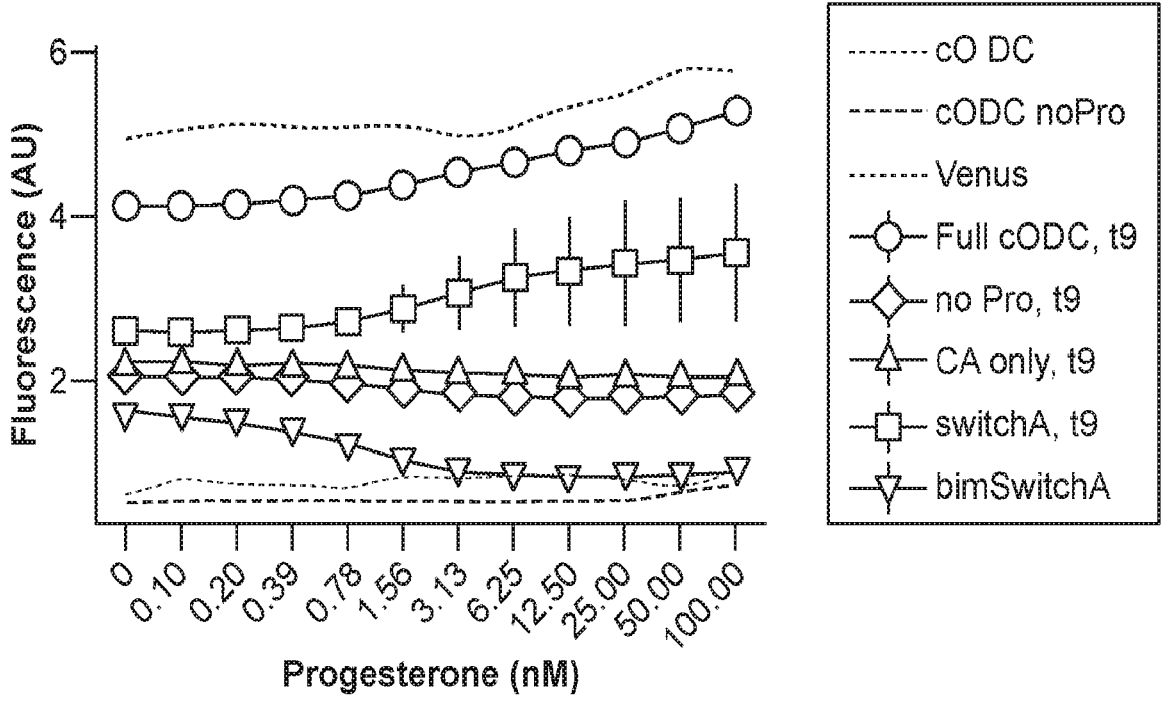
FIG. 23 compares the stability of YFP fused to cODC variants caged in $Switch_a$ to an empty $Switch_a$ and to $bimSwitch_a$.
Figures 24, 25:
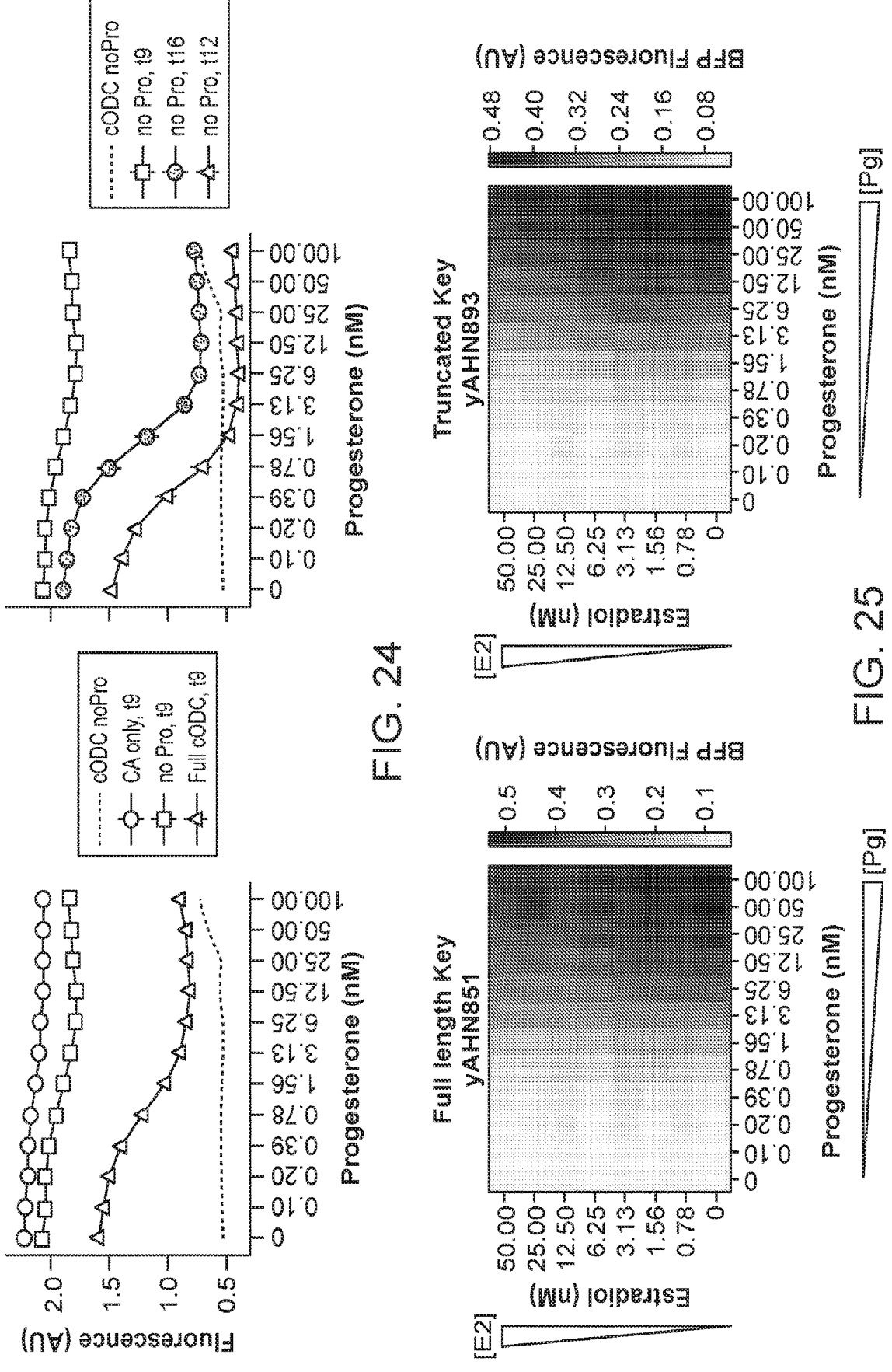
FIG. 24 provides an example of tuning toehold lengths of $degronLOCKR_a$.
FIG. 25 provides BFP expression corresponding to FIG. 13, panel b.

The functionality of LOCKR in vivo was assessed by caging the cODC degron, a ubiquitin-independent degradation signal from the C-terminus of murine ornithine decarboxylase (Takeuchi et al. Biochem. J 410, 401-407 (2008)). The system was configured such that degradation of the switch, and any protein fused to it, would be inducible by key. The caging strategy employed for Bim was used to embed three variants of cODC into Switch$_a$: the wild-type sequence, wild-type with a proline removed (since proline destabilizes alpha helices), and the dipeptide sequence CA, believed to be the minimal functional residues of the degron (FIG. 22). Each switch variant was tested in budding yeast *S. cerevisiae*, using a dual inducible system (Aranda-Diaz et al. ACS Synth. Biol. 6, 545-554 (2017)) to independently titrate the concentration the switch with a yellow fluorescent protein (YFP) N-terminal fusion and the key with a blue fluorescent protein (BFP) C-terminal fusion (FIG. 13, panel a). To assess the dynamic range of switch activation different amounts of key were titrated in using a range of progesterone (Pg) concentrations at a fixed amount of YFP-degron-Switch$_a$ (at a single concentration of estradiol (E2)) and steady-state fluorescence was measured using flow cytometry. Key induced degradation observed for these initial constructs was dependent on the presence of the cODC degron in the switch, and was not observed when YFP was fused to either BimSwitch$_a$ or Switch$_a$ (FIG. 23). The amount of inducible degradation was optimized by varying the switch toehold length to tune $K_{open}$. The switch with the largest dynamic range was the proline-removed cODC and a 12-residue toehold (herein referred to as degronSwitch$_a$). Using this variant, YFP fluorescence fused to degronSwitch$_a$ was reduced up to 73% upon full induction of key$_a$ (FIG. 24).

The dynamic range of degronLOCKR$_a$ was explored at different concentrations of YFP-degronSwitch$_a$ and key$_a$-BFP for two different key lengths (FIG. 13, panel b) by testing the full range of E2 and Pg combinations. The extent of key$_a$-induced degradation of degronSwitch$_a$ varied as a function of the concentration of both proteins. Key$_a$ fluorescence was stable as a function of degronSwitch$_a$ concentration (FIG. 25), suggesting the key is not co-degraded with the degronSwitch. With a truncated key$_a$ (43 residues versus 55 residues), the same dynamic range of switch activation was observed, but a higher key concentration was required for the same amount of switch activation (FIG. 13, panel c). This is similar to the behavior observed with BimLOCKR (FIG. 11, panel d), and shows our model of cage/key interaction holds true within living cells. To assess the dynamics of degronLOCKR$_a$ activation, an automated flow cytometry platform was used to measure YFP fluorescence as a function of time. Cells were grown at a constant concentration of E2 until YFP-degronSwitch$_a$ reached steady-state and then induced with Pg to activate production of key$_a$-BFP. It was found that the in vivo half-life for active degronLOCKR$_a$ is 24 minutes, which is very similar to the reported half life of 11-30 minutes for the constitutive cODC degron.

To enhance the functionality of degronLOCKR to trigger orthogonal degradation of different proteins in the same cell was enhanced by installing the proline removed cODC degron in $LOCKR_b$, $LOCKR_c$, and $LOCKR_d$. Each orthogonal switch variant was constitutively expressed fused to YFP (FIG. 26) and the degradation of YFP was measured with constitutive expression of each key variant fused to cyan fluorescent protein (CFP). DegronLOCKR$_a$ and degron-LOCKR$_c$ were strongly activated by their cognate keys, but not by each other's key (other constructs did not activate in vivo; FIG. 27). The orthogonality of the degronLOCKRs was tested by constitutively co-expressing degronLOCKR$_a$ and degronLOCKR$_c$ in the same cell fused to YFP and red fluorescent protein (RFP), respectively, and the Pg inducible system was used to titrate expression of each key variant in separate strains. Expression of key$_a$ led to selective degradation of YFP but not RFP, and expression of key$_c$ led to selective degradation of RFP but not YFP (FIG. 13, panel d). This demonstrates that the dual degronLOCKR system can function orthogonally and simultaneously in living cells.

To evaluate degronLOCKR function in mammalian cells, degronSwitch$_a$ fused to mCherry RFP was expressed in human HEK293T cells, and RFP fluorescence was measured in the presence and absence of Key. A redesigned asymmetric degronSwitch$_a$ with an 8-residue toehold (see FIG. 43) triggered a 11-fold reduction in mean RFP fluorescence in the presence of Key (FIG. 13, panel f). These data demonstrate the functionality of the degronLOCKR system in mammalian cells.

degronLOCKR Control of Gene Expression In Vivo

Figure 14:
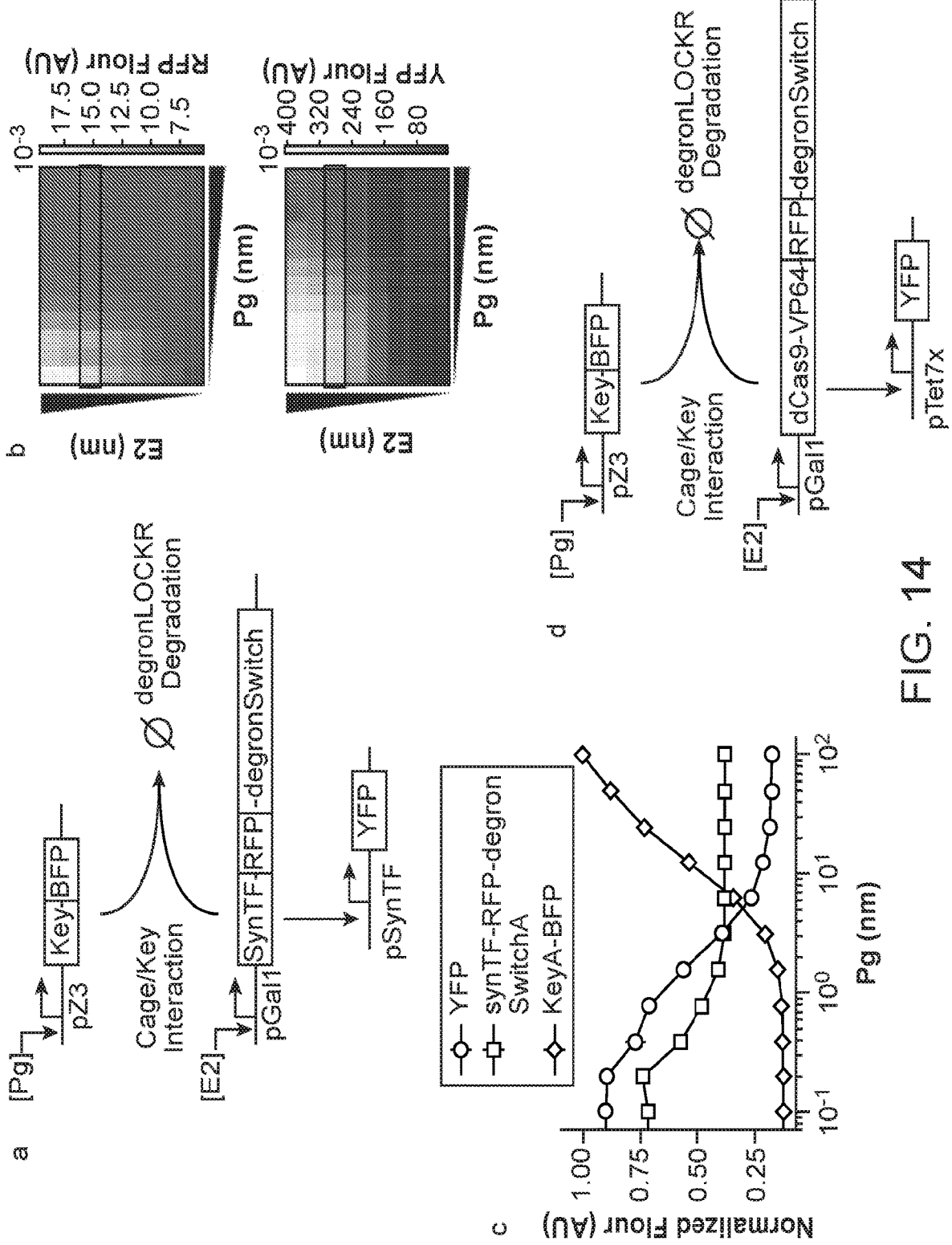
FIG. 14 demonstrates control of gene expression using degronLOCKR. a, Schematic of dual induction assay to determine the effect of degronLOCKR$_a$ on a synthetic transcription factor (SynTF). Pg induces expression of Key$_a$-BFP, and E2 induces expression of SynTF-RFP-degronSwitch$_a$ fusion. The pSynTF promoter is activated by SynTF and expresses YFP. b, Heatmaps of YFP and RFP fluorescence as a function of E2 (0-125 nM) and Pg (0-100 nM) measured by flow cytometry. c, Line plot comparing the fluorescence of YFP, SynTF-RFP-degronSwitch$_a$ and Key$_a$-BFP at 31.25 nM E2 (black rectangle in 5b) as a function of Pg induction. Fluorescence values were normalized to the maximum YFP, RFP, or BFP fluorescence. Error bars represent s.d. Of three biological replicates. d, Schematic of dual induction assay to determine the effect of degronLOCKR$_a$ on a dCas9-VP64 targeted to the pTet7x promoter via a constitutively expressed sgRNA (not shown). Pg induces expression of Key$_a$-BFP, and E2 induces expression of dCas9-VP64-RFP-degronSwitch$_a$ fusion. The pTet7x promoter is activated by dCas9-VP64 and expresses YFP. e, Heatmaps of YFP and RFP fluorescence as a function of E2 (0-125 nM) and Pg (0-100 nM) measured by flow cytometry. f. Line plot comparing the fluorescence of YFP, dCas9-VP64-RFP-degron-Switch$_a$ and Key$_a$-BFP at 31.25 nM E2 (black rectangle in 5d) as a function of Pg induction. Fluorescence values were normalized to the maximum YFP, RFP, or BFP fluorescence. Error bars represent s.d. of three biological replicates.

To demonstrate the utility of degronLOCKR, it was used as a tool to modulate the intracellular concentration of a synthetic transcription factor and dCas9. A zinc-finger based synthetic transcription factor (SynTF) (Khalil, et al. Cell 150, 647-658 (2012)) was fused to both RFP and degron-Switch$_a$ under the control of the E2 inducible promoter, and key$_a$-BFP-NLS under the control of the Pg inducible promoter. To monitor SynTF activity, measured pSynTF-YFP fluorescence was measured in the same cell (FIG. 14, panel a). An increase in expression of SynTF-RFP-degronSwitch$_a$ increased both RFP and YFP fluorescence, while an increase in key expression decreased both outputs (FIG. 14, panel b). For example, at 31.25 nM E2 (FIG. 14, panel b), maximal key induction caused a 61% reduction of RFP and 82% reduction of YFP (FIG. 14, panel c). Notably, degron-LOCKR caused a graded change in YFP fluorescence as a function of key concentration, which contrasts with the more digital behavior of transcription factors typically used in synthetic biology applications. To further establish degron-LOCKR as a general method of transcriptional control, degradation of an activating dCas9-VP64 fusion (Perez-Pinera, et al. Nat. Methods 10, 973-976 (2013)) was next tested. dCas9 was targeted to the tet operator site of the pTet7x with a constitutively expressed sgRNA to induce expression of YFP (FIG. 14, panel d), and key expression was titrated at different concentrations of dCas9 (FIG. 14, panel e). A 78% reduction of RFP and 41% reduction of YFP were observed upon induction of key at 31.25 nM E2 (FIG. 14, panel f). Together, these results demonstrate the modularity and functionality of degronLOCKR as a tool to control the stability of proteins in vivo.

The LOCKR system has several advantages. First, LOCKR is a universal platform to cage and then activate at will functionalities ranging from inducible activation of high-affinity protein-protein interactions to controlled degradation to localization of an attached cargo. Second, for any functional modality, many cargos can be regulated: For example, here it is shown how a transcription factor and hence gene expression can be efficiently modulated by LOCKR gated degradation, but other cargoes including kinases and other enzymes can also be controlled in the same way. In addition, altering the affinities of LOCKR components is tunable based on simple design principles that are general irrespective of the functional modality or application.

Supplementary Methods

PCR Mutagenesis and Isothermal Assembly

All primers for mutagenesis were ordered from Integrated DNA Technologies (IDT). Mutagenic primers were designed to anneal >18 bp on either side of the site for mutagenesis with the desired mutation encoded in the primer. PCR was used to create fragments upstream and downstream of the mutation site with >20 bp overlap with the desired pET vector. The resulting amplicons were isothermally assembled into either pET21b, pET28b, or pET29b restriction digested with XhoI and NdeI and transformed into chemically competent E. coli XL1-Blue cells. Monoclonal colonies were sequenced with Sanger sequencing. Sequence verified plasmid was purified using Qiagen miniprep kit and transformed into chemically competent E. coli BL21(DE3)Star, BL21(DE3)Star-pLysS cells (Invitrogen), or Lemo21 (DE3) cells (NEB) for protein expression.

Synthetic Gene Construction

Synthetic genes were ordered from Genscript Inc. (Piscataway, NJ, USA) and delivered in pET 28b+, pET21b+, or pET29b+E. coli expression vectors, inserted at the NdeI and XhoI sites of each vector. For pET28b+ constructs, synthesized DNA was cloned in frame with the N-terminal hexahistidine tag and thrombin cleavage site and a stop codon was added at the C-terminus. For pET21b+ constructs, a stop codon was added at the C-terminus such that the protein was expressed with no hexahistidine tag. For pET29b+ constructs, the synthesized DNA was cloned in frame with the C-terminal hexahistidine tag. Plasmids were transformed into chemically competent E. coli BL21(DE3)Star, BL21 (DE3)Star-pLysS cells (Invitrogen), or Lemo21(DE3) cells (NEB) for protein expression.

Bacterial Protein Expression and Purification

Starter cultures were grown in Lysogeny Broth (LB) or Terrific Broth II (TBII) overnight in the presence of 50 μg/mL carbenicillin (pET21b+) or 30 μg/mL (for LB) to 60 μg/mL (for TBII) kanamycin (pET28b+ and pET29b+). Starter cultures were used to inoculate 500 mL of Studier TBM-5052 autoinduction media containing antibiotic and grown at 37° C. for 24 hours. Cells were harvested by centrifugation at 4000 rcf for 20 minutes at 4° C. and resuspended in lysis buffer (20 mM Tris, 300 mM NaCl, 20 mM Imidazole, pH 8.0 at room temperature), then lysed by microfluidization in the presence of 1 mM PMSF. Lysates were cleared by centrifugation at 24,000 rcf for at least 30 minutes at 4° C. Supernatant was applied to Ni-NTA (Qiagen) columns pre-equilibrated in lysis buffer. The column was washed twice with 15 column volumes (CV) of wash buffer (20 mM Tris, 300 mM NaCl, 40 mM Imidazole, pH 8.0 at room temperature), followed by 15 CV of high-salt wash buffer (20 mM Tris, 1 M NaCl, 40 mM Imidazole, pH 8.0 at room temperature) then 15 CV of wash buffer. Protein was eluted with 20 mM Tris, 300 mM NaCl, 250 mM Imidazole, pH 8.0 at room temperature. Proteins were further purified by gel filtration using FPLC and a Superdex™ 75 Increase 10/300 GL (GE) size exclusion column, pooling fractions containing monomeric protein.

Size-Exclusion Chromatography, Multi-Angle Light Scattering (SEC-MALS)

SEC-MALS experiments used a Superdex™ 75 Increase 10/300 GL (GE) size exclusion column connected to a miniDAWN TREOS multi-angle static light scattering and an Optilab T-rEX (refractometer with EXtended range) detector (Wyatt Technology Corporation, Santa Barbara CA, USA). Protein samples were injected at concentrations of 3-5 mg/mL in TBS (pH 8.0). Data was analyzed using ASTRA™ (Wyatt Technologies) software to estimate the weight average molar mass (Mw) of eluted species, as well as the number average molar mass (Mn) to assess monodispersity by polydispersity index (PDI)=Mw/Mn.

Circular Dichroism (CD) Measurements

CD wavelength scans (260 to 195 nm) and temperature melts (25 to 95° C.) were measured using an AVIV model 420 CD spectrometer. Temperature melts monitored absorption signal at 222 nm and were carried out at a heating rate of 4° C./min. Protein samples were at 0.3 mg/mL in PBS pH 7.4 in a 0.1 cm cuvette. Guanidinium chloride (GdmCl) titrations were performed on the same spectrometer with an automated titration apparatus in PBS pH 7.4 at 25° C., monitored at 222 nm with protein sample at 0.03 mg/mL in a 1 cm cuvette with stir bar. Each titration consisted of at least 40 evenly distributed concentration points with one minute mixing time for each step. Titrant solution consisted of the same concentration of protein in PBS+GdmCl. GdmCl concentration was determined by refractive index.

Small Angle X-Ray Scattering (SAXS)

Samples were exchanged into SAXS buffer (20 mM Tris, 150 mM NaCl, 2% glycerol, pH 8.0 at room temperature) via gel filtration. Scattering measurements were performed at the SIBYLS 12.3.1 beamline at the Advanced Light Source. The X-ray wavelength ($\lambda$) was 1.27 Å and the sample-to-detector distance of the Mar165 detector was 1.5 m, corresponding to a scattering vector q ($q=4\pi*sin(\theta/\lambda)$ where $2\theta$ is the scattering angle) range of 0.01 to 0.59 $Å^{-1}$. Data sets were collected using 34 0.2 second exposures over a period of 7 seconds at 11 keV with protein at a concentration of 6 mg/mL. Data were also collected at a concentration of 3 mg/mL to determine concentration-dependence; all presented data was collected at the higher concentration as no concentration-dependent aggregation was observed. Data from 32 exposures was averaged separately over the Gunier, Parod, and Wide-q regions depending on signal quality over each region and frame. The averages were analyzed using the ScAtter software package to analyze data and report statistics. FoXS was used to compare design models to experimental scattering profiles and calculate quality of fit (X) values. The hexahistidine tags and thrombin cleavage sites on the N-termini of LOCKR proteins were modeled using Rosetta Remodel so that the design sequence matched that of the experimentally tested protein. To capture conformational flexibility of these residues, 100 independent models were generated, clustered, and the cluster center of the largest cluster was selected as a representative model for FoXS fitting without bias.

GFP Pulldown Assay

His-tagged LOCKR was expressed per the above protocol from pET28b+ while the key was expressed fused to super-folder GFP (sfGFP) without a his-tag in pET21b+. The his-tagged LOCKR was purified to completion and dialyized into TBS (20 mM Tris, 150 mM NaCl, pH 8.0 at room temperature); the key-GFP remained as lysate for this assay. 100 μL LOCKR at >1 μM was applied to a 96-well black Pierce® Nickel Coated Plate (ThermoFisher) and incubated at room temperature for 1 hour. Sample was discarded from the plate and washed 3× with 200 μL TBST (TBS+0.05% Tween-20). 100 μL of lysate containing key-GFP was added to each well and incubated at room temperature for 1 hour. Sample was discarded from the plate and washed 3× with 200 μL TBST (TBS+0.05% Tween-20). The plate was washed 1× with TBS, and 100 μL of TBS was added to each well. sfGFP fluorescence was measured on a Molecular Devices SpectraMax M5 plate reader or BioTek Synergy Neo2 plate reader; fluorescence was measured at 485 nm excitation and 530 nm emission, with a bandwidth of 20 nm for excitation and emission.

Bio-Layer Interferometry (BLI)

BLI measurements were made on an Octet® RED96 System (ForteBio) with streptavidin (SA) coated biosensors and all analysis was performed within ForteBio Data Analysis Software version 9.0.0.10. Assays were performed with protein diluted into HBS-EP+ Buffer from GE (10 mM HEPES, 150 mM NaCl, 3 mM EDTA, 0.05% v/v Surfactant P20, 0.5% non-fat dry milk, pH 7.4 at room temperature). Biotinylated Bcl2 was loaded onto the SA tips to a threshold of 0.5 nm programmed into the machine's protocol. Baseline was obtained by dipping the loaded biosensors into HBS-EP+ buffer; association kinetics were observed by dipping into wells containing defined concentrations of LOCKR and key, then dissociation kinetics were observed by dipping into the buffer used to obtain the baseline. Kinetic constants and response at equilibrium were computed by fitting a 1:1 binding model.

Construction of DNA Circuits

Hierarchical golden gate assembly was used to assemble plasmids for yeast strain construction using the method in Lee et al. (ACS Synth. Biol. 4, 975-986 (2015)). Individual parts had their BsaI, BsmBI, and NotI cut sites removed to facilitate downstream assembly and linearization. Parts were either generated via PCR or purchased as gBlocks from IDT. These parts were assembled into transcriptional units (promoter-gene-terminator) on cassette plasmids. These cassettes were then assembled together to form multi-gene plasmids for insertion into the yeast genome.

Yeast Strains and Growth Media

The base S. cerevisiae strain used in all experiments was BY4741 (MATa his3Δ1 leu2Δ0 met15Δ0 ura3Δ0). All yeast cultures were grown in YPD media (10 g/L Bacto Yeast Extract, 20 g/L Bacto peptone, 20 g/L dextrose) or synthetic complete medium (SDC) (6.7 g/L Bacto-yeast nitrogen base without amino acids, 2 g/L complete supplement amino acid mix, 20 g/L dextrose). Selection of auxotrophic markers (URA3, LEU2, and/or HIS3) was performed on synthetic complete medium with the appropriate dropout amino acid mix.

Estradiol and Progesterone Induction

Yeast strains were grown overnight by picking a single colony from a plate into YPD media. Saturated culture was diluted 1:500 in fresh SDC and aliquoted into individual wells of a 2 mL 96 well storage block (Corning) for a three hour outgrowth at 30° C. and 900 RPM in a Multitron shaker (Infors HT). Estradiol (Sigma-Aldrich) and progesterone (Fisher Scientific) were prepared at a 10× concentration by making the appropriate dilutions into SDC from a 3.6 mM estradiol and 3.2 mM progesterone stock solution. After the three hour outgrowth, 50 μL of estradiol and progesterone inducer were added to the 96 well block in the appropriate combinations and the block was returned to the shaker.

Mammalian Cell Culture and Lentiviral Transduction

HEK293T cells (from ATCC® CRL-3216™) were maintained in DMEM (Dulbecco's Modified Eagle Medium, Gibco) supplemented with 10% Fetal Calf Serum (SAFC)

and passaged every ~3 days. Pantropic VSV-G pseudotyped lentivirus was produced via transfection of Lenti-X 293T cells (Clontech) with a custom pHR'SIN:CSW transgene expression vector and the viral packaging plasmids pCMVdR8.91 and pMD2.G using Fugene HD (Promega). At 48 hr, viral supernatant was harvested and the HEK293T cells were exposed to the virus for 24 hr. Transductions were performed in triplicate.

HEK293T Experiments

Analysis of fluorescent protein expression was performed using a BD Fortessa flow cytometer (BD Biosciences) equipped with a high-throughput sampler. Cells were harvested and washed twice in PBS before running through the instrument in PBS+5% FBS. RFP (mCherry) fluorescence was measured using the PE-CF594 channel and BFP (tagBFP) was measured using the BV 421 channel. 50,000 events were collected per sample. Live cells were gated according to FSC-A and SSC-A, and singlets were gated according to SSC-A and SSC-H. Analysis of HEK293T flow cytometry data was performed using FlowJo v10.

Description of Automated Flow Cytometry and Continuous Culture System

Hardware

We adapted an existing automated experimental platform (Harrigan et al. bioRxiv 244020 (2018). doi:10.1101/244020) to perform variable concentration small molecule induction and long-term culturing. Yeast cultures were grown in 50 mL optically clear conical tubes (Falcon) that were held in eight custom temperature-controlled, magnetically stirred chambers. Liquid handling was accomplished using a 14 position stream selector (VICI Cheminert) and two syringe pumps (Cavro XCalibur Pump, TECAN) of a BD High-Throughput Sampler. Commands to the HTS were controlled using LABVIEW 2013. This setup allowed for periodic sampling and dilution of individual cultures. Each sampling period consisted of three main steps: 1) send sample to flow cytometer for measurement, 2) extract culture and send to waste, and 3) replenish culture with fresh media at desired hormone concentration. Each sampling period can be designated to either induce cultures to a new higher hormone concentration or to maintain desired hormone concentration. A sampling frequency of 24 minutes and a dilution volume of 3 mL were used.

Yeast Culture

Yeast strains were grown overnight by picking a single colony from a plate into YPD media. Saturated culture was diluted 1:200 into fresh SDC. Cultures were grown for 2 hours in glass tubes at 30 C and 250 RPM in a Innova 44 shaker (New Brunswick). Cultures were then diluted to 0.01 OD600 in fresh SDC and aliquoted into individual 50 mL optically clear conical tubes (Falcon) at a total volume of 30 mL YPD. Another one hour outgrowth was performed in bioreactors with magnetically-controlled stir bars at 30 C. All SDC media was supplemented with 5,000 U/mL Penicillin Streptomycin (Thermo-Fisher).

Estradiol and Progesterone Induction to Test degronLOCKR Dynamics

A 1× concentration was determined by the highest desired hormone concentration at which to test strains (30 nM E2 and 50 nM Pg, respectively). A solution of E2 and SDC media was created at a 10× concentration to bring pre-induced cultures to a desired concentration in one sampling period. A second solution of Pg and SDC media was created at a 10× concentration to induce key expression after degSwitch-YFP expression reached steady-state. SDC media was prepared at three different concentrations of hormone: (1) 10× E2/no Pg, (2) 1× E2/no Pg, (3) 1× E2/10× Pg, and (4) 1× E2/1× Pg. After a one hour outgrowth in bioreactors (t=−6 hr), the first induction was performed to achieve E2 concentration by extracting 3 mL from all cultures and replenishing with (1). After E2 induction, sampling proceeded as described above (see Hardware). All sampling periods following the first induction time point included sending a sample to the cytometer for measurement, extracting 3 mL from all cultures, and replenishing cultures with (2). During the second induction time point (t=0 hr), cultures were induced with (3) to activate key expression. This induction was followed by the same procedure as the first induction, except that hormone concentrations were maintained by (4). Controls (no activated key expression) did not undergo a second induction and, instead, continued to be replenished by (2).

Flow Cytometry

Analysis of fluorescent protein expression was performed using a BD LSRII flow cytometer (BD Biosciences) equipped with a high-throughput sampler. Cultures were diluted in TE before running through the instrument to obtain an acceptable density of cells. YFP (Venus) fluorescence was measured using the FITC channel, RFP (mScarlet) was measured using the PE-Texas Red channel, and BFP (mTagBFP2) was measured using the DAPI channel. For steady-state measurements, 5,000-10,000 events were collected per sample. For dynamic measurements, 2,000-10,000 events were collected per sample. Fluorescence values were calculated as the height (H) measurement for the appropriate channel and normalized to cell size by dividing by side scatter (SSC-H). All analysis of flow cytometry data was performed in Python 2.7 using the package FlowCytometryTools and custom scripts.

Fluorescence Microscopy

Saturated culture was diluted 1:100 in fresh SC media followed by a 3 hour outgrowth at 30° C. with shaking at 700 RPM in a Multitron shaker (Infors HT). Estradiol (Sigma-Aldrich) and progesterone (Fisher Scientific) were prepared at a 20× concentration by making the appropriate dilutions into SC media from a 3.6 mM estradiol and 3.2 mM progesterone stock solution. Cells were induced with estradiol and/or progesterone at a final concentration of [200 µM] and [250 µM] respectively. After 8 hours of growth, cells were resuspended in 1×PBS and imaged on a Zeiss Axio Observer Z1 microscope with X-Cite Series 120 fluorescent lamp and Hamamatsu Orca-Flash 4.0 Digital Camera.

Structural Visualization and Figures

All structural images for figures were generated using PyMOL.

Code Availability

Python scripts, bash scripts, and Rosetta XMLs are available for download at https(colon)//github(dot)com/Bobby-Langan/DeNovoDesignofBioactiveProteinS witches.

Functional Peptides Designed into LOCKR

```
aBcl2-Designed Bcl2 Binder:
                              (SEQ ID NO: 58)
M-QEL-DK-RAASLQ-NGD-FYA-LR-L pBim:
                              (SEQ ID NO: 59)
I---LR-IGD-F---Y Bim:
                              (SEQ ID NO: 60)
EIWIAOELRRIGDEFNAYYA cODC:
                              (SEQ ID NO: 61)
LPMSCAQES cODC_noPro:
                              (SEQ ID NO: 62)
L-MSCAQES cODC_CA_only:
CA
```

Amino Acid Sequences of Designed Key and LOCKR
Proteins:

Key_a:

(SEQ ID NO: 46)

EARKAIARVKRESKRIVEDAERLIREAAAASEKISREAERLIREAAAASEKISRE

Key_b:

(SEQ ID NO: 47)

NKEEIEKLAKEAREKLKKAEKEHKEIHDKLRKKNKKAREDLKKKADELRETNKR

VN

Key_c:

(SEQ ID NO: 48)

SSEKVRRELKESLKENHKQNQKLLKDHKRAQEKLNRELEELKKKHKKTLDDIRR

ES

Key_d:

(SEQ ID NO: 49)

DTVKRILEELRRRFEKLAKDLDDIARKLLEDHKKHNKELKDKQRKIKKEADDAA

RS

>degronLOCKR_a_327

(SEQ ID NO: 1)

SKEAVTKLQALNIKLAEKLLEAVTKLQALNIKLAEKLLEALARLQELNIALVYLAVELT

DPKRIADEIKKVKDKSKEIVERAEEEIARAAAESKKILDEAEEEIARAAAESKKILDEGSG

SGSDAVAELQALNLKLAELLLEAVAELQALNLKLAELLLEAIAKLQELNIKLVELLTKL

TDPATIREAIRKVKEDSERIVAEAERLIAAAKAESERIIREAERLIAAAKAESERIIREGSG

SGDPDVARLQELNIELARELLRDVARLQELNIELARELLRAAAELQELNIKLVELASELT

DPDEARKAIARVKRESKRIVEDAERLPMSCAQESEKISREAERLIREAA

>degronLOCKR_a_327_noPro (SEQ ID NO: 2)

SKEAVTKLQALNIKLAEKLLEAVTKLQALNIKLAEKLLEALARLQELNIALVYLAVELT

DPKRIADEIKKVKDKSKEIVERAEEEIARAAAESKKILDEAEEEIARAAAESKKILDEGSG

SGSDAVAELQALNLKLAELLLEAVAELQALNLKLAELLLEAIAKLQELNIKLVELLTKL

TDPATIREAIRKVKEDSERIVAEAERLIAAAKAESERIIREAERLIAAAKAESERIIREGSG

SGDPDVARLQELNIELARELLRDVARLQELNIELARELLRAAAELQELNIKLVELASELT

DPDEARKAIARVKRESKRIVEDAERLAMSCAQESEKISREAERLIREAA

>degronLOCKR_a_CAonly (SEQ ID NO: 3)

SKEAVTKLQALNIKLAEKLLEAVTKLQALNIKLAEKLLEALARLQELNIALVYLAVELT

DPKRIADEIKKVKDKSKEIVERAEEEIARAAAESKKILDEAEEEIARAAAESKKILDEGSG

SGSDAVAELQALNLKLAELLLEAVAELQALNLKLAELLLEAIAKLQELNIKLVELLTKL

TDPATIREAIRKVKEDSERIVAEAERLIAAAKAESERIIREAERLIAAAKAESERIIREGSG

SGDPDVARLQELNIELARELLRDVARLQELNIELARELLRAAAELQELNIKLVELASELT

DPDEARKAIARVKRESKRIVEDAERURECAAASEKISREAERLIREAA

>degronLOCKR_a_324_t12

(SEQ 1D NO: 4)

SKEAVTKLQALNIKLAEKLLEAVTKLQALNIKLAEKLLEALARLQELNIALVYLAVELT

DPKRIADEIKKVKDKSKEIVERAEEEIARAAAESKKILDEAEEEIARAAAESKKILDEGSG

SGSDAVAELQALNLKLAELLLEAVAELQALNLKLAELLLEAIAKLQELNIKLVELLTKL

TDPATIREAIRKVKEDSERIVAEAERLIAAAKAESERIIREAERLIAAAKAESERIIREGSG

SGDPDVARLQELNIELARELLRDVARLQELNIELARELLRAAAELQELNIKLVELASELT

DPDEARKAIARVKRESKRIVEDLIMSCAQESAASEKISREAERLIR

-continued

>degronLOCKR_a_320_t16
                                                    (SEQ ID NO: 5)
SKEAVTKLQALNIKLAEKLLEAVTKLQALNIKLAEKLLEALARLQELNIALVYLAVELT

DPKRIADEIKKVKDKSKEIVERAEEEIARAAAESKKILDEAEEEIARAAAESKKILDEGSG

SGSDAVAELQALNLKLAELLLEAVAELQALNLKLAELLLEAIAKLQELNIKLVELLTKL

TDPATIREAIRKVKEDSERIVAEAERLIAAAKAESERIIREAERLIAAAKAESERIIREGSG

SGDPDVARLQELNIELARELLRDVARLQELNIELARELLRAAAELQELNIKLVELASELT

DPDEARKAIARVKRESKRLVMSCAQESREAAAASEKISREAE

>mini-degronLOCKRa_1_t9 (wherein "mini" refers to a
re-designed scaffold that contains fewer helices but
maintains functionality)
                                                    (SEQ ID NO: 6)
NKEDATEAQKKA1RAAEELLKDVTRIQERAIREAEKALERLARVQEEAIRRVYEAVESK

NKEELKKVKEEIEELLRRLKRELDELEREIRELLKEIKEKADRLEKEIRDLIERIRRDRNA

SDEVVTRLARLNEELIRELREDVRRLAELNKELLRELERAARELARLNEKLLELADRVE

TEEEARKAIARVKRESKRIVEDAERLAMSCAQESEKISREAERLIREAA

>mini-degronLOCKRa_1_t12
                                                    (SEQ ID NO: 7)
NKEDATEAQKKA1RAAEELLKDVTRIQERAIREAEKALERLARVQEEAIRRVYEAVESK

NKEELKKVKEEIEELLRRLKRELDELEREIRELLKEIKEKADRLEKEIRDLIERIRRDRNA

SDEVVTRLARLNEELIRELREDVRRLAELNKELLRELERAARELARLNEKLLELADRVE

TEEEARKAIARVKRESKRIVEDLIMSCAQESAASEKISREAERLIR

>mini-degronLOCKRa_2_t9
                                                    (SEQ ID NO: 8)
DERLKRLNERLADELDKDLERLLRLNEELARELTRAAEELRELNEKLVELAKKLQGGR

SREVAERAEKEREKIRRKLEEIKKEIKEDADRIKKRADELRRRLEKTLEDAARELEKLKR

EPRTEELKRKATELQKEAIRRAEELLKEVTDVQRRAIERAEELLEKLARLQEEAIRTVYL

LVELNKVDRARKAIARVKRESKRIVEDAERLAMSCAQESEKISREAERLIREAA

>mini-degronLOCKRa_t12
                                                    (SEQ ID NO: 9)
DERLKRLNERLADELDKDLERLLRLNEELARELTRAAEELRELNEKLVELAKKLQGGR

SREVAERAEKEREKIRRKLEEIKKEIKEDADRIKKRADELRRRLEKTLEDAARELEKLKR

EPRTEELKRKATELQKENIRRAEELLKEVTDVQRRNIERAEELLEKLARLQEENIRTVYL

LVELNKVDRARKAIARVKRESKRIVEDLIMSCAQESAASEKISREAERLIR

>asym-degronLOCKR_a_mut (wherein "asym" refers to an
asymmetrized scaffold design)
                                                    (SEQ ID NO: 10)
SKEAAKKLQDLNIELARKLLEASTKLQRLNIRLAEALLEAIARLQELNLELVYLAVELT

DPKRIRDEIKEVKDKSKEIIRRAEKEIDDAAKESKKILEEARKAIRDAAEESRKILEEGSG

SGSDALDELQKLNLELAKLLLKAIAETQDLNLRAAKAFLEAAAKLQELNIRAVELLVKL

TDPATIRRALEHAKRRSKEIIDEAERAIRAAKRESERIIEEARRLIEKAKEESERIIREGSGS

GDPDIKKLQDLNIELARELLRAHAQLQRLNLELLRELLRALAQLQELNLDLLRLASELT

DPDEARKAIARVKRESKRIVEDAERLSREAAALSMSCAQESERSIREAAAASEKISRE

>asym-degronLOCKR_a_mut_t6
                                                    (SEQ ID NO: 11)
SKEAAKKLQDLNIELARKLLEASTKLQRLNIRLAEALLEAIARLQELNLELVYLAVELT

DPKRIRDEIKEVKDKSKEIIRRAEKEIDDAAKESKKILEEARKAIRDAAEESRKILEEGSG

SGSDALDELQKLNLELAKLLLKAIAETQDLNLRAAKAFLEAAAKLQELNIRAVELLVKL

TDPATIRRALEHAKRRSKEIIDEAERAIRAAKRESERIIEEARRLIEKAKEESERIIREGSGS

-continued

GDPDIKKLQDLNIELARELLRAHAQLQRLNLELLRELLRALAQLQELNLDLLRLASELT

DPDEARKAIARVKRESKRIVEDAERLSMSCAQESEKISREAERSIREAAAAS

>asym-degronLOCKR_a_short (wherein "short" refers to a
shortened version of the asym scaffold, where all the
helices have been truncated)

(SEQ ID NO: 12)

SELARKLLEASTKLQRLNIRLAEALLEAIARLQELNLELVYLAVELTDPKRIRDEIKEVK

DKSKEIIRRAEKEIDDAAKESEKILEEAREAISGSGSELAKLLLKAIAETQDLNLRAAKAF

LEAAAKLQELNIRAVELLVKLTDPATIREALEHAKRRSKEIIDEAERAIRAAKRESERIIE

EARRLIEKGSGSGSELARELLRAHAQLQRLNLELLRELLRALAQLQELNLDLLRLASEL

TDPDEARKAIARVKRESKRIVEDLEMSCAQESAASEKISREAERLIR

>asym_degronLOCKR_a_short_t5

(SEQ ID NO: 13)

SELARKLLEASTKLQRLNIRLAEALLEAIARLQELNLELVYLAVELTDPKRIRDEIKEVK

DKSKEIIRRAEKEIDDAAKESEKILEEAREAISGSGSELAKLLLKAIAETQDLNLRAAKAF

LEAAAKLQELNIRAVELLVKLTDPATIREALEHAKRRSKEIIDEAERAIRAAKRESERIIE

EARRLIEKGSGSGSELARELLRAHAQLQRLNLELLRELLRALAQLQELNLDLLRLASEL

TDPDEARKAIARVKRESKRLVMSCAQESREAAAASEKISREA

>asym-degronLOCKR_a_short_t8

(SEQ ID NO: 14)

SELARKLLEASTKLQRLNIRLAEALLEAIARLQELNLELVYLAVELTDPKRIRDEIKEVK

DKSKEIIRRAEKEIDDAAKESEKILEEAREAISGSGSELAKLLLKAIAETQDLNLRAAKAF

LEAAAKLQELNIRAVELLVKLTDPATIREALEHAKRRSKEIIDEAERAIRAAKRESERIIE

EARRLIEKGSGSGSELARELLRAHAQLQRLNLELLRELLRALAQLQELNLDLLRLASEL

TDPDEARKAIARVKRLSMSCAQESERLIREAAAASEKIK

>asym-degronLOCKR_a_short_t11

(SEQ ID NO: 15)

SELARKLLEASTKLQRLNIRLAEALLEAIARLQELNLELVYLAVELTDPKRIRDEIKEVK

DKSKEIIRRAEKEIDDAAKESEKILEEAREAISGSGSELAKLLLKAIAETQDLNLRAAKAF

LEAAAKLQELNIRAVELLVKLTDPATIREALEHAKRRSKEIIDEAERAIRAAKRESERIIE

EARRLIEKGSGSGSELARELLRAHAQLQRLNLELLRELLRALAQLQELNLDLLRLASEL

TDPDEARKAIARLKMSCAQESEDAERLIREAAAASE

>degronLOCKR_b (SEQ ID NO: 16)

SHAAVIKLSDLNIRLLDKLLQAVIKLTELNAELNRKLIEALQRLFDLNVALVHLAAELTD

PKRIADEIKKVKDKSKEIVERAEEEIARAAAESKKILDEAEEEIARAAAESKKILDEGSGS

GSDAVAELQALNLKLAELLLEAVAELQALNLKLAELLLEAIAKLQELNIKLVELLTKLT

DPATIREAIRKVKEDSERIVAEAERLIAAAKAESERIIREAERLIAAAKAESERIIREGSGS

NDPQVAQNQETFIELARDALRLVAENQEAFIEVARLTLRAAALAQEVAIKAVEAASEG

GSGSGPNKEEIEKLAKEAREKLKKAEKEHKMSCAQERKKNKKAREDLKKKADK

>degronLOCKR_b_t13

(SEQ ID NO: 17)

SHAAVIKLSDLNIRLLDKLLQAVIKLTELNAELNRKLIEALQRLFDLNVALVHLAAELTD

PKRIADEIKKVKDKSKEIVERAEEEIARAAAESKKILDEAEEEIARAAAESKKILDEGSGS

GSDAVAELQALNLKLAELLLEAVAELQALNLKLAELLLEAIAKLQELNIKLVELLTKLT

DPATIREAIRKVKEDSERIVAEAERLIAAAKAESERIIREAERLIAAAKAESERIIREGSGS

NDPQVAQNQETFIELARDALRLVAENQEAFIEVARLTLRAAALAQEVAIKAVEAASEG

GSGSGPNKEEIEKLAKEAREKLKKAEMSCAQEHDKLRKKNKKAREDLKK

-continued

>degronLOCKR_c
                                                                    (SEQ ID NO: 18)
SLEAVLKLAELNLKLSDKLAEAVQKLAALLNKLLEKLSEALQRLFELNVALVTLAIELT

DPKRIADEIKKVKDKSKEIVERAEEEIARAAAESKKILDEAEEEIARAAAESKKILDEGSG

SGSDAVAELQALNLKLAELLLEAVAELQALNLKLAELLLEAIAKLQELNIKLVELLTKL

TDPATIREAIRKVKEDSERIVAEAERLIAAAKAESERIIREAERLIAAAKAESERIIREGSG

SNDPLVARLQELLIEHARELLRLVATSQEIFIELARAFLANAAQLQEAAIKAVEAASENG

SGSGPSSEKVRRELKESLKENHKQNQKLLMSCAQEQEKLNRELEELKKKHKK

>degronLOCKR_c_t13
                                                                    (SEQ ID NO: 19)
SLEAVLKLAELNLKLSDKLAEAVQKLAALLNKLLEKLSEALQRLFELNVALVTLAIELT

DPKRIADEIKKVKDKSKEIVERAEEEIARAAAESKKILDEAEEEIARAAAESKKILDEGSG

SGSDAVAELQALNLKLAELLLEAVAELQALNLKLAELLLEAIAKLQELNIKLVELLTKL

TDPATIREAIRKVKEDSERIVAEAERLIAAAKAESERIIREAERLIAAAKAESERIIREGSG

SNDPLVARLQELLIEHARELLRLVATSQEIFIELARAFLANAAQLQEAAIKAVEAASENG

SGSGPSSEKVRRELKESLKENHKQNMSCAQEHKRAQEKLNRELEELKK

>mini-degronLOCKR_c_1_t9
                                                                    (SEQ ID NO: 20)
LIERLTRLEKEHVRELKRLLDTSLEILRRLVEAFETNLRQLKEALKRALEAANLHNEEVE

EVLRKLEEDLRRLEEELRKTLDDVRKEVKRLKEELDKRIKEVEDELRKIKEKLKKGDK

NEKRVLEEILRLAEDVLKKSDKLAKDVQERARELNEILEELSRKLQELFERVVEEVTRN

VPTTERIEKVRRELKESLKENHKQNQKLLMSCAQEQEKLNRELEELKKKHKK

>miniLOCKR_c_1_t13
                                                                    (SEQ ID NO: 21)
LIERLTRLEKEHVRELKRLLDTSLEILRRLVEAFETNLRQLKEALKRALEAANLHNEEVE

EVLRKLEEDLRRLEEELRKTLDDVRKEVKRLKEELDKRIKEVEDELRKIKEKLKKGDK

NEKRVLEEILRLAEDVLKKSDKLAKDVQERARELNEILEELSRKLQELFERVVEEVTRN

VPTTERIEKVRRELKESLKENHKLNMSCAQEHKRAQEKLNRELEELKK

>mini-degronLOCKR_c_2_t9
                                                                    (SEQ ID NO: 22)
SEERVLELAEEALRLSDEAAKEIQELARRLNEELEKLSKELQDLFERIVETVTRLIDADEE

TLKRAAEEIKKRLEDARKKAKEAADKAREELDRARKKLKELVDEIRKKAKDALEKAG

ADEELVARLLRLLEEHARELERLLRTSARIIERLLDAFRRNLEQLKEAADKAVEAAEEA

VRRVEDVRVWSEKVRRELKESLKENHKQNQKLLMSCAQEQEKLNRELEELKKKHKK

>miniLOCKR_c_t13
                                                                    (SEQ ID NO: 23)
SEERVLELAEEALRLSDEAAKEIQELARRLNEELEKLSKELQDLFERIVETVTRLIDADEE

TLKRAAEEIKKRLEDARKKAKEAADKAREELDRARKKLKELVDEIRKKAKDALEKAG

ADEELVARLLRLLEEHARELERLLRTSARIIERLLDAFRRNLEQLKEAADKAVEAAEEA

VRRVEDVRVWSEKVRRELKESLKENHKLNMSCAQEHKRAQEKLNRELEELKK

>asym-degronLOCKR_c_t13
                                                                    (SEQ ID NO: 24)
SLEAALKLAELNLKLSDKLAEASQKLAALLNKLLEKLSEAIQRLFELNLALVTLAIELTD

PKRIADEIKKVKDKSKEIIERAEEEIARAAAESKKILDEAEEEIARAAAESKKILDEGSGS

GSDALAELQALNLKLAELLLEAIAETQALNLKAAEAFLEAAAKLQELNIKAVELLVKLT

DPATIREALRKAKEDSERIIAEAERAIAAAKAESERIIREAERLIAAAKAESERIIREGSGS

-continued

NDPLIARLQELLIEHARELLRLHATSQEIFVELLRAFLANLAQLQEAALKALEAASENGS

GSGPSSEKVRRELKESLKENHKQNQKLLMSCAQEQEKLNRELEELKKKHKK

>degronLOCKR_d (SEQ ID NO: 25)

SLEAVLKLFELNHKLSEKLLEAVLKLHALNQKLSQKLLEALARLLELNVALVELAIELT

DPKRIADEIKKVKDKSKEIVERAEEEIARAAAESKKILDEAEEEIARAAAESKKILDEGSG

SGSDAVAELQALNLKLAELLLEAVAELQALNLKLAELLLEAIAKLQELNIKLVELLTKL

TDPATIREAIRKVKEDSERIVAEAERLIAAAKAESERIIREAERLIAAAKAESERIIREGSG

SGDPEVARLQEAFIEQAREILRNVAAAQEALIEQARRLLALAALAQEAAIKAVELASEH

GSGSGPDTVKRILEELRRRFEKLAKDLDDIAMSCAQEHKKHNKELKDKQRKIK

FIG. 10. Design of the LOCKR switch system. a, Thermodynamic model describing the design goal. The cage (cyan) and latch (blue) form the switch with some equilibrium in the open and closed states. The key (green) can bind the cage to promote the open state to allow target (yellow) binding to the latch. b, Plots from the model in (a) for two values of $K_{LT}$ showing how fraction target bound is affected by addition of key ($K_{CK}$=1 nM); the different colored curves show the effect of log-decreasing values of $K_{open}$=[open]/[closed]. c, Loops were added to homotrimer 5L6HC3 to form monomeric five- and six-helix frameworks; double mutant V217S/I232S weakens the Latch allowing it to be displaced by key, resulting in a LOCKR system able to bind an exogenous key. d, Chemical denaturation with guanidinium chloride (Gdm) of the trimer (dark blue), monomer (cyan), truncated five-helix framework (red), and LOCKR (green) monitoring mean residue ellipticity (MRE) at 222 nm. e, Small-angle x-ray scattering (SAXS) Kratky plots for the monomeric frameworks are similar to that of the input trimer, with the greatest deviation for the 5 helix framework. Colors continued from (d). f, Pulldown assay showing that Key binds to the truncation and LOCKR (V217S/I232S), but not the six-helix monomer; free GFP-Key was added to monomeric frameworks immobilized onto a plate via a hexahistidine tag; after a series of wash steps, binding was measured by GFP fluorescence (n=2, error bars indicate standard deviation).

FIG. 11. BimLOCKR design and activation. a, Following incorporation of the BIM peptide into the LOCKR latch, the free energy of the latch-cage interface was reduced by introducing sub-optimal interactions (left, removal of a buried hydrogen bond) and by truncating the latch, leaving exposed hydrophobic residues in the cage available for key binding (right). b, The lengthened BimLOCKR constructs show tight caging of Bim in the absence of key while introduction of the toehold (right) allows activation of 250 nM BimLOCKR with addition of 5 μM key via Bio-layer interferometry. c, Bio-layer interferometry shows key-dependent binding to Bcl2 with 250 nM BimLOCKR. Association from 0-500 s, then dissociation from 500-1700 s. Purple is at 3 μM key, then a three fold dilution of the key through blue, cyan, green, yellow, and orange. Red line is 250 nM LOCKR without key added. d, Each point in dark green is a result of fitting data in (c) and extracting the response at equilibrium; the lighter green curves show binding response at equilibrium for shorter keys that alter $K_{CK}$ of LOCKR to tune its range of activation. Dashed lines are the data fit to a logistic curve.

FIG. 12. Design and validation of orthogonal Bim-LOCKR. a, Left: LOCKR in cartoon representation. Cage in white with three different latches superimposed and hydrogen bond networks marked by colored markers. Right: Design models of hydrogen-bond networks across the orthogonal LOCKR interfaces corresponding to the colored markers on the left. b, BimSwitches binding to Bcl2 in response to its cognate key, measured by biolayer interferometry (Octet). c, Binding response to Bcl2 from biolayer interferometry experiments for each switch at 250 nM against each key at 5 μM; average of two replicates.

FIG. 13. Design and in vivo testing of degronLOCKR. a, Schematic of dual inducible system used in *S. cerevisiae* to test functionality of degronLOCKR. Progesterone (Pg) induces production of Key-BFP, and estradiol (E2) induces production of YFP-degronSwitch. b, Heatmaps of YFP fluorescence as a function of E2 (0-50 nM) and Pg (0-100 nM) for full length key (left) and a key that was truncated by 12 residues (right) as measured by flow cytometry. c, Line plot comparing the fluorescence of the YFP-degronSwitch$_a$ and Key$_a$-BFP at a max dose of E2 (black rectangle in (b) as a function of Pg induction. Fluorescence values were normalized to the maximum YFP or BFP fluorescence. Error bars represent s.d. of three biological replicates. d, Dynamic measurements of active degLOCKR using an automated flow cytometry platform. E2 was induced to activate expression of YFP-degronSwitch$_a$, and Pg was induced at t4 hrs to activate expression of Key$_a$-BFP. Measurements were taken every 24 minutes. e, Coexpression of orthogonal LOCKRs in the same cell. YFP-degronSwitch$_a$ and RFP-degron-Switch$_c$ were expressed using constitutive promoters and either Key$_a$-BFP (left) or Key$_c$-BFP (right) were expressed using the pZ3 inducible promoter. Normalized fluorescence of YFP-degronSwitch$_a$, RFP-degronSwitch$_c$ and either Key$_a$-BFP or Key$_c$-BFP are plotted as a function of Pg induction. Error bars represent s.d. of biological replicates. f, Asymmetric RFP-degronSwitch$_a$ was expressed in HEK293T cells with and without Key. Flow cytometry distribution of RFP fluorescence for a representative sample indicates decreased RFP expression in the presence of Key. Geometric mean of RFP expression is quantified in the bar plot. Data in all panels represent mean±s.d. of three biological replicates.

FIG. 14. Controlling gene expression using degron-LOCKR. a, Schematic of dual induction assay to determine the effect of degronLOCKR$_a$ on a synthetic transcription factor (SynTF). Pg induces expression of Key$_a$-BFP, and E2 induces expression of SynTF-RFP-degronSwitch$_a$ fusion. The pSynTF promoter is activated by SynTF and expresses YFP. b, Heatmaps of YFP and RFP fluorescence as a function of E2 (0-125 nM) and Pg (0-100 nM) measured by flow cytometry. c, Line plot comparing the fluorescence of YFP, SynTF-RFP-degronSwitch$_a$ and Key$_a$-BFP at 31.25 nM E2 (black rectangle in 5b) as a function of Pg induction. Fluorescence values were normalized to the maximum YFP, RFP, or BFP fluorescence. Error bars represent s.d. Of three biological replicates. d, Schematic of dual induction assay to determine the effect of degronLOCKR$_a$ on a dCas9-VP64 targeted to the pTet7× promoter via a constitutively expressed sgRNA (not shown). Pg induces expression of Key$_a$-BFP, and E2 induces expression of dCas9-VP64-RFP-degronSwitch$_a$ fusion. The pTet7× promoter is activated by dCas9-VP64 and expresses YFP. e, Heatmaps of YFP and RFP fluorescence as a function of E2 (0-125 nM) and Pg (0-100 nM) measured by flow cytometry. f, Line plot comparing the fluorescence of YFP, dCas9-VP64-RFP-degron-Switch$_a$ and Key$_a$-BFP at 31.25 nM E2 (black rectangle in 5d) as a function of Pg induction. Fluorescence values were normalized to the maximum YFP, RFP, or BFP fluorescence. Error bars represent s.d. of three biological replicates.

FIG. 15: Biophysical data from LOCKR design. a) Size Exclusion Chromatography for the Monomer, Truncation, and LOCKR designs on Superdex 75. Peaks indicated by vertical dashed lines represent monomeric protein used in downstream characterization and functional assays. b) Circular dichroism spectroscopy to determine protein stability upon heating and chemical denaturant, Guanidinium Chloride-HCl. Top row: full wavescan at 25° C. (blue), 75° C. (orange), 95° C. (red), then cooled to 25° C. (cyan). Middle row: guanidine melts also shown overlapped in FIG. 1d. Bottom row: fraction folded was converted to equilibrium constant, then to $\Delta G_{unfolding}$ value. The linear unfolding region, marked by vertical lines in middle row, was fit to determine the $\Delta G_{folding}$ for each design. c) SAXS spectra (black) referenced in FIG. 1e fit to Rosetta design models (red) using FoXS with chi-values referenced in the upper right.

FIG. 16: GFP Plate assay to find mutations for LOCKR. Different putative LOCKR constructs were adhered via 6×-His tag to a Ni coated 96-well plate, Key-GFP was applied, and excess washed. Resulting fluorescence represents Key-GFP bound to LOCKR constructs. The truncation was used as a positive control, since the key binds to the open interface. The monomer as a negative control since it does not bind the key. Error bars represent the standard deviation of three replicates.

FIG. 17: Caging Bim-related sequences. a) Three Bcl2 binding sequences were grafted onto the latch. aBcl2 is a single helix from a designed Bcl2 binder (pdb: SJSN) where non Bcl2-interacting residues were reverted back to the standard LOCKR latch sequence, shown as dashes. pBim is the partial Bim sequence where only Bcl2-interacting residues are grafted onto the latch. Bim is the full consensus sequence of the BH3 domain. b) LOCKR (left) with the latch in dark blue. The helical Bim sequence is taken from the Bim/Bcl2 interaction and grafted onto the latch c) Left: Bcl2 (tan) binding to Bim (purple) from pdb:2MV6 with pBim residues shown as sticks. Center: a well caged graft where important binding residues are caged. Right: a poor graft where Bcl2 binding residues are exposed and polar surface residues are against the cage interface.

FIG. 18: Tuning BimLOCKR. aBcl2, pBim, and Bim were caged to varying degrees of success. Early versions of the switch, with aBcl2 and pBim did not efficiently cage Bcl2 binding in the off state. They also only weakly bound the key leading to small dynamic range. The cage and key was extended by 5, 9, and 18 residues in an attempt to provide a larger interface to tightly hold the latch in the off state and provide a larger interface for key binding to increase the dynamic range of activation. Mutations on the latch, identified in FIG. 16, and providing toeholds for key binding were the two strategies employed to tune the switch. In graphs, "off" refers to 250-310 nM switch an absence of key while "on" refers to excess key added. The height of the bar graph shows the $R_{eq}$ as measured by Bio-layer interferometry.

FIG. 19: Sequence alignment of 1504 keys for filtering for orthogonality. Every pairwise alignment was scored using BLOSUM62 scoring, disallowing gaps while not penalizing end-gaps. This algorithm finds the BLOSUM62 score of the most similar superposition of each pair of keys taking into account amino acid identity.

Figure 20:
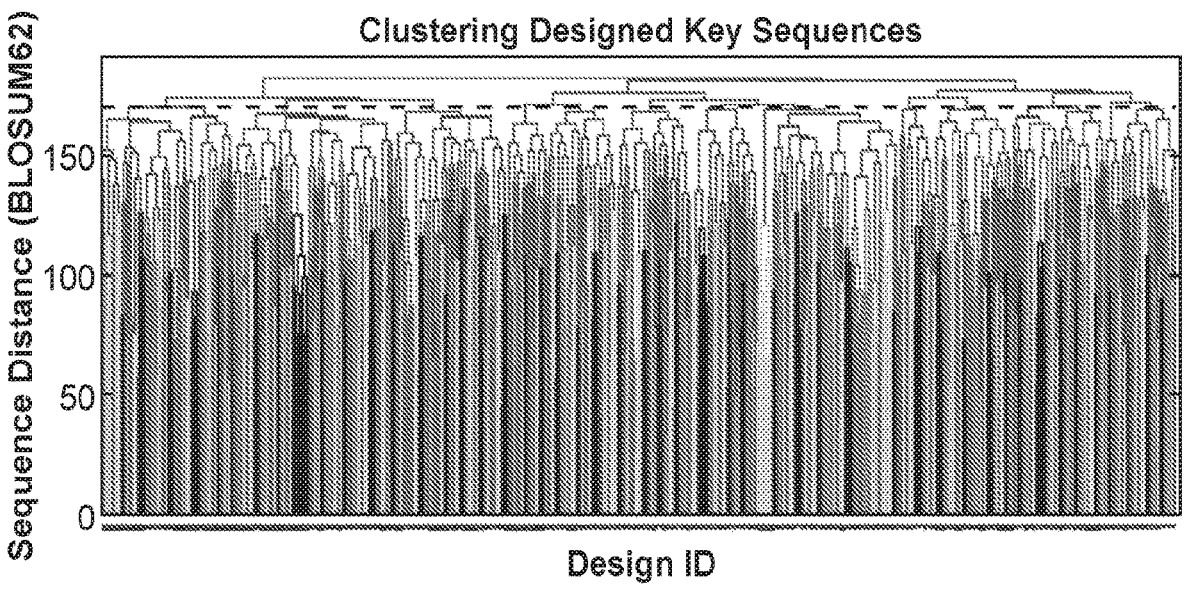
FIG. 20 provides clustering of the sequences aligned in FIG. 19.

FIG. 20: Clustering sequences aligned in FIG. 19. Each sequence along the y-axis was clustered using a hierarchical clustering algorithm. The cutoff at 170 (horizontal, black dotted line) selects 13 clusters from which the centers were chosen as designs to order.

FIG. 21: Validation of model in FIG. 10, panel a. a) BLI measurement of BimLOCKR$_a$ (400 nM) binding to Bcl2 (gold), BclB (yellow), and Bak (lighter yellow—Bim-LOCKR at 1 μM) as key is added to solution. Normalized due to differences in $R_{max}$ for Bcl2 and BclB on the tip. b) BLI measurement of BimLOCKR$_a$ binding to key$_a$ immobilized on the tip. Open circles are with no Bcl2 present, gold points are with Bcl2 present at 500 nM.

FIG. 22: Caging cODC sequences. a) Three variations of the cODC degron to cage. Variations meant to tune $K_{open}$ by removing the destabilizing proline (noPro) and minimizing mutations to the latch (CA only). b) Predicted models of the full and noPro cODC sequences (orange) threaded onto the latch (dark blue). Thread position chosen such that the cysteine residue needed for degradation is sequestered against the cage (light blue). Proline highlighted in red in the full cODC mutated to an isoleucine in the noPro variant.

FIG. 23: Comparing the stability of YFP fused to cODC variants caged in Switch$_a$ to an empty Switch$_a$ and to bimSwitch$_a$. The dual inducible system from FIG. 13, panel a, was used to express the various YFP-Switch$_a$ fusions (solid lines and dots) via pGal1 and E2, and Key$_a$-BFP via pZ3 and Pg. YFP (Venus) alone, YFP fused to the WT cODC (cODC) or YFP fused to the proline removed cODC (cODC noPro), were also expressed using pGal1 and E2 (dashed lines). Cells were induced with a saturating dose of E2 (50 nM) and Pg was titrated in from 0-100 nM. Fluorescence was measured at steady-state using a flow cytometer and error bars represent s.d. of biological replicates. A moderate decrease in YFP fluorescence was observed as a function of Pg for the full cODC variant, whereas only a small decrease was observed for the proline removed and CA only. No decrease in fluorescence was observed as a function of key induction for YFP alone, empty Switch$_a$, or bimSwitch$_a$.

FIG. 24: Tuning toehold lengths of degronLOCKR$_a$. The dual inducible system from FIG. 13, panel a, was used to express the various YFP-Switch$_a$ fusions via pGal1 and E2, and Key$_a$-BFP via pZ3 and Pg. YFP fused to the proline removed cODC (cODC no Pro) was also expressed using pGal1 and E2 (dashed line). Cells were induced with a saturating dose of E2 (50 nM) and Pg was titrated in from 0-100 nM. Fluorescence was measured at steady-state using a flow cytometer and error bars represent s.d. of biological replicates. (Left) cODC variants from FIG. 22 alone to show dynamic range of Full cODC. (Right) Extending toehold on proline removed version from 9 to 12 and 16aa. Proline removed with 12aa toehold shows the greatest dynamic range of all the switches tested.

FIG. 25: BFP expression corresponding to FIG. 13, panel b. E2 and Pg were used to induce expression of YFP-degronSwitch$_a$ and Key$_a$ (Full length or truncated)-BFP, respectively. Fluorescence was measured at steady-state using a flow cytometer. BFP expression was not dependent on expression of the Switch, suggesting the Key does not co-degrade with the Switch.

Figure 26:
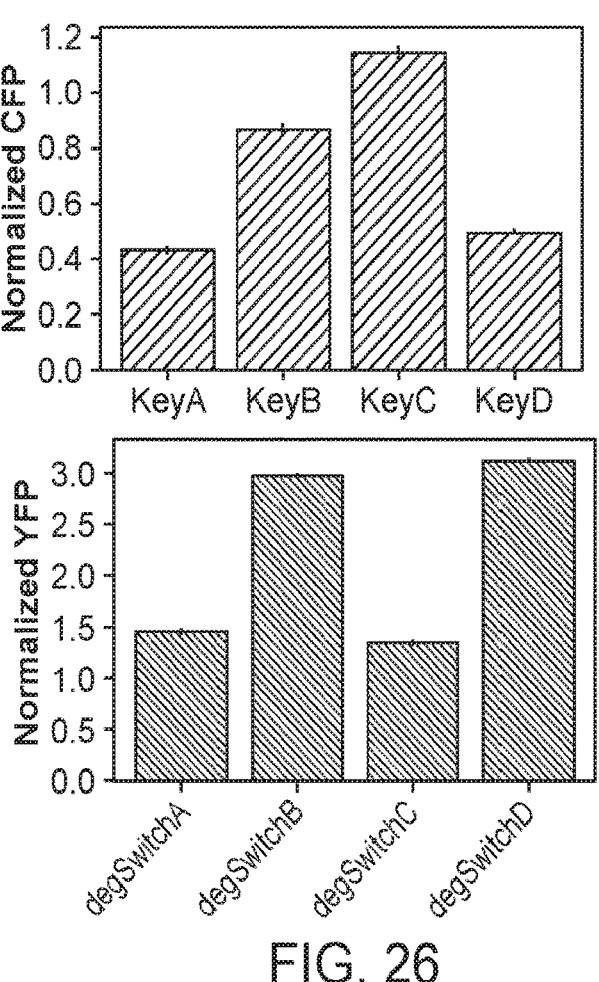
FIG. 26 provides expression data related to orthogonal YFP-degronSwitch and Key-CFP.
Figure 27:
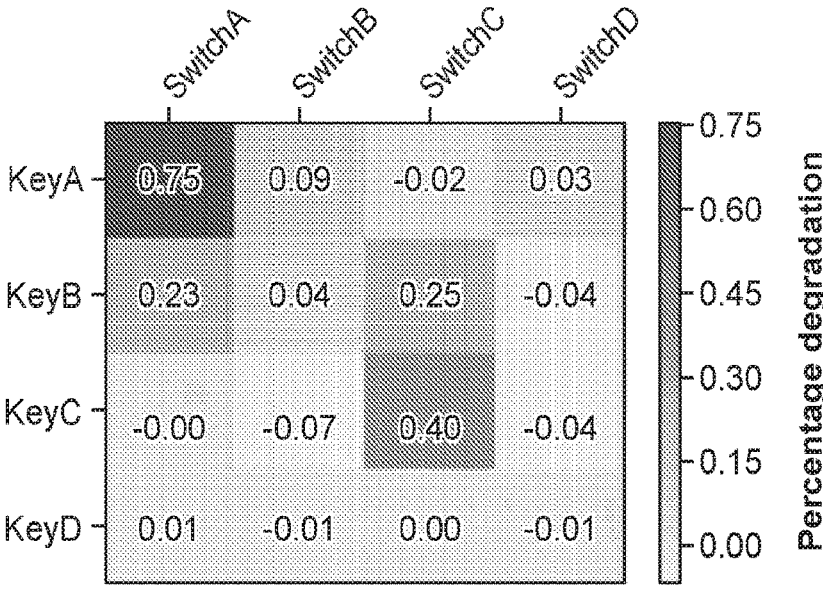
FIG. 27 demonstrates $degronLOCKR_{a-d}$ orthogonality.

FIG. 26: Expression of orthogonal YFP-degronSwitch and Key-CFP. Four different switches and keys (A, B, C, D) were expressed using the strong pTDH3 promoter. Fluorescence was measured at steady-state using a flow cytometer and error bars represent s.d. of biological replicates.

FIG. 27: degronLOCKR$_{a-d}$ orthogonality. All combinations of pTDH3-YFP-degronSwitch and pTDH3-Key-CFP were tested. Fluorescence was measured at steady-state using a flow cytometer. Percentage degradation was calculated by subtracting the YFP-degronSwitch fluorescence with the given Key-CFP coexpressed from the YFP-degron-Switch fluorescence without any Key expressed and normalizing by the YFP-degronSwitch fluorescence without any Key expressed. degronSwitch$_a$ is activated strongly by Key$_a$ and weakly by Key$_b$. degronSwitch$_c$ is activated strongly by Key$_c$ and weakly by Key$_b$. Because degronSwitch$_a$ and degronSwitch$_c$ are not activated by Key$_c$ and Key$_a$ respectively, these two are considered to be an orthogonal pair.

FIG. 40: Comparison of different degronSwitch variants in HEK293T cells. Fluorescence of RFP-degronSwitch variants in the presence and absence of Key-BFP were measured using flow cytometry. Original symmetric design ("Sym") was compared against an asymmetric design ("Asym"). Two toehold lengths (designated by a preceeding "t") were tested for each variant (i.e., "t12", "t9", t8" and "t5"). Data in bar graph represents geometric mean±s.d. of three biological replicates and untransduced control ("UnT") is provided for reference. Histograms are depicted for a representative sample. Asymmetric cage with a t8 toehold demonstrated the largest dynamic range.

Example 2: Modular and Tunable Biological Feedback Control Using a De Novo Protein Switch In this example, a de novo protein switch, degron-LOCKR, designed via host-agnostic parts with modular connectivity and predictable tunability is employed to implement feedback control on endogenous pathways and synthetic circuits in the yeast *S. cerevisiae*.

Figure 28:
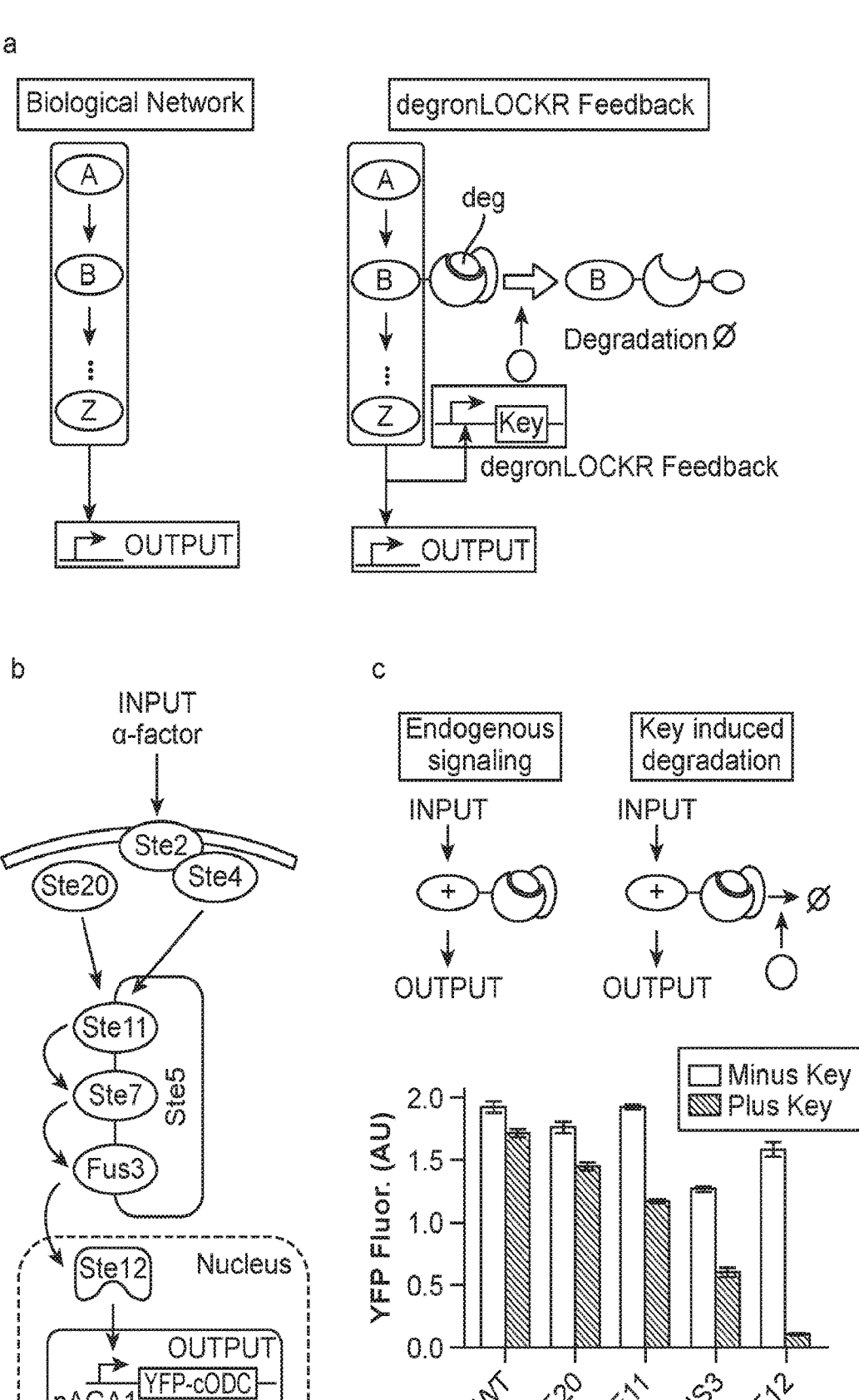
FIG. 28 provides degronLOCKR is a modular tool for controlling biological pathways. a) Schematic of degron-LOCKR as a modular tool to implement synthetic feedback control on an endogenous or synthetic biological network by fusing the degSwitch to an effector molecule and driving the expression of the key from the output of the network. b) Simplified schematic of the yeast mating pathway not showing complex endogenous feedback. Pathway is activated by addition of α-factor and signaling activity is measured using a pAGA1-YFP-cODC reporter. c) degronLOCKR induced degradation of positive signaling molecules to control mating pathway activity. The endogenous copy of indicated signaling molecule was fused to degSwitch and key was expressed using a progesterone inducible system. Cells were induced with a saturating dose of α-factor and pathway activity with and without key was compared. pAGA1-YFP-cODC was measured on a flow cytometer after four hours of growth. Data represent mean±s.d. of three biological replicates.

The degronLOCKR device is based on LOCKR (Latching Orthogonal Cage Key pRoteins) technology, and consists of the designer degSwitch and key proteins. The degSwitch is a six-helix bundle that has the cODC degron embedded in the destabilized sixth helix (latch), which is occluded via interaction with the five-helix scaffold (cage). The key, a genetically encoded peptide, can outcompete the latch for binding with the cage. This reveals the cODC degron, thus targeting the degSwitch and any fused cargo to the proteasome for degradation. degronLOCKR is a powerful device for synthetic biology because protein degradation is a universal method for post-translational regulation. It has been shown that degronLOCKR can control gene expression by regulating the stability of a transcription factor. Here, this functionality is capitalized on to implement modular feedback control on a biological network using degronLOCKR by expressing the key as a function of the output of the network (FIG. 28, panel a). The degronLOCKR feedback strategy offers several advantages over other approaches for implementing feedback control. First, the modular nature of the degronLOCKR allows the degSwitch to be directly fused to any protein of interest to generate on-target effects. Modifying endogenous genes with the degSwitch also preserves the native transcriptional and translational regulation of the signaling protein. Finally, degronLOCKR is a completely de novo designed protein thus allowing for predictable modifications to tune its characteristics.

degronLOCKR Synthetic Negative Feedback in Endogenous Yeast Pathway

As a qualitative proof of concept, degronLOCKR was used to implement synthetic negative feedback in the yeast MAPK mating pathway (FIG. 28, panel b), a complex signaling pathway with many endogenous feedback loops. The ability of degronLOCKR to modulate pathway output was tested by appending the degSwitch to the endogenous locus of several positive pathway molecules in a ΔFAR1 ΔBAR1 background strain and the key was expressed using an inducible system (Aranda-Diaz et al. ACS Synth. Biol. 6, 545-554 (2017)) (FIG. 28, panel c). The key was targeted to either the cytosol or nucleus using a nuclear localization sequence to trigger degradation of each molecule in a specific compartment of the cell (FIG. 29). This localized inducible degradation is a unique characteristic of degron-LOCKR that enables location specific action in the cell. The mating pathway was stimulated with a saturating dose of α-factor (100 nM) and monitored pathway activity using pAGA1-YFP-cODC (McCullagh et al. Nat. Cell Biol. 12, 954-962 (2010)) transcriptional reporter (cODC degron (Hoyt et al. J. Biol. Chem. 278, 12135-12143 (2003)) destabilizes the long lived fluorescent reporter, allowing dynamics to be observed). Degrading STE20 (MAPKKKK), STE11 (MAPKKK), and FUS3 (MAPK) had a moderate effect, while degrading STE12 (TF) completely eliminated the output of the mating pathway (FIG. 28, panel c, bottom). These data indicate that degronLOCKR is an effective tool for modulating endogenous pathways.

Figure 30:
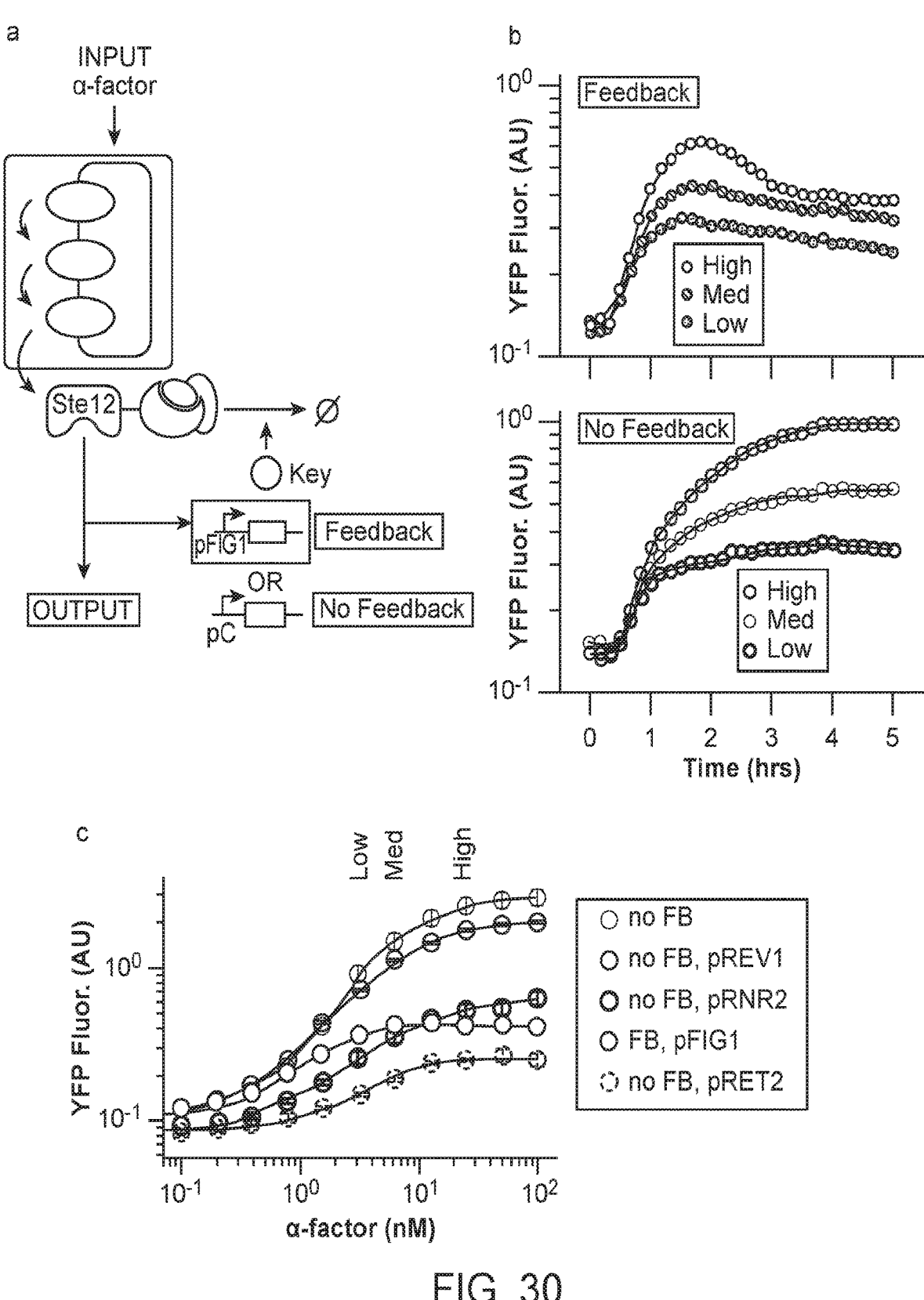
FIG. 30 demonstrates that degronLOCKR module successfully implements synthetic feedback control of the mating pathway. a) Schematic of synthetic negative feedback where the endogenous copy of STE12 is fused to the degSwitch and either the pathway reporter pFIG1 (synthetic feedback) or a constitutive promoter (no feedback) is used to express key-CFP-NLS. All output measurements are for pAGA1-YFP-cODC. b) Measurements of pAGA1-YFP-cODC dynamics. Synthetic feedback and no feedback (pREV1) strains were induced with a high (25 nM), medium (6.25 nM), or low (3.13 nM) dose of α-factor at time t=0 hr and flow cytometry measurements (points) were performed every 10 minutes. Lines represent a moving average taken over three data points. c) α-factor dose response of synthetic feedback (pFIG1) and four no feedback (no key, pREV1, pRNR2, pRET2) strains. pAGA1-YFP-cODC fluorescence was measured using flow cytometry four hours after α-factor induction. Points represent the mean±s.d. of three biological replicates. Solid lines are a hill function fit to the data. High, medium, and low doses of α-factor from the experiment in (b) are indicated on the graph.

Synthetic negative feedback control of the mating pathway was next implemented by expressing the key-CFP-NLS from a mating pathway responsive promoter (FIG. 1) in a strain where endogenous STE12 is fused to the degSwitch (FIG. 30, panel a). The effect of this feedback was compared to a strain with no feedback where STE12 is still fused to degSwitch but the key is driven by a constitutive promoter. pAGA1-YFP-cODC dynamics were followed after stimulation with high (25 nM), medium (6.25 nM), and low (3.13 nM) doses of α-factor (Fig FIG. 30, panel b) using automated flow cytometry. For comparison, a strain without feedback (pREV1-key-CFP-NLS) was simultaneously measured. Following stimulation with each dose of alpha-factor, the output of the synthetic feedback and no feedback strains initially followed each other closely. After around two hours, the synthetic feedback output started to decrease while the no feedback output increased to different steady-states corresponding to the different doses of α-factor. The strain with degronLOCKR synthetic feedback displayed larger transient overshoots for larger doses of α-factor, but eventually converged on the same steady-state output regardless of the input size. These data suggest that synthetic feedback desensitizes the steady-state output to α-factor of the mating pathway in this input regime. This effect is likely not due to saturation of signaling because of the different observed transients.

To obtain a more global comparison of the steady-state behaviors of the synthetic feedback and no feedback strains, the output dose response of each was measured as a function of α-factor. The feedback strain displayed attenuation of maximum output magnitude and decreased slope in the linear region of the dose response (FIG. 30, panel c). Comparing the synthetic feedback strain to no feedback strains with a range of constitutive promoter strengths (Lee et al. ACS Synth. Biol. 4, 975-986 (2015)) (pREV1, pRNR2, pRET2) indicates that the behavior generated by feedback cannot be achieved by expressing different constitutive amounts of the key. Taken together, the dynamic adaptation behavior and dose response clearly demonstrate the effect of synthetic negative feedback and utility of degronLOCKR as a tool for rapid rewiring of a complex endogenous signaling pathway.

degronLOCKR Feedback in a Synthetic Transcriptional Cascade

Figure 31:
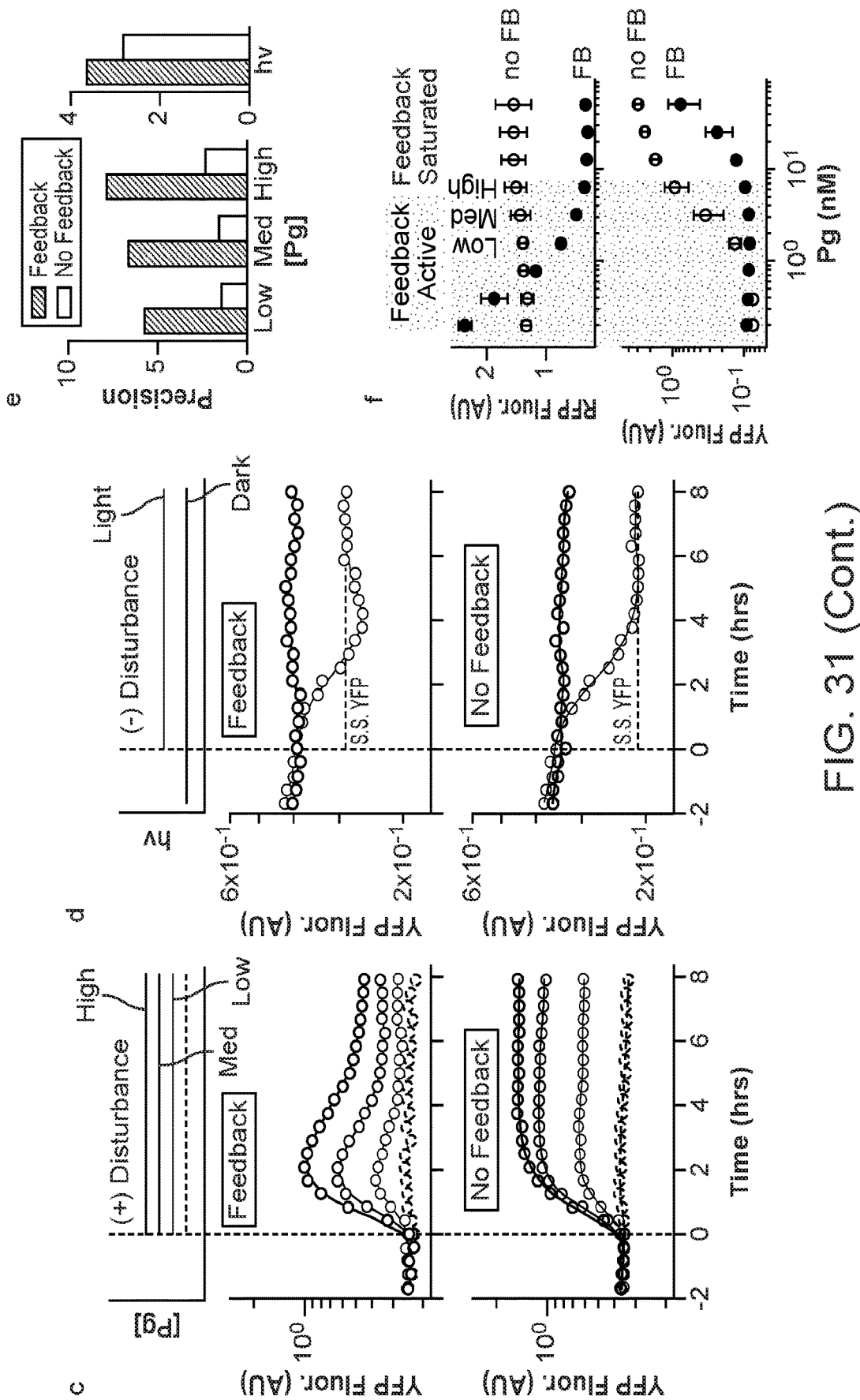
FIG. 31 provides operational properties of degronLOCKR feedback module quantified via control of a synthetic circuit. a) Schematic of synthetic feedback circuit. GEM-degSwitch is expressed constitutively and is activated by estradiol (E2) to drive expression of pGAL1-Z3PM-psd. Z3PM is activated by progesterone (Pg) to drive expression from pZ3. Blue light can be used to induce degradation of Z3PM-psd. pZ3-YFP-cODC is the measured output of the circuit, and pZ3-key-CFP-NLS drives feedback (synthetic feedback) in the circuit by activating degradation of GEM-degSwitch. In the circuit with no feedback a constitutive promoter is used to express key-CFP-NLS. b) Model simulation (see supplementary information) of the feedback and no feedback circuits. The simulated dynamics (left) and change of steady-state (right) of output following a Pg disturbance indicate that feedback buffers against increasing Pg concentration by degrading GEM and reducing Z3PM concentration. c) Dynamic measurements of pZ3-Venus-cODC using automated flow cytometry for the synthetic feedback and no feedback strains (pRNR2-key-CFP-NLS) following a positive disturbance. Cells were grown to steady-state expression in 0.78 nM Pg and 7.5 nM E2. At time 0 hrs cells were either kept at the same Pg concentration or induced to a new final concentration of 1.56 nM (low), 3.13 nM (med), or 6.25 nM (high) Pg. Dynamics were measured for another eight hours. Solid line represents a moving average taken over three data points. d) Dynamic measurements of pZ3-Venus-cODC using automated flow cytometry for the synthetic feedback and no feedback strains (pRPL18B-key-CFP-NLS driving key) following a negative disturbance. Cells were grown to steady-state expression in 1.57 nM Pg and 30 nM E2 then subjected to blue-light at time 0 hrs to activate the psd. Dynamics were measured for eight hours post-disturbance. Growth and sampling conditions are as in c). e) Precision of the synthetic feedback versus no feedback circuits to each of the disturbances. f) Comparison of steady-state circuit behavior (ten hours after stimulation) with and without feedback (pRNR2-key-CFP-NLS) as a function of Pg at a fixed concentration of 7.5 nM E2. RFP fluorescence is a proxy for Z3PM concentration and YFP fluorescence is the output of the circuit. Pg doses used for positive disturbance in c) are indicated. Points represent mean±s.d. of three biological replicates.

The quantitative capabilities and operational range of the degronLOCKR feedback module was next mapped using a simple synthetic transcriptional cascade consisting of two inducible synthetic transcription factors (Aranda-Diaz et al.) (FIG. 31, panel a). The first, GEM (Gal4 DNA binding domain-Estradiol hormone binding domain-Msn2 activation domain), is induced by estradiol (E2) and activates pGAL1 to produce Z3PM (Z3 zinc finger-Progesterone hormone binding domain-Msn2 activation domain). Z3PM, in turn, is induced by progesterone (Pg) and activates transcription of pZ3-YFP-cODC. To implement feedback, the same modular strategy that was successful for controlling the mating pathway was used: fusing GEM to the degSwitch and using pZ3 to express key-CFP-NLS (synthetic feedback). With feedback, the concentration of GEM is dependent on the output of Z3PM because the amount of key produced, and hence degradation rate of GEM, is a function of Z3PM activity. The circuit can be perturbed by addition of Pg or induction of a blue-light inducible degron (psd) (Renicke et al. Chem. Biol. 20, 619-626 (2013)) fused to Z3PM to increase or decrease the output, respectively. Feedback buffers against these disturbances by modulating the concentration of Z3PM. This type of disturbance rejection experiment is an essential test of feedback in technological systems.

Figure 32:
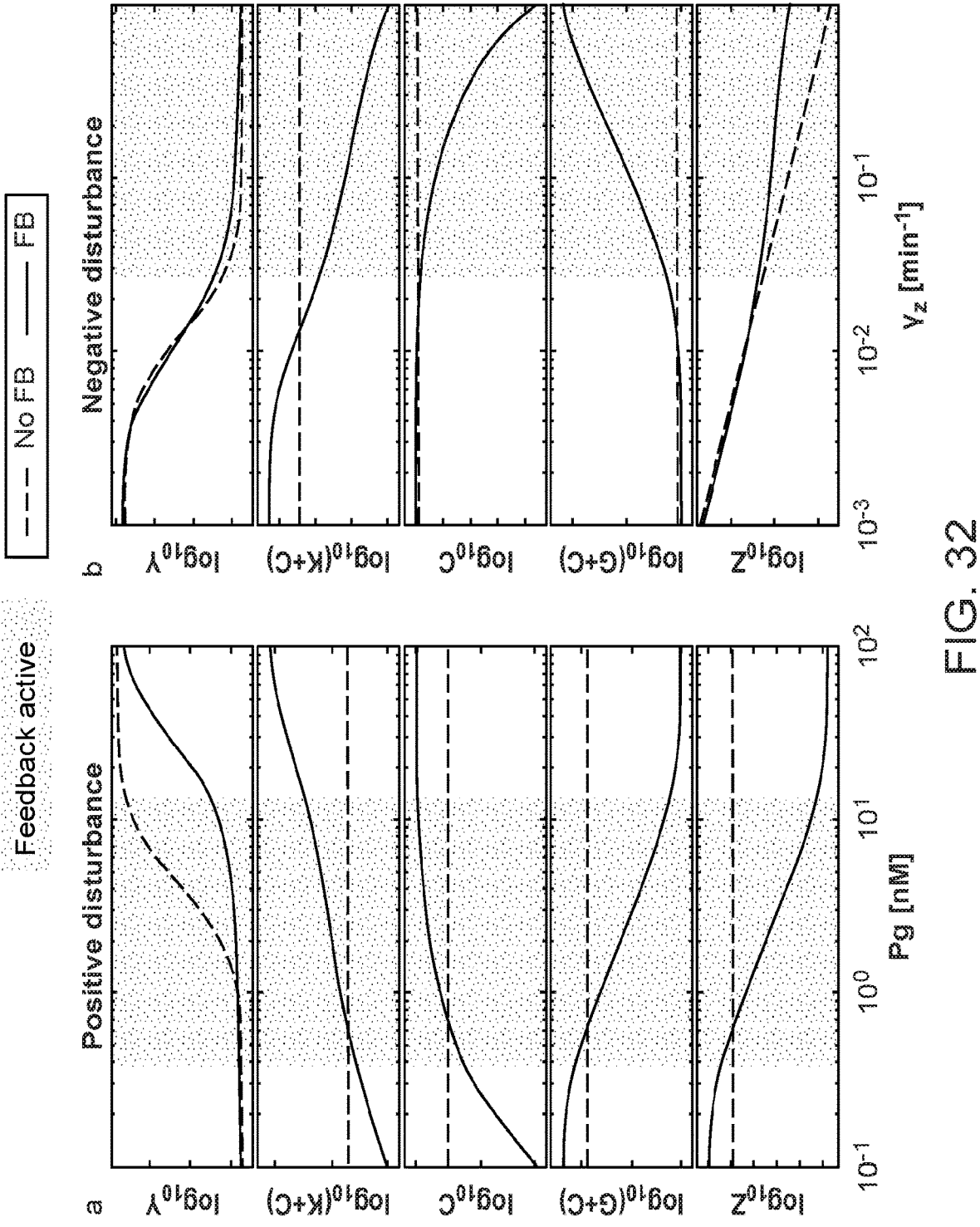
FIG. 32 provides steady state solutions in response to positive or negative disturbances. Steady values as a) progesterone (Pg) or b) ZPM degradation rate ($\gamma_Z$) change according to our Hill-like model. Continuous lines correspond to the feedback system (FB), while the dashed line shows an example where the feedback has been removed (i.e. $f_K = \mu_K^*$ instead of Eq.12; No FB). The gray box delimits the area where the feedback is considered "active", which is defined by the relative change in total GEM ($\Delta(G+C)/(G+C)$) over the relative change of the disturbance (either a) $\Delta P/P$ or b) $\Delta\gamma_Z/\gamma_Z$) is higher than 0.15. Noteworthy, in the absence of feedback, $\Delta(G+C)$ is equal zero for any disturbance except on the synthesis or degradation rate of the key or GEM directly.

A simple computational model of the circuit predicts that an increase in Pg results in a monotonic increase in output without feedback (key expressed constitutively), whereas feedback gives a transient increase in output followed by adaptation to a steady-state whose value is closer to the pre-disturbance value than the circuit with no feedback for the same increase in Pg (FIG. 31, panel b, left). Feedback attenuates the dependence of the output on the Pg disturbance by decreasing the production rate of Z3PM, therefore compensating for an increase in Z3PM activity after a Pg increase with a decrease in its concentration (FIG. 31, panel b, right; FIG. 32).

These predictions were experimentally verified by first inducing cells with 7.5 nM E2 and 0.78 nM Pg and which were grown until their output reached steady-state (FIG. 31, panel c). At that time, the cells were perturbed with a high (6.25 nM), medium (3.13 nM), or low (1.56 nM) step-input of Pg and the dynamics of pZ3-YFP-cODC were measured using an automated flow cytometry and optogenetically-enabled continuous culture platform. As a control, the same series of inductions were performed on an strain without feedback (pRNR2 expressing key) which had similar YFP steady-state output as the feedback strain at the pre-disturbance concentration of E2 and Pg. Without feedback, the step-input of Pg caused an increase in Z3PM activity and thus YFP expression until the output reached a new steady-state commensurate with the disturbance. In contrast, the synthetic feedback circuit increased key expression as Z3PM activity increased, resulting in GEM degradation and thus a decrease in Z3PM production. This buffering effect is visible starting two hours post-disturbance when the synthetic feedback circuit output begins to decrease while the no feedback circuit output continues to climb. This adaptation behavior is qualitatively similar to the synthetic negative feedback loop constructed for the mating pathway. Because of the well-defined inputs and disturbances, adaptation can be quantified using a precision metric calculated by taking the inverse of the absolute difference between post- and pre-disturbance output normalized by the pre-disturbance output (Ma et al. Cell 138, 760-773 (2009)) (FIG. 31, panel e). The feedback circuit generates much higher precision than the circuit without feedback for the Pg positive disturbance, showcasing a benefits of feedback control.

A similar experiment was performed where the cells were subjected to a negative disturbance. Cells were grown to steady-state at 30 nM E2 and 1.57 nM Pg, then induced with blue light to activate degradation of Z3PM (FIG. 31, panel d). As a control, a no feedback circuit was built as a control with the key expressed constitutively from pRPL18B to match the steady-state expression of the synthetic feedback circuit before disturbance. After an immediate decrease in YFP expression in both synthetic feedback and no feedback circuits as a result of Z3PM degradation, the no feedback circuit settled to a new lower steady-state. The feedback circuit, however, underwent a slight overshoot after which it recovered to a steady-state closer to the pre-disturbance value than the no feedback circuit. The amount of adaptation in the synthetic feedback circuit for the negative disturbance is not as dramatic as for the positive disturbance (FIG. 31, panel f). Model simulation shows that the negative disturbance pushes the circuit output to a lower expression level where the relative difference between a circuit with and without feedback will be smaller. Thus, even if feedback is still actively buffering against the negative disturbance the effect will be harder to observe. This underscores the fact that any feedback circuit, whether built with biological molecules or electronic components, has properties that need to be explored through thorough prototyping in order to enable productive modular use.

Figure 33:
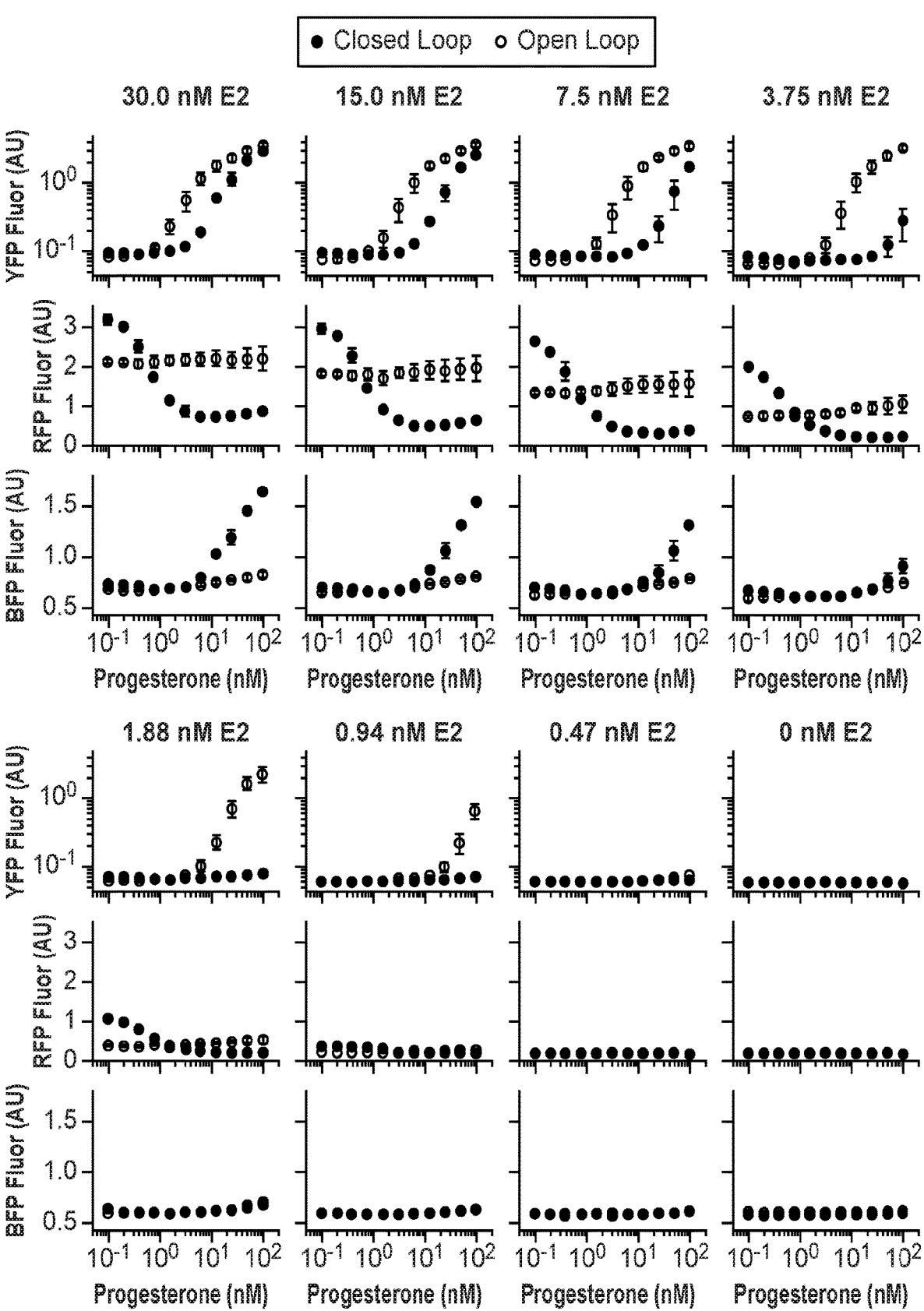
FIG. 33 depicts circuit behavior as a function of Pg for a fixed dose of E2.
Figure 34:
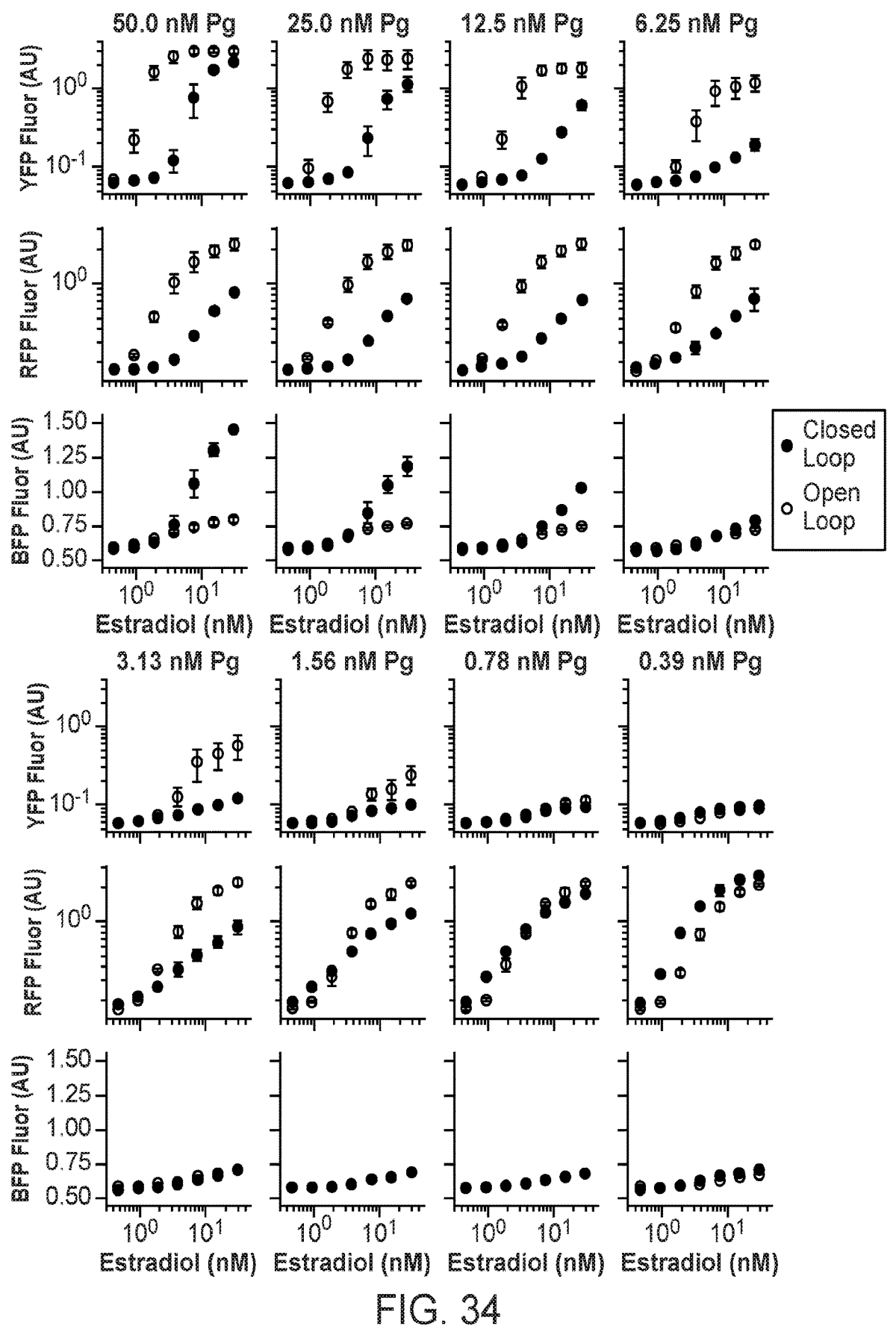
Figure 35:
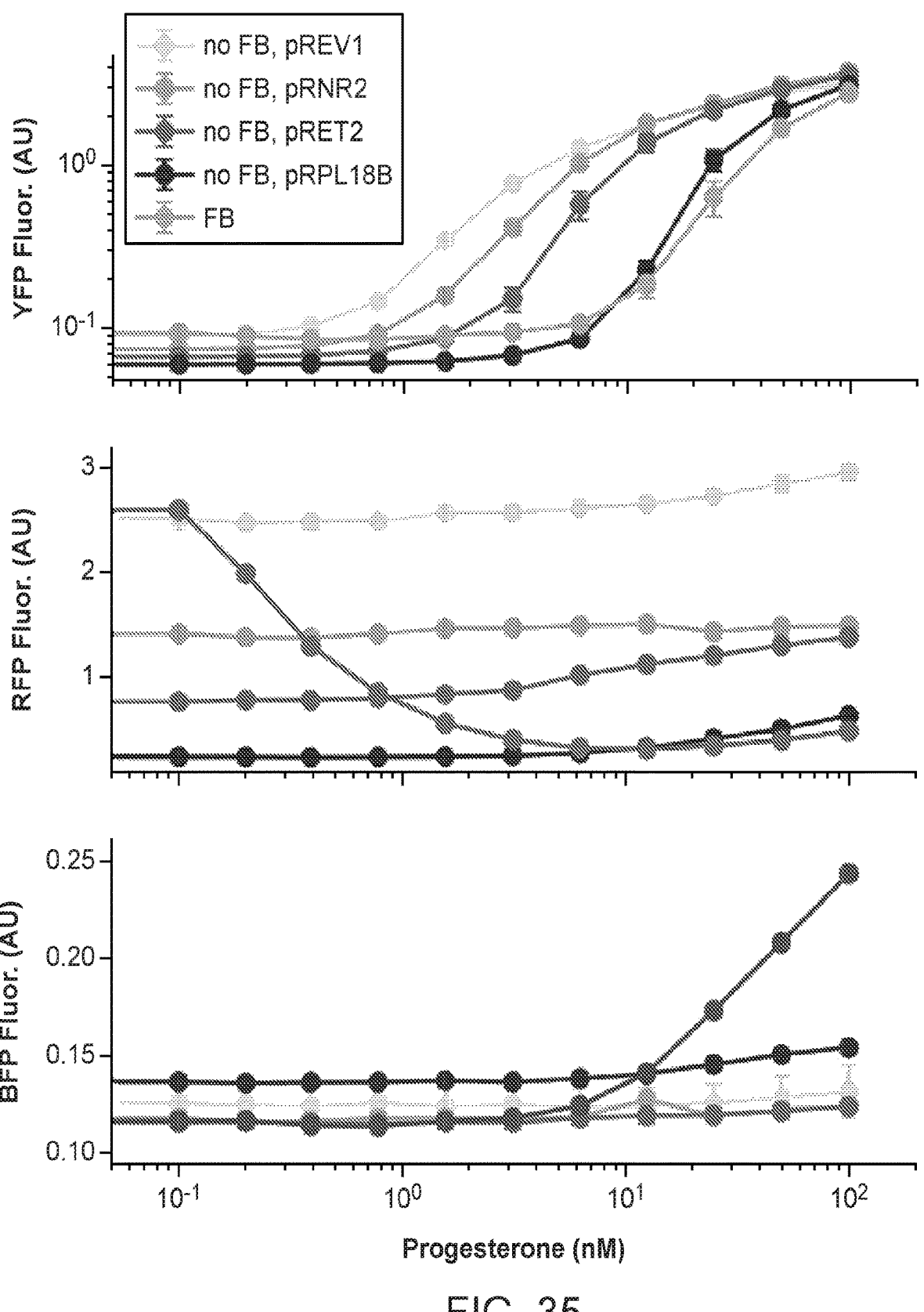
FIG. 35 depicts circuit behavior when expressing different amounts of key constitutively FIG. 36 demonstrates that the DegronLOCKR synthetic feedback strategy is predictably tunable. a) (Top) Exploring different methods to tune the feedback gain in the synthetic feedback circuit. (Bottom) Model simulation (see supplementary information) of circuit output and Z3PM as a function of Pg disturbance for decreasing key production rate or key/cage affinity. b & c) Experimental validation of tuning. b) (Top) Tuning feedback gain by varying the number of Z3 binding sites on pZ3 with the key at a fixed length. (Bottom) RFP and YFP fluorescence as a function of Pg for strong (pZ3-6x), medium (pZ3-4x), and weak (pZ3-3x) feedback strains versus no feedback (pREV1-key-CFP-NLS) strain. Points represent mean±s.d. of three biological replicates. c) (Top) Tuning feedback gain by varying the length of the key with the strength of the feedback promoter fixed at pZ3-6x. (Bottom) RFP and YFP fluorescence as a function of Pg for long (55 aa), medium (51 aa), and short (43 aa) key feedback strains versus no feedback (pREV1-NLS-key-CFP) strain. Points represent mean±s.d. of three biological replicates. d) Changing promoter strength and key length to tune feedback gain on the synthetic negative feedback loop in the mating pathway. pAGA1 is a stronger reporter of the mating pathway than pFIG1. e) (Top) Dynamic measurements of pAGA1-YFP-cODC for various feedback and no feedback strains following stimulation with 25 nM α-factor. Points represent flow cytometry measurements and lines represent a moving average taken over three data points. (Bottom) α-factor dose response of feedback strains versus a no feedback (pREV1-NLS-key-CFP) strain. YFP fluorescence was measured using flow cytometry four hours after α-factor induction. Points represent the mean of three biological replicates and error bars represent the standard error. Solid lines are a hill function fit to the data. The dose of α-factor used in the dynamic experiment (top) is indicated on the graph.

To further delineate the properties of the degronLOCK feedback module, the feedback and no feedback circuits were induced with the full range of E2 and Pg concentrations and measured pZ3-YFP-cODC output at steady-state using flow cytometry (FIG. 33 and FIG. 34). In these experiments, pGAL1-RFP was measured to gain more proximal information about the activity of GEM and thus the feedback action. At a fixed concentration of E2 (7.5 nM E2), increasing Pg leads to an increase in the YFP output of the no feedback circuit until saturation is reached (FIG. 35, FIG. 31, panel e). Because the key is expressed from a constitutive promoter in this strain, RFP fluorescence is insensitive to Pg. In contrast, RFP fluorescence decreases as a function of Pg in the synthetic feedback circuit, a result of degronLOCKR induced degradation of GEM. This effect eventually saturates above 6.25 nM Pg, as shown by the constant RFP expression beyond this concentration. The difference between these two regions of operation is clearly visible in the YFP output, which shows reduced sensitivity to Pg in the region of active feedback and a dramatic increase when feedback is saturated. These results are qualitatively recapitulated by the model, which shows the feedback saturating when the complex formation between the key and degSwitch saturates (FIG. 30 and FIG. 31).

Figure 36:
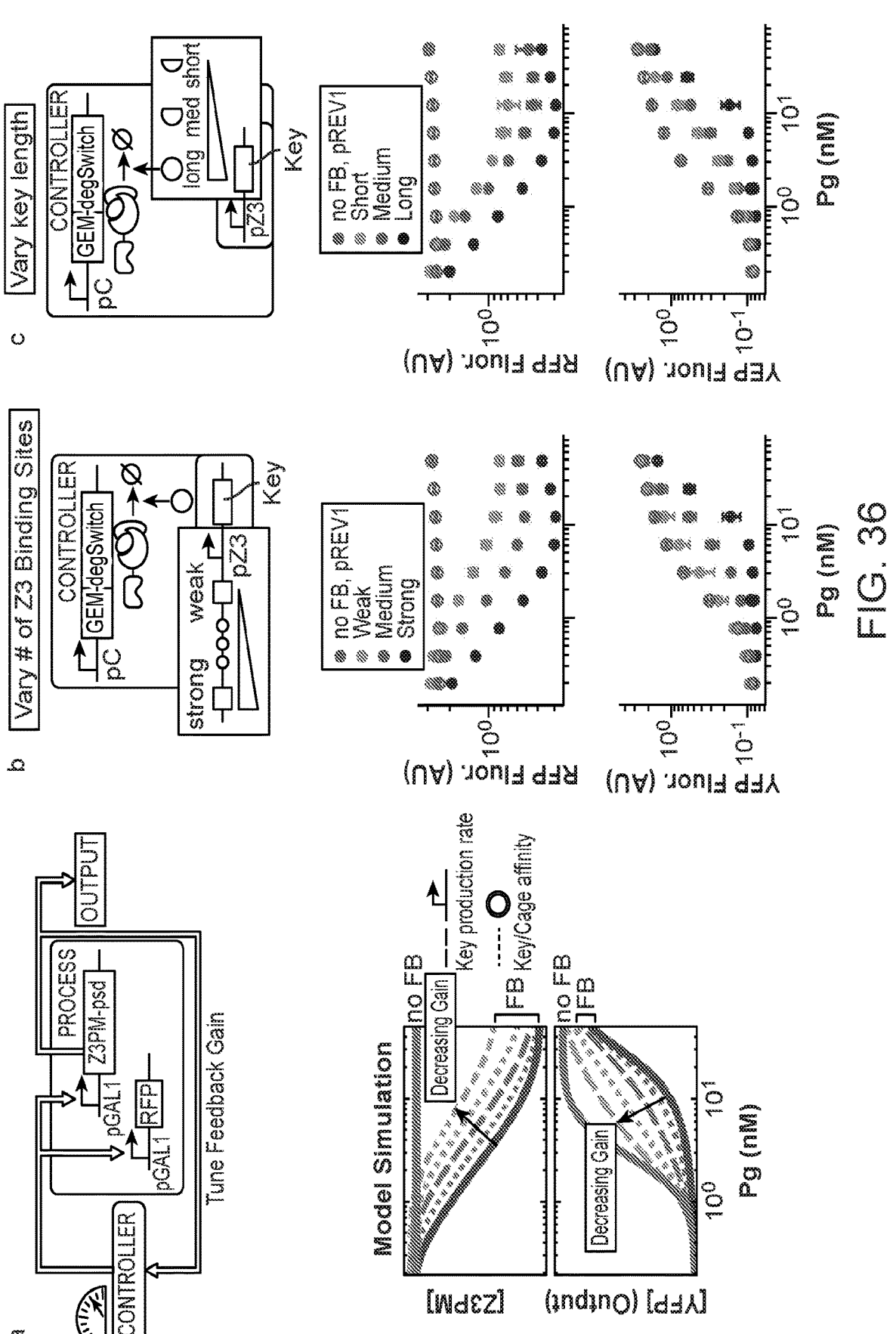
Figure 36:
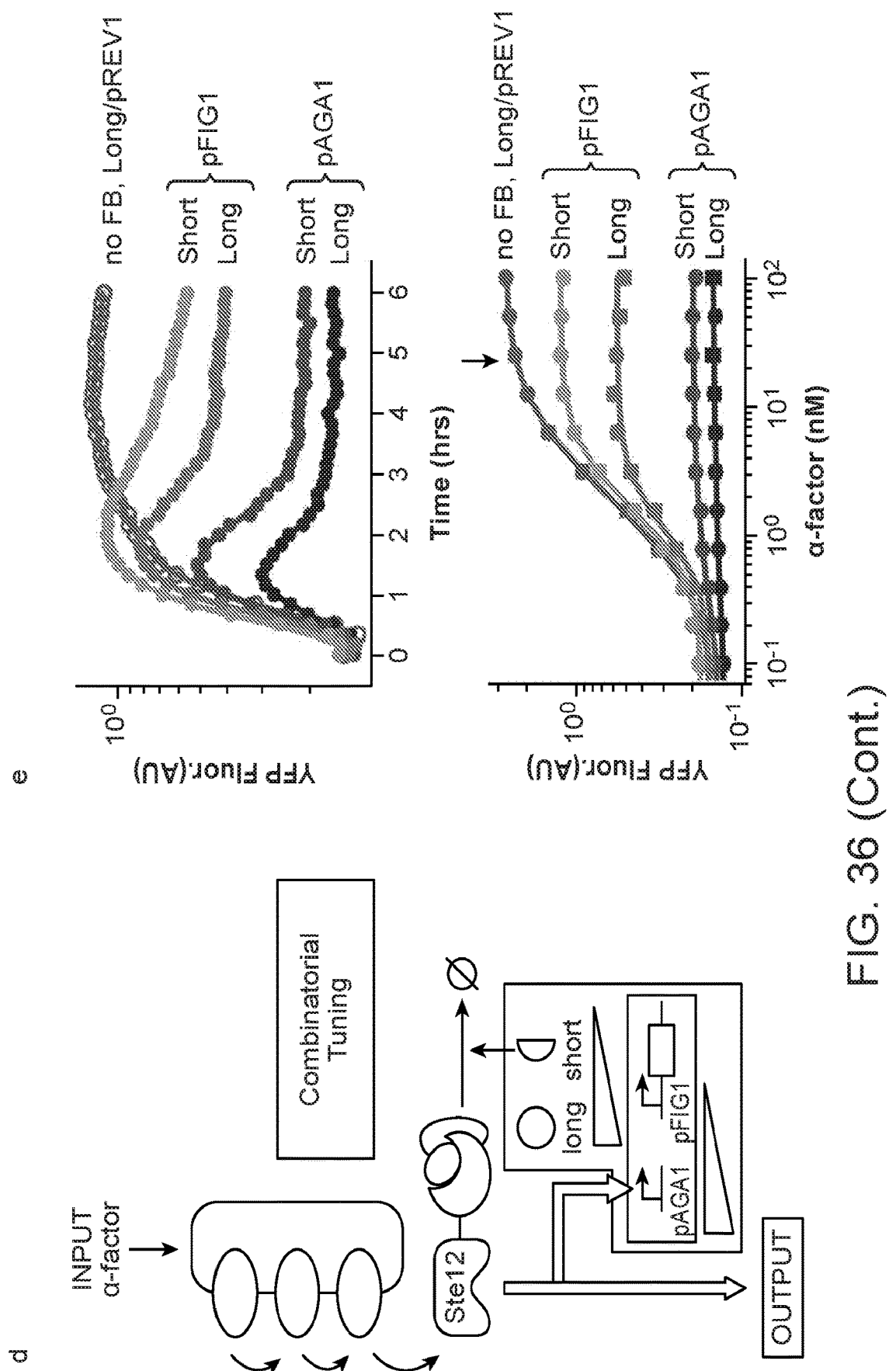
Figure 37:
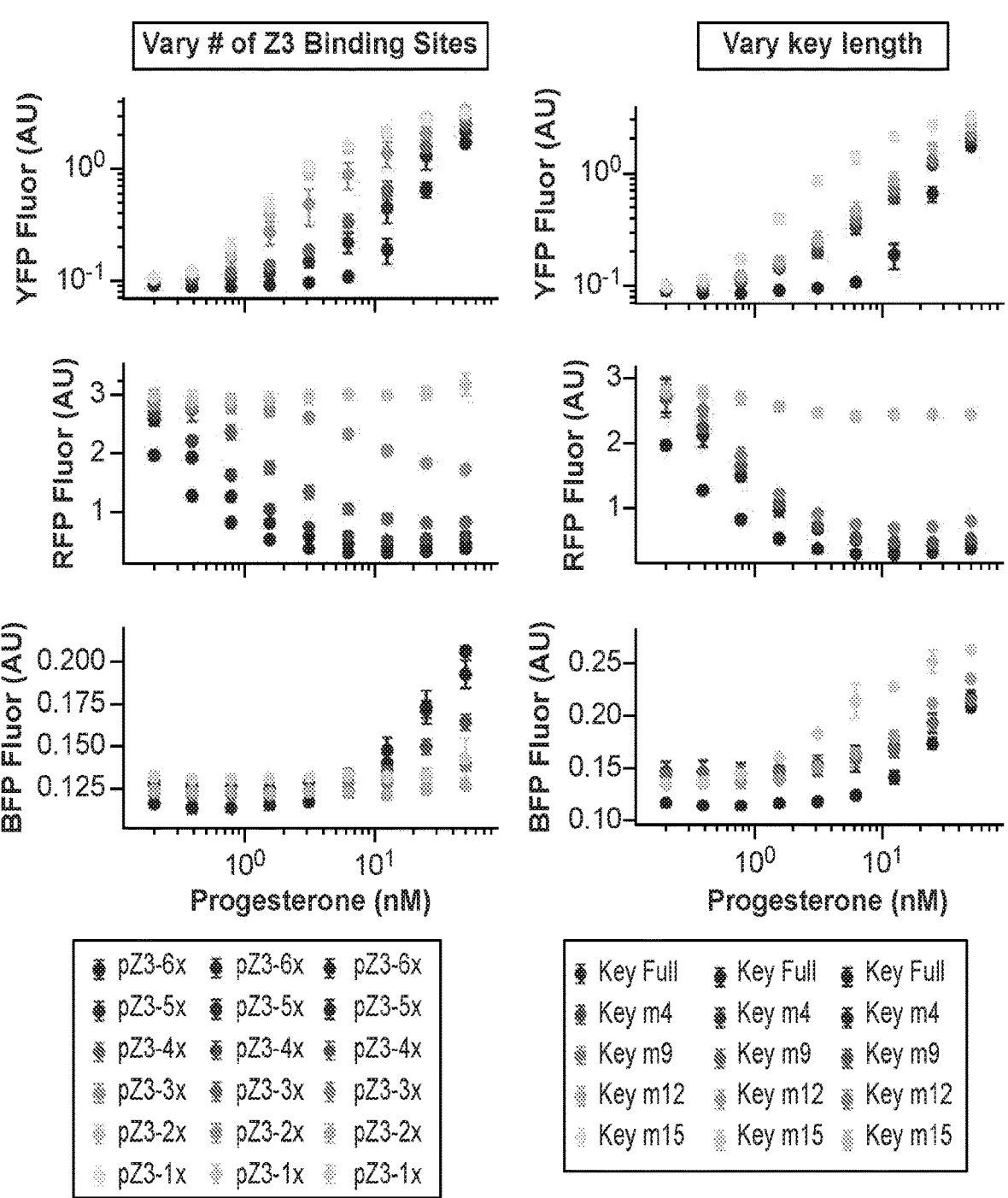
FIG. 37 demonstrates that changing promoter strength or key length modulates feedback gain.

Next the tunability degronLOCKR feedback control was investigated. An useful aspect of designed feedback controllers is the ability to tune the gain to suit the application. Two methods of tuning feedback gain were evaluated: changing the strength of the feedback promoter and changing the binding affinity of the key and cage (FIG. 36, panel a). The computational model predicts that both methods for tuning feedback gain are qualitatively similar and thus should be interchangeable (FIG. 36, panel b). To test this, medium and weak variants of the pZ3 promoter with four and three Z3 binding sites (BS), respectively, were created. To test the effect of weakening the feedback promoter strength, a Pg dose response at a fixed concentration of E2 of the different circuit variants was performed (FIG. 36, panel b). It was observed that weakening the promoter indeed changed the dependence of the steady-state output on Pg. As the number of binding sites was reduced, the output dose response for the feedback circuit converged to the circuit without feedback (FIG. 37). Next, the affinity of the key for the cage was decreased by decreasing the length of the key. The full-length key was truncated by four (medium) or 12 (short) residues and each key variant was tested in the feedback circuit using the full-strength pZ3 promoter (6×Z3 BS) (FIG. 36, panel c, FIG. 37). Similar to reducing the strength of the feedback promoter, a decrease in key length led to a change in the dependence of the steady-state output on Pg (FIG. 36, panel d). Reducing the strength of the feedback gain through either strategy also led to larger transients and reduced adaptation (FIG. 38). Tuning feedback gain through key length is an attractive alternative to promoter engineering, showcasing a unique strength of de novo proteins.

To show the generalizability of these tuning strategies, the mating pathway was revised and combinatorial tuning of the synthetic feedback loop was performed by changing both the strength of the feedback promoter and the length of the key (FIG. 36, panel d). Because pAGA1 is a much stronger promoter than FIG. 1, using pAGA1 to express the key generated a pulse of expression following induction with alpha-factor (FIG. 36, panel e). The size of the pulse, as well as the steady-state output following it were both increased by reducing the key length, which reduced the amount of feedback in the system. Similarly, reducing the key length while using the weaker promoter FIG. 1 to drive feedback yielded a larger transient and higher steady-state output. Measurement of steady-state output as a function of α-factor for different promoters and key lengths (FIG. 36, panel f, FIG. 39) clearly demonstrates that reducing promoter strength or key length increases the steady-state output of the pathway and the slope of the dose response, indicating reduced feedback gain. Taken together, these data demonstrate the facile tunability of the characteristics of the degronLOCKR feedback strategy.

The above represents a novel method for biological feedback control that can be used in a plug-and-play and tunable manner to control any biological network with a transcriptional output. This success highlights the value of degronLOCKR and de novo protein design for synthetic biology. These proteins, due to their de novo design, function across mammalian and plant species with minimal crosstalk for various applications, including therapeutics and biotechnology.

Methods

Construction of DNA Circuits

Hierarchical golden gate assembly was used to assemble plasmids for yeast strain construction according to Lee et al. (2015). Individual parts had their BsaI, BsmBI, and NotI cut sites removed to facilitate downstream assembly and linearization. Parts were either generated via PCR or purchased as gBlocks from IDT. These parts were then assembled into transcriptional units (promoter-gene-terminator) on cassette plasmids. These cassettes were then assembled together to form multi-gene plasmids for insertion into the yeast genome.

Yeast Strains and Growth Media

The base S. cerevisiae strain used in all experiments was BY4741 (MATa his3Δ1 leu2Δ0 met15Δ0 ura3Δ0). All yeast cultures were grown in YPD media (10 g/L Bacto Yeast Extract, 20 g/L Bacto peptone, 20 g/L dextrose). Selection of auxotrophic markers (URA3, LEU2, and/or HIS3) was performed on synthetic complete medium (6.7 g/L Bacto-yeast nitrogen base without amino acids, 2 g/L complete supplement amino acid mix, 20 g/L dextrose).

Knockouts of FAR1 and BAR1

A modified version of BY4741 (yAHN797) was created for the mating pathway experiments with FAR1 and BAR1 knocked out using the CRISPR/Cas9 method outlined in Lee et al. FAR1 was first targeted by two sgRNAs designed using the Benchling biology design tool to target the ORF of each gene. These sgRNAs were expressed on CEN6/ARS4 plasmids containing a Cas9 with two nuclear localization sequences and a URA3 auxotrophic marker. Repair DNA with homology to the 50 bp upstream and downstream of the ORF was generated by annealing oligos. A standard lithium acetate procedure was used to transform yeast with the plasmid containing sgRNA/Cas9 and repair DNA. The efficacy of sgRNA was assessed by comparing the number of colonies of transformants given repair DNA with respect to transformants that were not provided repair DNA. Colonies were screened by colony PCR to verify the knockout, and successful clones were grown in an overnight culture of YPD. 5 ul of overnight culture was then plated on synthetic complete medium containing 5-fluoroorotic acid (5-FOA) to counterselect the URA3 auxotrophic marker on the CEN6/ARS4 plasmid. The knockout process was then repeated to knock out BAR1.

Integration of degSwitch into Yeast Genome

Linear DNA consisting of degSwitch with a 5×GS linker and a URA3 auxotrophic marker was generated using overlap extension PCR. This linear DNA was then used as PCR template to add 80 bp of homology targeting the 3' end of the MAT pathway regulators GPA1, MSG5, SST2, STE5, STE7, STE11, and STE50. Individual lithium acetate yeast transformations were then performed using each of the linear DNA fragments to insert the degSwitch downstream of each of the seven genes into the parental strain yAHN797 and selectively plated on synthetic complete media lacking uracil. Insertions were confirmed using colony PCR.

Yeast Cell Culture and Induction

Yeast strains were streaked out from a glycerol stock on SDC plates with the appropriate auxotrophic marker, or YPD plates if no auxotrophic marker was present. Individual colonies from these plates were used to inoculate a culture in YPD to grow to saturation over 12-24 hours.

Alpha-Factor Induction

Saturated culture was diluted 1:500 in fresh YPD and 450 ul were aliquoted into individual wells of a 2 mL 96 well storage block (Corning) for a three hour outgrowth at 30 C and 900 RPM in a Multitron shaker (Infors HT). Alpha-factor mating pheromone was prepared at a 10× concentration by making the appropriate dilutions into YPD from a 50 uM stock solution (Zymo Research). After the 3 hour outgrowth, 50 ul of alpha-factor solution was added to the 96 well block and the block was returned to the shaker for a four hour growth.

Estradiol and Progesterone Induction

Saturated culture was diluted 1:500 in fresh YPD and 400 ul were aliquoted into individual wells of a 2 mL 96 well storage block (Corning) for a three hour outgrowth at 30 C and 900 RPM in a Multitron shaker (Infors HT). Estradiol (Sigma-Aldrich) and progesterone (Fisher Scientific) were prepared at a 10× concentration by making the appropriate dilutions into YPD from a 3.6 mM (estradiol) and 3.2 mM (progesterone) stock solution. After the three hour out-growth, 50 ul of estradiol and progesterone inducer were added to the 96 well block in the appropriate combinations and the block was returned to the shaker for a ten hour growth.

Yeast Culture

Saturated cultures were diluted 1:200, or 1:100 for mating pathway cultures, into 10 mL or 15 mL YPD. Cultures were grown for 2 hours in glass tubes at 30 C in a shaker. Cultures were then diluted to 0.01 OD600 and aliquoted into indi-vidual Falcon tubes at a total volume of 30 mL YPD. Another one hour outgrowth was performed in custom bioreactors at 30 C and stirred with magnetically-controlled stir bars. All cultures were grown in YPD at 0.5× Penicillin Streptomycin.

Hardware

In order to collect time-course measurements, a platform for automated flow cytometry and continuous culture was constructed. An existing automated experimental platform was adapted to perform small molecule induction at varying concentrations and long-term culturing. Yeast cultures were grown in 50 mL optically clear conical tubes (Falcon) that were held in eight temperature-controlled, magnetically stirred chambers. Liquid handling was accomplished using two syringe pumps (Cavro XCalibur Pump, TECAN) of a BD High-Throughput Sampler. This set-up allowed for sampling from individual cultures to a BD LSRII flow cytometer for measurement. To achieve continuously cul-turing, a specified volume of culture was first moved to waste and different ratios of hormone media and fresh media were added back. Commands to the HTS were controlled using LABVIEW 2013.

A sampling period consisted of three main steps: sample, extract dilution volume, and replenish dilution volume at respective hormone concentrations. During long time-course experiments, a sampling period was chosen to hold event rate near constant. A doubling time of 90 minutes was assumed, so 4 mL of culture was extracted and then replaced with fresh media and hormone every 25 minutes (dilution rate of $0.16\ mL min^{-1}$). Shorter experiments done on the mating pathway were not performed with continuous cul-turing, allowing for a higher sampling frequency of every 10 minutes.

Estradiol and Progesterone Induction (One Induction)

To study conditions where [E2] and [Pg] concentrations maintained the same throughout the experiment, only one induction was needed. Three stocks were created: (1) inducer, (2) refill stock at 1× [E2] and 1× [Pg] concentration, and (3) refill stock without hormone. During the induction timepoint, cultures were induced to respective concentra-tions by different ratios of (1) and (3). Cultures were held at their respective concentrations by adjusted ratios of (2) and (3).

Estradiol and Progesterone Induction (Two Induction)

To study disturbance rejection at same [E2] but different [Pg], cultures were induced twice. The first induction allowed all cultures to grow to steady state at the same pre-disturbance concentration. After cultures reached steady state (t=0 hrs), cultures were induced with more Pg or kept at the same concentration, and allowed to grow to steady-state again. Four stocks were created: (1) inducer to achieve pre-disturbance concentration, (2) inducer to achieve differ-ent disturbance [Pg], (3) refill stock at 1× [E2]/[Pg] to maintain desired concentrations, and (4) refill stock at 1× [E2] but without Pg. Cultures were induced at t=−10 hr with (1). All cultures were held at the same pre-disturbance concentration for 10 hours by replenishing with a 1:8 dilution between (3) and (4). At t=0, cultures were induced with different ratios of (2) and (4). Concentrations were maintained by adjusted ratios of (3) and (4), so that the highest disturbance [Pg] was achieved without dilution and the lowest [Pg] maintained with a 1:8 dilution.

Alpha Factor Induction

To study the dynamic response of degronLOCKR medi-ated feedback on the mating pathway, cultures were induced with input (alpha-factor) at t0. Different concentrations were achieved combining different volumes of a YPD 1×25 nM alpha-factor stock and YPD without alpha-factor.

Light Induction

Each bioreactor is equipped with an individual blue LED that is connected to a USB controllable LED driver (Migh-tex). Starting at light induction timepoint, cultures were exposed to a saturating light dose (45 seconds on/15 seconds off with an intensity amplitude of 25 mA). This light regime was maintained until expression reached steady-state.

Flow Cytometry

Analysis of fluorescent protein reporter expression was performed with a BD LSRII flow cytometer (BD Biosci-ences) equipped with a high-throughput sampler. Cultures were diluted in TE before running through the instrument to obtain an acceptable density of cells. YFP (Venus) fluores-cence was measured using the FITC channel, RFP (mKate2) was measured using the PE-Texas Red channel (for steady-state measurements) or mCherry channel (for dynamic mea-surements), and CFP was measured using the DAPI channel. For steady-state measurements, 5,000-10,000 events were collected per sample. For dynamic measurements, samples 2,000-10,000 events were collected per sampled. Fluores-cence values were calculated as the height (H) measurement for the appropriate channel and normalized to cell size by dividing by side scatter (SSC-H).

FIG. 28. degronLOCKR is a modular tool for controlling biological pathways. a) Schematic of degronLOCKR as a modular tool to implement synthetic feedback control on an endogenous or synthetic biological network by fusing the degSwitch to an effector molecule and driving the expres-sion of the key from the output of the network. b) Simplified schematic of the yeast mating pathway not showing complex endogenous feedback. Pathway is activated by addition of α-factor and signaling activity is measured using a pAGA1-YFP-cODC reporter. c) degronLOCKR induced degradation of positive signaling molecules to control mating pathway activity. The endogenous copy of indicated signaling mol-ecule was fused to degSwitch and key was expressed using a progesterone inducible system. Cells were induced with a saturating dose of α-factor and pathway activity with and without key was compared. pAGA1-YFP-cODC was mea-sured on a flow cytometer after four hours of growth. Data represent mean±s.d. of three biological replicates.

FIG. 30. degronLOCKR module successfully implements synthetic feedback control of the mating pathway a) Sche-matic of synthetic negative feedback where the endogenous copy of STE12 is fused to the degSwitch and either the pathway reporter FIG. 1 (synthetic feedback) or a constitu-tive promoter (no feedback) is used to express key-CFP-NLS. All output measurements are for pAGA1-YFP-cODC.

b) Measurements of pAGA1-YFP-cODC dynamics. Synthetic feedback and no feedback (pREV1) strains were induced with a high (25 nM), medium (6.25 nM), or low (3.13 nM) dose of α-factor at time t=0 hr and flow cytometry measurements (points) were performed every 10 minutes. Lines represent a moving average taken over three data points. c) α-factor dose response of synthetic feedback (FIG. 1) and four no feedback (no key, pREV1, pRNR2, pRET2) strains. pAGA1-YFP-cODC fluorescence was measured using flow cytometry four hours after α-factor induction. Points represent the mean±s.d. of three biological replicates. Solid lines are a hill function fit to the data. High, medium, and low doses of α-factor from the experiment in (b) are indicated on the graph.

FIG. 31. Operational properties of degronLOCKR feedback module quantified via control of a synthetic circuit a) Schematic of synthetic feedback circuit. GEM-degSwitch is expressed constitutively and is activated by estradiol (E2) to drive expression of pGAL1-Z3PM-psd. Z3PM is activated by progesterone (Pg) to drive expression from pZ3. Blue light can be used to induce degradation of Z3PM-psd. pZ3-YFP-cODC is the measured output of the circuit, and pZ3-key-CFP-NLS drives feedback (synthetic feedback) in the circuit by activating degradation of GEM-degSwitch. In the circuit with no feedback a constitutive promoter is used to express key-CFP-NLS. b) Model simulation (see supplementary information) of the feedback and no feedback circuits. The simulated dynamics (left) and change of steady-state (right) of output following a Pg disturbance indicate that feedback buffers against increasing Pg concentration by degrading GEM and reducing Z3PM concentration. c) Dynamic measurements of pZ3-Venus-cODC using automated flow cytometry for the synthetic feedback and no feedback strains (pRNR2-key-CFP-NLS) following a positive disturbance. Cells were grown to steady-state expression in 0.78 nM Pg and 7.5 nM E2. At time 0 hrs cells were either kept at the same Pg concentration or induced to a new final concentration of 1.56 nM (low), 3.13 nM (med), or 6.25 nM (high) Pg. Dynamics were measured for another eight hours. Solid line represents a moving average taken over three data points. d) Dynamic measurements of pZ3-Venus-cODC using automated flow cytometry for the synthetic feedback and no feedback strains (pRPL18B-key-CFP-NLS driving key) following a negative disturbance. Cells were grown to steady-state expression in 1.57 nM Pg and 30 nM E2 then subjected to blue-light at time 0 hrs to activate the psd. Dynamics were measured for eight hours post-disturbance. Growth and sampling conditions are as in c). e) Precision of the synthetic feedback versus no feedback circuits to each of the disturbances. f) Comparison of steady-state circuit behavior (ten hours after stimulation) with and without feedback (pRNR2-key-CFP-NLS) as a function of Pg at a fixed concentration of 7.5 nM E2. RFP fluorescence is a proxy for Z3PM concentration and YFP fluorescence is the output of the circuit. Pg doses used for positive disturbance in c) are indicated. Points represent mean±s.d. of three biological replicates.

FIG. 36. DegronLOCKR synthetic feedback strategy is predictably tunable a) (Top) Exploring different methods to tune the feedback gain in the synthetic feedback circuit. (Bottom) Model simulation (see supplementary information) of circuit output and Z3PM as a function of Pg disturbance for decreasing key production rate or key/cage affinity. b & c) Experimental validation of tuning. b) (Top) Tuning feedback gain by varying the number of Z3 binding sites on pZ3 with the key at a fixed length. (Bottom) RFP and YFP fluorescence as a function of Pg for strong (pZ3-6x), medium (pZ3-4x), and weak (pZ3-3x) feedback strains versus no feedback (pREV1-key-CFP-NLS) strain. Points represent mean±s.d. of three biological replicates. c) (Top) Tuning feedback gain by varying the length of the key with the strength of the feedback promoter fixed at pZ3-6x. (Bottom) RFP and YFP fluorescence as a function of Pg for long (55 aa), medium (51 aa), and short (43 aa) key feedback strains versus no feedback (pREV1-NLS-key-CFP) strain. Points represent mean±s.d. of three biological replicates. d) Changing promoter strength and key length to tune feedback gain on the synthetic negative feedback loop in the mating pathway. pAGA1 is a stronger reporter of the mating pathway than FIG. 1. e) (Top) Dynamic measurements of pAGA1-YFP-cODC for various feedback and no feedback strains following stimulation with 25 nM α-factor. Points represent flow cytometry measurements and lines represent a moving average taken over three data points. (Bottom) α-factor dose response of feedback strains versus a no feedback (pREV1-NLS-key-CFP) strain. YFP fluorescence was measured using flow cytometry four hours after α-factor induction. Points represent the mean of three biological replicates and error bars represent the standard error. Solid lines are a hill function fit to the data. The dose of α-factor used in the dynamic experiment (top) is indicated on the graph.

FIG. 29: Panel of mating pathway regulators tested with degronLOCKR. degSwitch was fused to the C-terminus of the endogenous copy of each regulator. Key with or without SV40 NLS was expressed using a Pg inducible system. STE20, STE11, and PTP3 were degraded using cytoplasmic key (Key-CFP), and STE12, DIG1 and DIG2 were degraded using nuclear key (Key-CFP-NLS). MSG5 and FUSS were degraded using either cytoplasmic (cyto) or nuclear (nuc) key. Cells were induced with 1 nM (low) or 100 nM (high) α-factor and 50 nM or 0 nM Pg and grown for four hours before YFP fluorescence was measured using a flow cytometer. Data represent mean±s.d. of three biological replicates.

FIG. 32: Steady state solutions in response to positive or negative disturbances. Steady values as a) progesterone (Pg) or b) ZPM degradation rate (yz) change according to our Hill-like model. Continuous lines correspond to the feedback system (FB), while the dashed line shows an example where the feedback has been removed (i.e. $f_K = \mu_{K^*}$ instead of Eq.12; No FB). The gray box delimits the area where the feedback is considered "active", which is defined by the relative change in total GEM ($\Delta(G+C)/(G+C)$) over the relative change of the disturbance (either a) $\Delta P/P$ or b) $\Delta \gamma_z/\gamma_z$) is higher than 0.15. Noteworthy, in the absence of feedback, $\Delta(G+C)$ is equal zero for any disturbance except on the synthesis or degradation rate of the key or GEM directly.

FIG. 33: Circuit behavior as a function of Pg for a fixed dose of E2. Comparison of steady-state circuit behavior (ten hours after stimulation) with and without feedback (pRNR2-key-CFP-NLS) as a function of Pg at all concentrations of E2. YFP fluorescence is the output of the circuit, RFP fluorescence is a proxy for Z3PM concentration, and BFP fluorescence is the amount of key produced. Points represent mean±s.d. of three biological replicates.

FIG. 34: Circuit behavior as a function of E2 for a fixed dose of Pg. Comparison of steady-state circuit behavior (ten hours after stimulation) with and without feedback (pRNR2-key-CFP-NLS) as a function of E2 at all concentrations of Pg. YFP fluorescence is the output of the circuit, RFP fluorescence is a proxy for Z3PM concentration, and BFP fluorescence is the amount of key produced. Points represent mean±s.d. of three biological replicates.

FIG. 35: Circuit behavior when expressing different amounts of key constitutively. Comparison of steady-state circuit behavior (ten hours after stimulation) with feedback and various levels of key expression without feedback (pREV1, pRNR2, pRET2, pRPL18B) as a function of Pg at a fixed concentration of 7.5 nM E2. YFP fluorescence is the output of the circuit, RFP fluorescence is a proxy for Z3PM concentration, and BFP fluorescence is the amount of key produced. Points represent mean±s.d. of three biological replicates.

FIG. 37: Changing promoter strength or key length modulates feedback gain. Comparison of steady-state circuit behavior (ten hours after stimulation) for various levels of feedback gain (left, tuning via changing feedback promoter strength; right, tuning via changing key length) as a function of Pg at a fixed concentration of 7.5 nM E2. Left, tuning via changing feedback promoter strength (x refers to number of Z3 operator sites); right, tuning via changing key length (m refers to number of residues removed from C-terminus of key). YFP fluorescence is the output of the circuit, RFP fluorescence is a proxy for Z3PM concentration, and BFP fluorescence is the amount of key produced. Points represent mean±s.d. of three biological replicates.

FIG. 38: Tuning feedback strength changes dynamic behavior of circuit output. Dynamic measurements of pZ3-Venus-cODC using automated flow cytometry for the synthetic feedback strain with various gains and no feedback strain (pREV1-key-CFP-NLS) following induction with 3.13 nM Pg and 7.5 nM E2 at time=0 hrs. Solid line represents a moving average taken over three data points.

FIG. 39: Combinatorial tuning of synthetic feedback in mating pathway. (Top) Dynamic measurements of pAGA1-YFP-cODC for various feedback and no feedback (pREV1, pRNR2, pRET2, pRPL18B) strains following stimulation with 25 nM α-factor. Points represent flow cytometry measurements and lines represent a moving average taken over three data points. (Bottom) α-factor dose response of feedback strains versus no feedback (pREV1, pRNR2, pRET2, pRPL18B) strains. YFP fluorescence was measured using flow cytometry four hours after α-factor induction. Points represent mean±s.d. of three biological replicates. Solid lines are a hill function fit to the data.

Example 3: degronLOCKR Functions in Human Primary T Cells

The ability of degronLOCKR to function in human primary T cells was demonstrated by inducibly degrading a mCherry fluorescent protein. Lentiviral transfer constructs were constructed containing mCherry fused to the asymmetric short scaffold degronSwitch with a t8 toehold and cODC degron embedded in the latch. The mCherry-degronSwitch fusion was expressed using pPGK constitutive promoter. In a second lentiviral construct a fusion of Key to tagBFP was expressed using four different constitutive promoters (pPGK, pSFFV, pCMV(G), pCMV(D)).

Experiments were performed in human primary CD4+ T cells. Cells were transduced with different combinations of the aforementioned lentiviruses. In one instance, cells were transduced with only mCherry-degronSwitch. In others, cells received both the mCherry-degronSwitch virus in addition to a virus expressing Key-tagBFP. After lentiviral transduction, fluorescence was measured using flow cytometry. Distributions are shown in FIG. 41. We observed that mCherry fluorescence was nearly completely abolished when cells were co-transduced with a virus containing any amount of Key production (Key production was quantified using tagBFP fluorescence). This data indicates that the Key is able to trigger the degronSwitch and activate degradation of mCherry.

Example 4: degronLOCKR-Mediated Feedback Functions in Jurkat T Cells

An inducible humanized synthetic transcription factor ZF3-p65-Ert2 (ZPE) was used as the model process to test whether feedback mediated by degronLOCKR would be functional in human T cells (inducible TF gift of Mo Khalil, Boston U). The output of the circuit is a mCherry fluorescent reporter produced by a pZF3 promoter, and ZPE fused to the degronSwitch is driven by a pSFFV constitutive promoter. Two versions of the circuit were constructed, one with no feedback, and one with feedback through the key. The circuit with feedback has the key driven by a separate pZF3 promoter and is fused to a mEGFP. Several variants of this feedback circuit were tested by mixing and matching different pZF3 promoter variants and key lengths. These experiments were performed by stably integrating the constructs into Jurkat T cells using lentivirus. Cells that received the circuit were gated out as mCherry positive (the pZF3 (4x)_mCMV promoter is leaky) and for the feedback version, BFP positive.

This experiment was performed by inducing cells with a range of tamoxifen (4OHT), which activates the ZPE transcription factor by translocating it into the nucleus. Cells were measured 5 days post-induction using flow cytometry. Sample distributions are shown in FIG. 42 for the circuit output and Key production for the circuit with Feedback.

Figure 43:
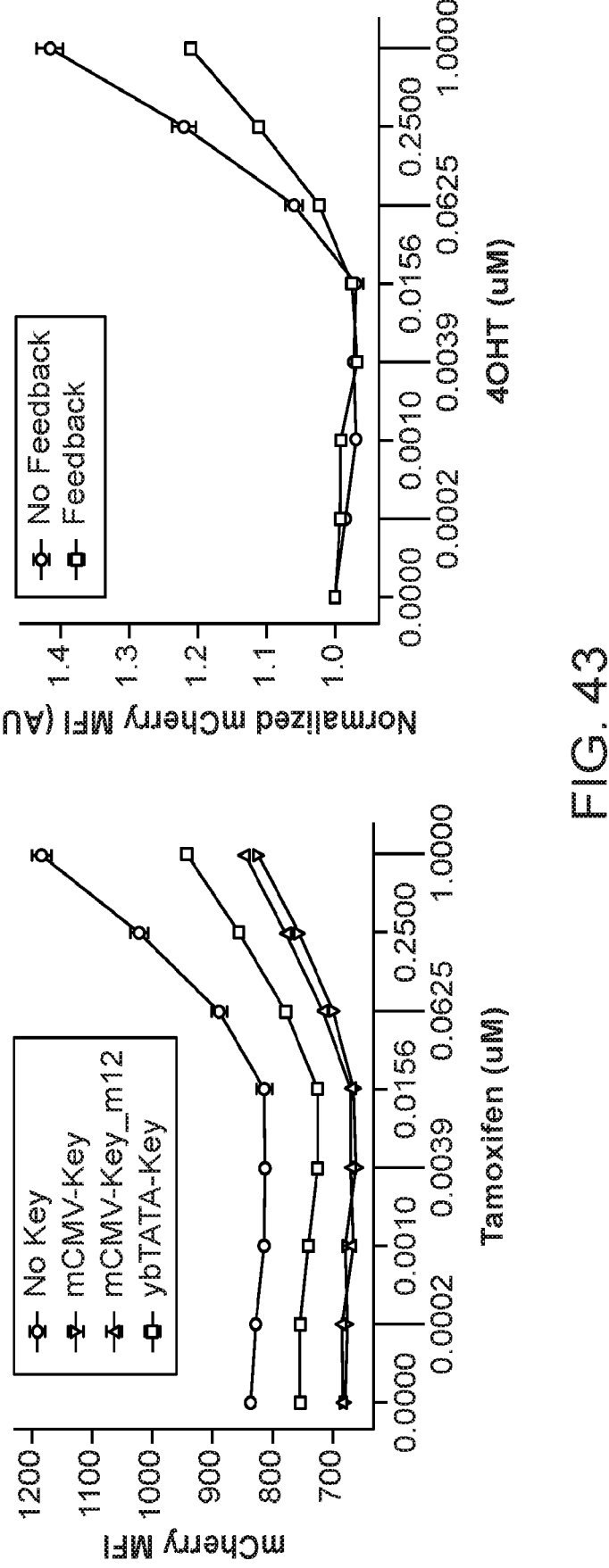
FIG. 43 shows a comparison of output for different feedback variants (left panel) and a normalized output for circuit with no feedback and feedback circuit with mCMV-Key (right panel).

The dose response of the no feedback and feedback circuits for a full range of 4OHT concentrations were compared. It appears that buffering from feedback can be tuned by changing the promoter or key length, similar to the effects previously observed in yeast. When observing the feedback off of the mCMV promoter driving full length key, we can see that the presence of feedback both reduces the maximal steady-state output and also reduces the slope of the dose-response (FIG. 43). These characteristics are classic hallmarks of feedback and suggest that our feedback circuit is having an effect on the circuit. In the future, mCherry could be replaced with a payload of interest. Our feedback circuits could perform both disturbance rejection and tune the dynamics of T cell activation (i.e., production of CAR) or delivery of a therapeutic payload.

While the present invention has been described with reference to the specific embodiments thereof, it should be understood by those skilled in the art that various changes may be made and equivalents may be substituted without departing from the true spirit and scope of the invention. In addition, many modifications may be made to adapt a particular situation, material, composition of matter, process, process step or steps, to the objective, spirit and scope of the present invention. All such modifications are intended to be within the scope of the claims appended hereto.

SEQUENCE LISTING (28220 sequences)

SEQ ID NO: 1 - protein, 350 aa, Artificial Sequence
  Synthetic sequence.
SKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIARVKRESKRIVEDAERLPMSCAQESEKISREAERLIREAA

SEQ ID NO: 2 - protein, 350 aa, Artificial Sequence
  Synthetic sequence.
SKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIARVKRESKRIVEDAERLAMSCAQESEKISREAERLIREAA

SEQ ID NO: 3 - protein, 350 aa, Artificial Sequence
  Synthetic sequence.
SKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIARVKRESKRIVEDAERLIRECAAASEKISREAERLIREAA

SEQ ID NO: 4 - protein, 347 aa, Artificial Sequence
  Synthetic sequence.
SKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIARVKRESKRIVEDLIMSCAQESAASEKISREAERLIR

SEQ ID NO: 5 - protein, 343 aa, Artificial Sequence
  Synthetic sequence.
SKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIARVKRESKRLVMSCAQESREAAAASEKISREAE

SEQ ID NO: 6 - protein, 228 aa, Artificial Sequence
  Synthetic sequence.
NKEDATEAQKKAIRAAEELLKDVTRIQERAIREAEKALERLARVQEEAIRRVYEAVESKNKEELKKVKEEIEELLRRLKRELDELEREIRELLKEIKEKADRLEKEIRDLIERIRRDRNASDEVVTRLARLNEELIRELREDVRRLAELNKELLRELERAARELARLNEKLLELADRVETEEEARKAIARVKRESKRIVEDAERLAMSCAQESEKISREAERLIREAA

SEQ ID NO: 7 - protein, 225 aa, Artificial Sequence
  Synthetic sequence.
NKEDATEAQKKAIRAAEELLKDVTRIQERAIREAEKALERLARVQEEAIRRVYEAVESKNKEELKKVKEEIEELLRRLKRELDELEREIRELLKEIKEKADRLEKEIRDLIERIRRDRNASDEVVTRLARLNEELIRELREDVRRLAELNKELLRELERAARELARLNEKLLELADRVETEEEARKAIARVKRESKRIVEDLIMSCAQESAASEKISREAERLIR

SEQ ID NO: 8 - protein, 232 aa, Artificial Sequence
  Synthetic sequence.
DERLKRLNERLADELDKDLERLLRLNEELARELTRAAEELRELNEKLVELAKKLQGGRSREVAERAEKEREKIRRKLEEIKKEIKEDADRIKKRADELRRRLEKTLEDAARELEKLKREPRTEELKRKATELQKEAIRRAEELLKEVTDVQRRAIERAEELLEKLARLQEEAIRTVYLLVELNKVDRARKAIARVKRESKRIVEDAERLAMSCAQESEKISREAERLIREAA

SEQ ID NO: 9 - protein, 229 aa, Artificial Sequence
  Synthetic sequence.
DERLKRLNERLADELDKDLERLLRLNEELARELTRAAEELRELNEKLVELAKKLQGGRSREVAERAEKEREKIRRKLEEIKKEIKEDADRIKKRADELRRRLEKTLEDAARELEKLKREPRTEELKRKATELQKENIRRAEELLKEVTDVQRRNIERAEELLEKLARLQEENIRTVYLLVELNKVDRARKAIARVKRESKRIVEDLIMSCAQESAASEKISREAERLIR

SEQ ID NO: 10 - protein, 359 aa, Artificial Sequence
  Synthetic sequence.
SKEAAKKLQDLNIELARKLLEASTKLQRLNIRLAEALLEAIARLQELNLELVYLAVELTDPKRIRDEIKEVKDKSKEIIRRAEKEIDDAAKESKKILEEARKAIRDAAEESRKILEEGSGSGSDALDELQKLNLELAKLLLKAIAETQDLNLRAAKAFLEAAAKLQELNIRAVELLVKLTDPATIRRALEHAKRRSKEIIDEAERAIRAAKRESERIIEEARRLIEKAKEESERIIREGSGSGDPDIKKLQDLNIELARELLRAHAQLQRLNLELLRELLRALAQLQELNLDLLRLASELTDPDEARKAIARVKRESKRIVEDAERLSREAAALSMSCAQESERSIREAAAASEKISRE

SEQ ID NO: 11 - protein, 353 aa, Artificial Sequence
  Synthetic sequence.
SKEAAKKLQDLNIELARKLLEASTKLQRLNIRLAEALLEAIARLQELNLELVYLAVELTDPKRIRDEIKEVKDKSKEIIRRAEKEIDDAAKESKKILEEARKAIRDAAEESRKILEEGSGSGSDALDELQKLNLELAKLLLKAIAETQDLNLRAAKAFLEAAAKLQELNIRAVELLVKLTDPATIRRALEHAKRRSKEIIDEAERAIRAAKRESERIIEEARRLIEKAKEESERIIREGSGSGDPDIKKLQDLNIELARELLRAHAQLQRLNLELLRELLRALAQLQELNLDLLRLASELTDPDEARKAIARVKRESKRIVEDAERLSMSCAQESEKISREAERSIREAAAAS

SEQ ID NO: 12 - protein, 288 aa, Artificial Sequence
  Synthetic sequence.
SELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARVKRESKRIVEDLEMSCAQESAASEKISREAERLIR

SEQ ID NO: 13 - protein, 283 aa, Artificial Sequence
  Synthetic sequence.
SELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARVKRESKRLVMSCAQESREAAAASEKISREA

SEQ ID NO: 14 - protein, 280 aa, Artificial Sequence
  Synthetic sequence.
SELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARVKRLSMSCAQESERLIREAAAASEKIK

SEQ ID NO: 15 - protein, 277 aa, Artificial Sequence
  Synthetic sequence.
SELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARLKMSCAQESEDAERLIREAAAASE

SEQ ID NO: 16 - protein, 353 aa, Artificial Sequence
  Synthetic sequence.
SHAAVIKLSDLNIRLLDKLLQAVIKLTELNAELNRKLIEALQRLFDLNVALVHLAAELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSNDPQVAQNQETFIELARDALRLVAENQEAFIEVARLTLRAAALAQEVAIKAVEAASEGGSGSGPNKEEIEKLAKEAREKLKKAEKEHKMSCAQERKKNKKAREDLKKKADK

SEQ ID NO: 17 - protein, 349 aa, Artificial Sequence
  Synthetic sequence.
SHAAVIKLSDLNIRLLDKLLQAVIKLTELNAELNRKLIEALQRLFDLNVALVHLAAELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSNDPQVAQNQETFIELARDALRLVAENQEAFIEVARLTLRAAALAQEVAIKAVEAASEGGSGSGPNKEEIEKLAKEAREKLKKAEMSCAQEHDKLRKKNKKAREDLKK

SEQ ID NO: 18 - protein, 353 aa, Artificial Sequence
  Synthetic sequence.
SLEAVLKLAELNLKLSDKLAEAVQKLAALLNKLLEKLSEALQRLFELNVALVTLAIELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSNDPLVARLQELLIEHARELLRLVATSQEIFIELARAFLANAAQLQEAAIKAVEAASENGSGSGPSSEKVRRELKESLKENHKQNQKLLMSCAQEQEKLNRELEELKKKHKK

SEQ ID NO: 19 - protein, 349 aa, Artificial Sequence
  Synthetic sequence.
SLEAVLKLAELNLKLSDKLAEAVQKLAALLNKLLEKLSEALQRLFELNVALVTLAIELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSNDPLVARLQELLIEHARELLRLVATSQEIFIELARAFLANAAQLQEAAIKAVEAASENGSGSGPSSEKVRRELKESLKENHKQNMSCAQEHKRAQEKLNRELEELKK

SEQ ID NO: 20 - protein, 229 aa, Artificial Sequence
  Synthetic sequence.
LIERLTRLEKEHVRELKRLLDTSLEILRRLVEAFETNLRQLKEALKRALEAANLHNEEVEEVLRKLEEDLRRLEEELRKTLDDVRKEVKRLKEELDKRIKEVEDELRKIKEKLKKGDKNEKRVLEEILRLAEDVLKKSDKLAKDVQERARELNEILEELSRKLQELFERVVEEVTRNVPTTERIEKVRRELKESLKENHKQNQKLLMSCAQEQEKLNRELEELKKKHKK

SEQ ID NO: 21 - protein, 225 aa, Artificial Sequence
  Synthetic sequence.
LIERLTRLEKEHVRELKRLLDTSLEILRRLVEAFETNLRQLKEALKRALEAANLHNEEVEEVLRKLEEDLRRLEEELRKTLDDVRKEVKRLKEELDKRIKEVEDELRKIKEKLKKGDKNEKRVLEEILRLAEDVLKKSDKLAKDVQERARELNEILEELSRKLQELFERVVEEVTRNVPTTERIEKVRRELKESLKENHKLNMSCAQEHKRAQEKLNRELEELKK

SEQ ID NO: 22 - protein, 233 aa, Artificial Sequence
  Synthetic sequence.
SEERVLELAEEALRLSDEAAKEIQELARRLNEELEKLSKELQDLFERIVETVTRLIDADEETLKRAAEEIKKRLEDARKKAKEAADKAREELDRARKKLKELVDEIRKKAKDALEKAGADEELVARLLRLLEEHARELERLLRTSARIIERLLDAFRRNLEQLKEAADKAVEAAEEAVRRVEDVRVWSEKVRRELKESLKENHKQNQKLLMSCAQEQEKLNRELEELKKKHKK

SEQ ID NO: 23 - protein, 229 aa, Artificial Sequence
  Synthetic sequence.
SEERVLELAEEALRLSDEAAKEIQELARRLNEELEKLSKELQDLFERIVETVTRLIDADEETLKRAAEEIKKRLEDARKKAKEAADKAREELDRARKKLKELVDEIRKKAKDALEKAGADEELVARLLRLLEEHARELERLLRTSARIIERLLDAFRRNLEQLKEAADKAVEAAEEAVRRVEDVRVWSEKVRRELKESLKENHKLNMSCAQEHKRAQEKLNRELEELKK

SEQ ID NO: 24 - protein, 353 aa, Artificial Sequence
  Synthetic sequence.
SLEAALKLAELNLKLSDKLAEASQKLAALLNKLLEKLSEAIQRLFELNLALVTLAIELTDPKRIADEIKKVKDKSKEIIERAEEEIARAAAESKKILDEAEEEIARAAAESKKILDEGSGSGSDALAELQALNLKLAELLLEAIAETQALNLKAAEAFLEAAAKLQELNIKAVELLVKLTDPATIREALRKAKEDSERIIAEAERAIAAAKAESERIIREAERLIAAAKAESERIIREGSGSNDPLIARLQELLIEHARELLRLHATSQEIFVELLRAFLANLAQLQEAALKALEAASENGSGSGPSSEKVRRELKESLKENHKQNQKLLMSCAQEQEKLNRELEELKKKHKK

SEQ ID NO: 25 - protein, 353 aa, Artificial Sequence
  Synthetic sequence.
SLEAVLKLFELNHKLSEKLLEAVLKLHALNQKLSQKLLEALARLLELNVALVELAIELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPEVARLQEAFIEQAREILRNVAAAQEALIEQARRLLALAALAQEAAIKAVELASEHGSGSGPDTVKRILEELRRRFEKLAKDLDDIAMSCAQEHKKHNKELKDKQRKIK

SEQ ID NO: 26 - protein, 7 aa, Artificial Sequence
  Synthetic sequence.
MSCAQES

SEQ ID NO: 27 - protein, 9 aa, Artificial Sequence
  Synthetic sequence.
  VARIANT (2)..(2): X is any amino acid, optimally not proline.
LXMSCAQES

SEQ ID NO: 28 - protein, 27 aa, Artificial Sequence
  Synthetic sequence.
KTRGVEEVAEGVVLLRRRGNKFAMKKK

SEQ ID NO: 29 - protein, 32 aa, Artificial Sequence
  Synthetic sequence.
KPFLNGGPYHSREQSTDSGLGLGSYKFAMKKK

SEQ ID NO: 30 - protein, 30 aa, Artificial Sequence
  Synthetic sequence.
ASADLDLEALAPYIPADDDFQLRKFAMKKK

SEQ ID NO: 31 - protein, 24 aa, Artificial Sequence
  Synthetic sequence.
KPEGKEEKDINNNVKKTKFAMKKK

SEQ ID NO: 32 - protein, 27 aa, Artificial Sequence
  Synthetic sequence.
KPEGDVQKADVSSTGQGIDSKFAMKKK

SEQ ID NO: 33 - protein, 29 aa, Artificial Sequence
  Synthetic sequence.
KAAEEEEVSLASTPTDVRDVDIKFAMKKK

SEQ ID NO: 34 - protein, 23 aa, Artificial Sequence
  Synthetic sequence.
KKYSSQTSQDSGNYSNKFAMKKK

SEQ ID NO: 35 - protein, 29 aa, Artificial Sequence
  Synthetic sequence.
KPLSSSVPSQKTYQGSYGFRLGKFAMKKK

SEQ ID NO: 36 - protein, 29 aa, Artificial Sequence
  Synthetic sequence.
KAWQQQSYLDSGIHSGATTTAPKFAMKKK

SEQ ID NO: 37 - protein, 8 aa, Artificial Sequence
  Synthetic sequence.
  misc_feature (2)..(2): Xaa can be any naturally occurring amino acid
LXMSCAQE

SEQ ID NO: 38 - protein, 9 aa, Artificial Sequence
  Synthetic sequence.
  VARIANT (9)..(9): The final S can either be present or absent.
LPMSCAQES

SEQ ID NO: 39 - protein, 9 aa, Artificial Sequence
  Synthetic sequence.
  VARIANT (9)..(9): The final S can either be present or absent.
LAMSCAQES

SEQ ID NO: 40 - protein, 9 aa, Artificial Sequence
  Synthetic sequence.
  VARIANT (9)..(9): The final S can either be present or absent.
LVMSCAQES

SEQ ID NO: 41 - protein, 9 aa, Artificial Sequence
  Synthetic sequence.
  VARIANT (9)..(9): The final S can either be present or absent.
LSMSCAQES

SEQ ID NO: 42 - protein, 9 aa, Artificial Sequence
  Synthetic sequence.
  VARIANT (9)..(9): The final S can either be present or absent.
LEMSCAQES

SEQ ID NO: 43 - protein, 9 aa, Artificial Sequence
  Synthetic sequence.
  VARIANT (9)..(9): The final S can either be present or absent.
LKMSCAQES

SEQ ID NO: 44 - protein, 6 aa, Artificial Sequence
  Synthetic sequence.
MSCAQE

SEQ ID NO: 45 - protein, 4 aa, Artificial Sequence
  Synthetic sequence.
PEST

SEQ ID NO: 46 - protein, 55 aa, Artificial Sequence
  Synthetic sequence.
EARKAIARVKRESKRIVEDAERLIREAAAASEKISREAERLIREAAAASEKISRE

SEQ ID NO: 47 - protein, 56 aa, Artificial Sequence
  Synthetic sequence.
NKEEIEKLAKEAREKLKKAEKEHKEIHDKLRKKNKKAREDLKKKADELRETNKRVN

SEQ ID NO: 48 - protein, 56 aa, Artificial Sequence
  Synthetic sequence.
SSEKVRRELKESLKENHKQNQKLLKDHKRAQEKLNRELEELKKKHKKTLDDIRRES

SEQ ID NO: 49 - protein, 56 aa, Artificial Sequence
  Synthetic sequence.
DTVKRILEELRRRFEKLAKDLDDIARKLLEDHKKHNKELKDKQRKIKKEADDAARS

SEQ ID NO: 50 - protein, 5 aa, Artificial Sequence
  Synthetic sequence.
GSGGS

SEQ ID NO: 51 - protein, 4 aa, Artificial Sequence
  Synthetic sequence.
GGGS

SEQ ID NO: 52 - protein, 4 aa, Artificial Sequence
  Synthetic sequence.
GGSG

SEQ ID NO: 53 - protein, 5 aa, Artificial Sequence
  Synthetic sequence.
GGSGG

SEQ ID NO: 54 - protein, 5 aa, Artificial Sequence
  Synthetic sequence.
GSGSG

SEQ ID NO: 55 - protein, 5 aa, Artificial Sequence
  Synthetic sequence.
GSGGG

SEQ ID NO: 56 - protein, 5 aa, Artificial Sequence
  Synthetic sequence.
GGGSG

SEQ ID NO: 57 - protein, 5 aa, Artificial Sequence
  Synthetic sequence.
GSSSG

SEQ ID NO: 58 - protein, 21 aa, Artificial Sequence
  Synthetic sequence.
MQELDKRAASLQNGDFYALRL

SEQ ID NO: 59 - protein, 8 aa, Artificial Sequence
  Synthetic sequence.
ILRIGDFY

SEQ ID NO: 60 - protein, 20 aa, Artificial Sequence
  Synthetic sequence.
EIWIAQELRRIGDEFNAYYA

SEQ ID NO: 61 - protein, 9 aa, Artificial Sequence
  Synthetic sequence.
LPMSCAQES

SEQ ID NO: 62 - protein, 8 aa, Artificial Sequence
  Synthetic sequence.
LMSCAQES

SEQ ID NO: 63 - protein, 165 aa, Artificial Sequence
  Synthetic sequence.
SVEELLRKLEEVLRKIREENERSLKELRDRAREIVKRNRETNRELEEVIKELEKRLSGADKEKVEELVRRIRRIVERVVEEDRRTVEEIEKIAREVVKRDRDSADRVRRTVEDVLRKATGSEDIVRKIERIVETIEREVRELIMSCAQESRDIRRKVDESVKNVE

SEQ ID NO: 64 - protein, 168 aa, Artificial Sequence
  Synthetic sequence.
SVEELLRKLEEVLRKIREENERSLKELRDRAREIVKRNRETNRELEEVIKELEKRLSGADKEKVEELVRRIRRIVERVVEEDRRTVEEIEKIAREVVKRDRDSADRVRRTVEDVLRKATGSEDIVRKIERIVETIEREVRESVKLVMSCAQESRRKVDESVKNVEKLL

SEQ ID NO: 65 - protein, 172 aa, Artificial Sequence
  Synthetic sequence.
SVEELLRKLEEVLRKIREENERSLKELRDRAREIVKRNRETNRELEEVIKELEKRLSGADKEKVEELVRRIRRIVERVVEEDRRTVEEIEKIAREVVKRDRDSADRVRRTVEDVLRKATGSEDIVRKIERIVETIEREVRESVKKVEELAMSCAQESDESVKNVEKLLRDVD

SEQ ID NO: 66 - protein, 176 aa, Artificial Sequence
  Synthetic sequence.
SVEELLRKLEEVLRKIREENERSLKELRDRAREIVKRNRETNRELEEVIKELEKRLSGADKEKVEELVRRIRRIVERVVEEDRRTVEEIEKIAREVVKRDRDSADRVRRTVEDVLRKATGSEDIVRKIERIVETIEREVRESVKKVEEIARDLRMSCAQESKNVEKLLRDVDKKAR

SEQ ID NO: 67 - protein, 179 aa, Artificial Sequence
  Synthetic sequence.
SVEELLRKLEEVLRKIREENERSLKELRDRAREIVKRNRETNRELEEVIKELEKRLSGADKEKVEELVRRIRRIVERVVEEDRRTVEEIEKIAREVVKRDRDSADRVRRTVEDVLRKATGSEDIVRKIERIVETIEREVRESVKKVEEIARDIRRLGMSCAQESEKLLRDVDKKARDRK

SEQ ID NO: 68 - protein, 180 aa, Artificial Sequence
  Synthetic sequence.
SVEELLRKLEEVLRKIREENERSLKELRDRAREIVKRNRETNRELEEVIKELEKRLSGADKEKVEELVRRIRRIVERVVEEDRRTVEEIEKIAREVVKRDRDSADRVRRTVEDVLRKATGSEDIVRKIERIVETIEREVRESVKKVEEIARDIRRKLDMSCAQESKLLRDVDKKARDRKK

SEQ ID NO: 69 - protein, 157 aa, Artificial Sequence
  Synthetic sequence.
DEVEKVLEEIKRALDDLRKKVEESKREIKEALKAVEKHTRDSDTANKRTLAEIERGVKSKDTERVRKLVEELSEENERSLREVRRVAEELLEINERVLEEVERVVEALLDLVRRGGSERVVEEVRRVLEELRRLAMSCAQESRRAIERLAREDARVS

SEQ ID NO: 70 - protein, 161 aa, Artificial Sequence
  Synthetic sequence.
DEVEKVLEEIKRALDDLRKKVEESKREIKEALKAVEKHTRDSDTANKRTLAEIERGVKSKDTERVRKLVEELSEENERSLREVRRVAEELLEINERVLEEVERVVEALLDLVRRGGSERVVEEVRRVLEELRRRLEKLKMSCAQESERLAREDARVSKKSI

SEQ ID NO: 71 - protein, 164 aa, Artificial Sequence
  Synthetic sequence.
DEVEKVLEEIKRALDDLRKKVEESKREIKEALKAVEKHTRDSDTANKRTLAEIERGVKSKDTERVRKLVEELSEENERSLREVRRVAEELLEINERVLEEVERVVEALLDLVRRGGSERVVEEVRRVLEELRRRLEKVTELAMSCAQESAREDARVSKKSIDVN

SEQ ID NO: 72 - protein, 168 aa, Artificial Sequence
  Synthetic sequence.
DEVEKVLEEIKRALDDLRKKVEESKREIKEALKAVEKHTRDSDTANKRTLAEIERGVKSKDTERVRKLVEELSEENERSLREVRRVAEELLEINERVLEEVERVVEALLDLVRRGGSERVVEEVRRVLEELRRRLEKVTEDSRRLLMSCAQESARVSKKSIDVNKKLD

SEQ ID NO: 73 - protein, 172 aa, Artificial Sequence
  Synthetic sequence.
DEVEKVLEEIKRALDDLRKKVEESKREIKEALKAVEKHTRDSDTANKRTLAEIERGVKSKDTERVRKLVEELSEENERSLREVRRVAEELLEINERVLEEVERVVEALLDLVRRGGSERVVEEVRRVLEELRRRLEKVTEDSRRAIERLKMSCAQESKKSIDVNKKLDDDVR

SEQ ID NO: 74 - protein, 163 aa, Artificial Sequence
  Synthetic sequence.
DAEELVRELEERIKRSHERLEELLREVKRLIERSHEELKRLNEEVLRELDRVLDEVAKRGSDSEELLRELEERVARIKERSKESYARSKESLDRAKEVLEELYRASKRSLEEFERELREKGVDKDSARELERIVKENAELAMSCAQESEKIVRENTKLAEDSV

SEQ ID NO: 75 - protein, 164 aa, Artificial Sequence
  Synthetic sequence.
DAEELVRELEERIKRSHERLEELLREVKRLIERSHEELKRLNEEVLRELDRVLDEVAKRGSDSEELLRELEERVARIKERSKESYARSKESLDRAKEVLEELYRASKRSLEEFERELREKGVDKDSARELERIVKENAELLYMSCAQESKIVRENTKLAEDSVR

SEQ ID NO: 76 - protein, 167 aa, Artificial Sequence
  Synthetic sequence.
DAEELVRELEERIKRSHERLEELLREVKRLIERSHEELKRLNEEVLRELDRVLDEVAKRGSDSEELLRELEERVARIKERSKESYARSKESLDRAKEVLEELYRASKRSLEEFERELREKGVDKDSARELERIVKENAELAERLYMSCAQESRENTKLAEDSVRELK

SEQ ID NO: 77 - protein, 168 aa, Artificial Sequence
  Synthetic sequence.
DAEELVRELEERIKRSHERLEELLREVKRLIERSHEELKRLNEEVLRELDRVLDEVAKRGSDSEELLRELEERVARIKERSKESYARSKESLDRAKEVLEELYRASKRSLEEFERELREKGVDKDSARELERIVKENAELAERVLKMSCAQESENTKLAEDSVRELKR

SEQ ID NO: 78 - protein, 171 aa, Artificial Sequence
  Synthetic sequence.
DAEELVRELEERIKRSHERLEELLREVKRLIERSHEELKRLNEEVLRELDRVLDEVAKRGSDSEELLRELEERVARIKERSKESYARSKESLDRAKEVLEELYRASKRSLEEFERELREKGVDKDSARELERIVKENAELAERVFRELAMSCAQESKLAEDSVRELKRLVE

SEQ ID NO: 79 - protein, 174 aa, Artificial Sequence
  Synthetic sequence.
DAEELVRELEERIKRSHERLEELLREVKRLIERSHEELKRLNEEVLRELDRVLDEVAKRGSDSEELLRELEERVARIKERSKESYARSKESLDRAKEVLEELYRASKRSLEEFERELREKGVDKDSARELERIVKENAELAERVFREVEKLVMSCAQESEDSVRELKRLVEELK

SEQ ID NO: 80 - protein, 177 aa, Artificial Sequence
  Synthetic sequence.
DAEELVRELEERIKRSHERLEELLREVKRLIERSHEELKRLNEEVLRELDRVLDEVAKRGSDSEELLRELEERVARIKERSKESYARSKESLDRAKEVLEELYRASKRSLEEFERELREKGVDKDSARELERIVKENAELAERVFREVEKIVRLTMSCAQESVRELKRLVEELKKRA

SEQ ID NO: 81 - protein, 178 aa, Artificial Sequence
  Synthetic sequence.
DAEELVRELEERIKRSHERLEELLREVKRLIERSHEELKRLNEEVLRELDRVLDEVAKRGSDSEELLRELEERVARIKERSKESYARSKESLDRAKEVLEELYRASKRSLEEFERELREKGVDKDSARELERIVKENAELAERVFREVEKIVRELLMSCAQESRELKRLVEELKKRAK

SEQ ID NO: 82 - protein, 162 aa, Artificial Sequence
  Synthetic sequence.
SAADEVVERMKELVATVKRENDEVVKELKKLVKELEDDNRRVVEESKKSVEDLARRVGKDKREVVEEVRRTSKELVERNEETAKRVDDLVRRLVEENRRSVTEVEELVKELVKELRRGSGSEDLVREVEKRVRDIVEELQMSCAQESKAVEDIIEKSKRIAE

SEQ ID NO: 83 - protein, 165 aa, Artificial Sequence
  Synthetic sequence.
SAADEVVERMKELVATVKRENDEVVKELKKLVKELEDDNRRVVEESKKSVEDLARRVGKDKREVVEEVRRTSKELVERNEETAKRVDDLVRRLVEENRRSVTEVEELVKELVKELRRGSGSEDLVREVEKRVRDIVEESRKLAMSCAQESEDIIEKSKRIAEDTL

SEQ ID NO: 84 - protein, 173 aa, Artificial Sequence
  Synthetic sequence.
SAADEVVERMKELVATVKRENDEVVKELKKLVKELEDDNRRVVEESKKSVEDLARRVGKDKREVVEEVRRTSKELVERNEETAKRVDDLVRRLVEENRRSVTEVEELVKELVKELRRGSGSEDLVREVEKRVRDIVEESRKLAEETRKALEMSCAQESRIAEDTLEKNKEMVE

SEQ ID NO: 85 - protein, 176 aa, Artificial Sequence
  Synthetic sequence.
SAADEVVERMKELVATVKRENDEVVKELKKLVKELEDDNRRVVEESKKSVEDLARRVGKDKREVVEEVRRTSKELVERNEETAKRVDDLVRRLVEENRRSVTEVEELVKELVKELRRGSGSEDLVREVEKRVRDIVEESRKLAEETRKAVEDLIMSCAQESEDTLEKNKEMVERLE

SEQ ID NO: 86 - protein, 159 aa, Artificial Sequence
  Synthetic sequence.
SESDEVIRDLARLLDELARHVDDSVRRMDEVVKRSTREADELAKRLDELVKEVEKKPGDERVERMVAEIERLVAEVLEELKKKYEKLKREVEENLRRLEETVRDIVEKARKVTEKGVSKEKIDRIIRELERILEELIMSCAQESRRLEDSLRRVAELLK

SEQ ID NO: 87 - protein, 162 aa, Artificial Sequence
  Synthetic sequence.
SESDEVIRDLARLLDELARHVDDSVRRMDEVVKRSTREADELAKRLDELVKEVEKKPGDERVERMVAEIERLVAEVLEELKKKYEKLKREVEENLRRLEETVRDIVEKARKVTEKGVSKEKIDRIIRELERILEEAKKLHMSCAQESEDSLRRVAELLKAAL

SEQ ID NO: 88 - protein, 163 aa, Artificial Sequence
  Synthetic sequence.
SESDEVIRDLARLLDELARHVDDSVRRMDEVVKRSTREADELAKRLDELVKEVEKKPGDERVERMVAEIERLVAEVLEELKKKYEKLKREVEENLRRLEETVRDIVEKARKVTEKGVSKEKIDRIIRELERILEEAKKKLLMSCAQESDSLRRVAELLKAALD

SEQ ID NO: 89 - protein, 166 aa, Artificial Sequence
  Synthetic sequence.
SESDEVIRDLARLLDELARHVDDSVRRMDEVVKRSTREADELAKRLDELVKEVEKKPGDERVERMVAEIERLVAEVLEELKKKYEKLKREVEENLRRLEETVRDIVEKARKVTEKGVSKEKIDRIIRELERILEEAKKKHEDLLMSCAQESRRVAELLKAALDRLR

SEQ ID NO: 90 - protein, 169 aa, Artificial Sequence
  Synthetic sequence.
SESDEVIRDLARLLDELARHVDDSVRRMDEVVKRSTREADELAKRLDELVKEVEKKPGDERVERMVAEIERLVAEVLEELKKKYEKLKREVEENLRRLEETVRDIVEKARKVTEKGVSKEKIDRIIRELERILEEAKKKHEDVLRLLMSCAQESAELLKAALDRLREIV

SEQ ID NO: 91 - protein, 159 aa, Artificial Sequence
  Synthetic sequence.
SESDEVIRDLARLLDELARHVDDSVRRMDEVVKRSTREADELAKRLDELVKEVEKKPGDERVERMVAEIERLVAEVLEELKKKYEKLKREVEENLRRLEETVRDIVEKARKVTEKGVSKEKIDRIIRELERILEELKMSCAQESRRLEDSLRRVAELLK

SEQ ID NO: 92 - protein, 162 aa, Artificial Sequence; identical to SEQ ID NO: 87
  Synthetic sequence.

SEQ ID NO: 93 - protein, 163 aa, Artificial Sequence
  Synthetic sequence.
SESDEVIRDLARLLDELARHVDDSVRRMDEVVKRSTREADELAKRLDELVKEVEKKPGDERVERMVAEIERLVAEVLEELKKKYEKLKREVEENLRRLEETVRDIVEKARKVTEKGVSKEKIDRIIRELERILEEAKKKLSMSCAQESDSLRRVAELLKAALD

SEQ ID NO: 94 - protein, 166 aa, Artificial Sequence; identical to SEQ ID NO: 89
  Synthetic sequence.

SEQ ID NO: 95 - protein, 169 aa, Artificial Sequence; identical to SEQ ID NO: 90
  Synthetic sequence.

SEQ ID NO: 96 - protein, 159 aa, Artificial Sequence
  Synthetic sequence.
SESDDVIRKLRELLEELRTHVEKSIRDLRKILEDSTRHAKRSIEELERLLEEVRKKPGDEEVRKTVEEISRRVAENVKRLEDLYRRMEEEVKKNLDRLRKRVEDIIREVEEARKKGVDEEKLKDLIRKLRDILRRLAMSCAQESDDARESLERAKREHE

SEQ ID NO: 97 - protein, 162 aa, Artificial Sequence
  Synthetic sequence.
SESDDVIRKLRELLEELRTHVEKSIRDLRKILEDSTRHAKRSIEELERLLEEVRKKPGDEEVRKTVEEISRRVAENVKRLEDLYRRMEEEVKKNLDRLRKRVEDIIREVEEARKKGVDEEKLKDLIRKLRDILRRAAELHMSCAQESRESLERAKREHEKLI

SEQ ID NO: 98 - protein, 163 aa, Artificial Sequence
  Synthetic sequence.
SESDDVIRKLRELLEELRTHVEKSIRDLRKILEDSTRHAKRSIEELERLLEEVRKKPGDEEVRKTVEEISRRVAENVKRLEDLYRRMEEEVKKNLDRLRKRVEDIIREVEEARKKGVDEEKLKDLIRKLRDILRRAAEALKMSCAQESESLERAKREHEKLID

SEQ ID NO: 99 - protein, 166 aa, Artificial Sequence
  Synthetic sequence.
SESDDVIRKLRELLEELRTHVEKSIRDLRKILEDSTRHAKRSIEELERLLEEVRKKPGDEEVRKTVEEISRRVAENVKRLEDLYRRMEEEVKKNLDRLRKRVEDIIREVEEARKKGVDEEKLKDLIRKLRDILRRAAEAHKKLIMSCAQESERAKREHEKLIDRLK

SEQ ID NO: 100 - protein, 169 aa, Artificial Sequence
  Synthetic sequence.
SESDDVIRKLRELLEELRTHVEKSIRDLRKILEDSTRHAKRSIEELERLLEEVRKKPGDEEVRKTVEEISRRVAENVKRLEDLYRRMEEEVKKNLDRLRKRVEDIIREVEEARKKGVDEEKLKDLIRKLRDILRRAAEAHKKLIDLGMSCAQESKREHEKLIDRLKKIL

SEQ ID NO: 101 - protein, 170 aa, Artificial Sequence
  Synthetic sequence.
SESDDVIRKLRELLEELRTHVEKSIRDLRKILEDSTRHAKRSIEELERLLEEVRKKPGDEEVRKTVEEISRRVAENVKRLEDLYRRMEEEVKKNLDRLRKRVEDIIREVEEARKKGVDEEKLKDLIRKLRDILRRAAEAHKKLIDDLRMSCAQESREHEKLIDRLKKILE

SEQ ID NO: 102 - protein, 173 aa, Artificial Sequence
  Synthetic sequence.
SESDDVIRKLRELLEELRTHVEKSIRDLRKILEDSTRHAKRSIEELERLLEEVRKKPGDEEVRKTVEEISRRVAENVKRLEDLYRRMEEEVKKNLDRLRKRVEDIIREVEEARKKGVDEEKLKDLIRKLRDILRRAAEAHKKLIDDARELLMSCAQESEKLIDRLKKILEELE

SEQ ID NO: 103 - protein, 159 aa, Artificial Sequence; identical to SEQ ID NO: 96
  Synthetic sequence.

SEQ ID NO: 104 - protein, 162 aa, Artificial Sequence; identical to SEQ ID NO: 97
  Synthetic sequence.

SEQ ID NO: 105 - protein, 163 aa, Artificial Sequence; identical to SEQ ID NO: 98
  Synthetic sequence.

SEQ ID NO: 106 - protein, 166 aa, Artificial Sequence; identical to SEQ ID NO: 99
  Synthetic sequence.

SEQ ID NO: 107 - protein, 170 aa, Artificial Sequence; identical to SEQ ID NO: 101
  Synthetic sequence.

SEQ ID NO: 108 - protein, 173 aa, Artificial Sequence; identical to SEQ ID NO: 102
  Synthetic sequence.

SEQ ID NO: 109 - protein, 163 aa, Artificial Sequence
  Synthetic sequence.
DREREVKKRLDEVRERIERLLRRVEEESRRVAEEIRRLIEEVRRRNKKVTEEIRELLKGLKDKEEVRRVLERLRKLNAESDELLERILERLRRLVEATNRLVKAIIEELRRLVEKIVREVPDSEELREELKKLERKIEKLAMSCAQESKEVTERLEDLLRRIT

SEQ ID NO: 110 - protein, 167 aa, Artificial Sequence
  Synthetic sequence.
DREREVKKRLDEVRERIERLLRRVEEESRRVAEEIRRLIEEVRRRNKKVTEEIRELLKGLKDKEEVRRVLERLRKLNAESDELLERILERLRRLVEATNRLVKAIIEELRRLVEKIVREVPDSEELREELKKLERKIEKVAKELKMSCAQESERLEDLLRRITEHAR

SEQ ID NO: 111 - protein, 174 aa, Artificial Sequence
  Synthetic sequence.
DREREVKKRLDEVRERIERLLRRVEEESRRVAEEIRRLIEEVRRRNKKVTEEIRELLKGLKDKEEVRRVLERLRKLNAESDELLERILERLRRLVEATNRLVKAIIEELRRLVEKIVREVPDSEELREELKKLERKIEKVAKEIHDHDKELEMSCAQESRRITEHARKSDREIE

SEQ ID NO: 112 - protein, 163 aa, Artificial Sequence; identical to SEQ ID NO: 109
  Synthetic sequence.

SEQ ID NO: 113 - protein, 167 aa, Artificial Sequence
  Synthetic sequence.
DREREVKKRLDEVRERIERLLRRVEEESRRVAEEIRRLIEEVRRRNKKVTEEIRELLKGLKDKEEVRRVLERLRKLNAESDELLERILERLRRLVEATNRLVKAIIEELRRLVEKIVREVPDSEELREELKKLERKIEKVAKELHMSCAQESERLEDLLRRITEHAR

SEQ ID NO: 114 - protein, 174 aa, Artificial Sequence; identical to SEQ ID NO: 111
  Synthetic sequence.

SEQ ID NO: 115 - protein, 169 aa, Artificial Sequence
  Synthetic sequence.
SEVDEAVKNNEEDAKESRRVVEEAVKRDEDIARDIERAAREVVERDKEIVDEVRRGVKDEKKLREVVTLSKKIVDETKEIADRVLELSKRIVKETRDIAKRVLKLNDDSVKDVRRIAREGRSKETKDLLDENSKRSNEISREVKKLCMSCAQESKKIVDEVAKALEDTV

SEQ ID NO: 116 - protein, 170 aa, Artificial Sequence
  Synthetic sequence.
SEVDEAVKNNEEDAKESRRVVEEAVKRDEDIARDIERAAREVVERDKEIVDEVRRGVKDEKKLREVVTLSKKIVDETKEIADRVLELSKRIVKETRDIAKRVLKLNDDSVKDVRRIAREGRSKETKDLLDENSKRSNEISREVKKDLEMSCAQESKIVDEVAKALEDTVD

SEQ ID NO: 117 - protein, 173 aa, Artificial Sequence
  Synthetic sequence.
SEVDEAVKNNEEDAKESRRVVEEAVKRDEDIARDIERAAREVVERDKEIVDEVRRGVKDEKKLREVVTLSKKIVDETKEIADRVLELSKRIVKETRDIAKRVLKLNDDSVKDVRRIAREGRSKETKDLLDENSKRSNEISREVKKDLERLVMSCAQESDEVAKALEDTVDKNR

SEQ ID NO: 118 - protein, 177 aa, Artificial Sequence
  Synthetic sequence.
SEVDEAVKNNEEDAKESRRVVEEAVKRDEDIARDIERAAREVVERDKEIVDEVRRGVKDEKKLREVVTLSKKIVDETKEIADRVLELSKRIVKETRDIAKRVLKLNDDSVKDVRRIAREGRSKETKDLLDENSKRSNEISREVKKDLERTVRELKMSCAQESKALEDTVDKNRRIVE

SEQ ID NO: 119 - protein, 170 aa, Artificial Sequence
  Synthetic sequence.
SEAEELLKRLEDRAEEILRRLEEILRTSRKLAEDVLRELEKLLRESERRIREVLEELRGIKDKKELEDVIREVEKELDESLERSRELLKDVLKKLDDNLKESERLVEDIDRELAKILEDLKKAGVPKEVVDEIKRIVDEVRERLKRLVMSCAQESEDARRALEKIVKENE

SEQ ID NO: 120 - protein, 173 aa, Artificial Sequence
  Synthetic sequence.
SEAEELLKRLEDRAEEILRRLEEILRTSRKLAEDVLRELEKLLRESERRIREVLEELRGIKDKKELEDVIREVEKELDESLERSRELLKDVLKKLDDNLKESERLVEDIDRELAKILEDLKKAGVPKEVVDEIKRIVDEVRERLKRIVDLTMSCAQESRRALEKIVKENEEIL

SEQ ID NO: 121 - protein, 174 aa, Artificial Sequence
  Synthetic sequence.
SEAEELLKRLEDRAEEILRRLEEILRTSRKLAEDVLRELEKLLRESERRIREVLEELRGIKDKKELEDVIREVEKELDESLERSRELLKDVLKKLDDNLKESERLVEDIDRELAKILEDLKKAGVPKEVVDEIKRIVDEVRERLKRIVDELRMSCAQESRALEKIVKENEEILR

SEQ ID NO: 122 - protein, 177 aa, Artificial Sequence
  Synthetic sequence.
SEAEELLKRLEDRAEEILRRLEEILRTSRKLAEDVLRELEKLLRESERRIREVLEELRGIKDKKELEDVIREVEKELDESLERSRELLKDVLKKLDDNLKESERLVEDIDRELAKILEDLKKAGVPKEVVDEIKRIVDEVRERLKRIVDENAKLTMSCAQESEKIVKENEEILRRLK

SEQ ID NO: 123 - protein, 185 aa, Artificial Sequence
  Synthetic sequence.
SEAEELLKRLEDRAEEILRRLEEILRTSRKLAEDVLRELEKLLRESERRIREVLEELRGIKDKKELEDVIREVEKELDESLERSRELLKDVLKKLDDNLKESERLVEDIDRELAKILEDLKKAGVPKEVVDEIKRIVDEVRERLKRIVDENAKIVEDARRALEMSCAQESEILRRLKKELRELRK

SEQ ID NO: 124 - protein, 160 aa, Artificial Sequence
  Synthetic sequence.
SRAETVLKEVTDKIKKLADSSDELLRRNKENIDELKKSSEELLRRLTKAIEEIEKGSVDEETLEELIRRVEAELEAHHRELEKNSREDEKRNRDHHAKLEEEMRRVEERLEREGIDDEVVKRVRDLLDTVRRRNEKLMMSCAQESDKLRRDNEDVIRRVE

SEQ ID NO: 125 - protein, 167 aa, Artificial Sequence
  Synthetic sequence.
SRAETVLKEVTDKIKKLADSSDELLRRNKENIDELKKSSEELLRRLTKAIEEIEKGSVDEETLEELIRRVEAELEAHHRELEKNSREDEKRNRDHHAKLEEEMRRVEERLEREGIDDEVVKRVRDLLDTVRRRNEKVNEDVKRLNMSCAQESEDVIRRVEKLLRELE

SEQ ID NO: 126 - protein, 171 aa, Artificial Sequence
  Synthetic sequence.
SRAETVLKEVTDKIKKLADSSDELLRRNKENIDELKKSSEELLRRLTKAIEEIEKGSVDEETLEELIRRVEAELEAHHRELEKNSREDEKRNRDHHAKLEEEMRRVEERLEREGIDDEVVKRVRDLLDTVRRRNEKVNEDVKRMNDKLRMSCAQESRRVEKLLRELEEKRR

SEQ ID NO: 127 - protein, 160 aa, Artificial Sequence
  Synthetic sequence.
SRAETVLKEVTDKIKKLADSSDELLRRNKENIDELKKSSEELLRRLTKAIEEIEKGSVDEETLEELIRRVEAELEAHHRELEKNSREDEKRNRDHHAKLEEEMRRVEERLEREGIDDEVVKRVRDLLDTVRRRNEKLVMSCAQESDKLRRDNEDVIRRVE

SEQ ID NO: 128 - protein, 167 aa, Artificial Sequence; identical to SEQ ID NO: 125
  Synthetic sequence.

SEQ ID NO: 129 - protein, 171 aa, Artificial Sequence; identical to SEQ ID NO: 126
  Synthetic sequence.

SEQ ID NO: 130 - protein, 162 aa, Artificial Sequence
  Synthetic sequence.
DEVRELLERNRRLLEEIKKTVKDLIRANEELLKRIEDDAKRLIDRNEELLDELEKGLSDDETIREAKERLKASLEDVKRRVEEVKRLLEKSLEEVETIIREAEKRNRDSLREMERRGSSEELEELRRVVEESDETIKRLLMSCAQESDRSLDRIRKLLEDVR

SEQ ID NO: 131 - protein, 166 aa, Artificial Sequence
  Synthetic sequence.
DEVRELLERNRRLLEEIKKTVKDLIRANEELLKRIEDDAKRLIDRNEELLDELEKGLSDDETIREAKERLKASLEDVKRRVEEVKRLLEKSLEEVETIIREAEKRNRDSLREMERRGSSEELEELRRVVEESDETIKRLLEELIMSCAQESDRIRKLLEDVRRSVE

SEQ ID NO: 132 - protein, 169 aa, Artificial Sequence
  Synthetic sequence.
DEVRELLERNRRLLEEIKKTVKDLIRANEELLKRIEDDAKRLIDRNEELLDELEKGLSDDETIREAKERLKASLEDVKRRVEEVKRLLEKSLEEVETIIREAEKRNRDSLREMERRGSSEELEELRRVVEESDETIKRLLEEAKELVMSCAQESRKLLEDVRRSVERSA

SEQ ID NO: 133 - protein, 173 aa, Artificial Sequence
  Synthetic sequence.
DEVRELLERNRRLLEEIKKTVKDLIRANEELLKRIEDDAKRLIDRNEELLDELEKGLSDDETIREAKERLKASLEDVKRRVEEVKRLLEKSLEEVETIIREAEKRNRDSLREMERRGSSEELEELRRVVEESDETIKRLLEEAKESVDRLLMSCAQESEDVRRSVERSAKRID

SEQ ID NO: 134 - protein, 165 aa, Artificial Sequence
  Synthetic sequence.
STEEVLDEIRKLHKTLTEDIKRVLREIEELHRRTIEENKEVLDKIAEDYKRVIDDVRTKDTPNVEKLLKDLEKSAKENIEHNERTLREDDRVLKEIRRRATELLKANEEMLRRIEEVARKGGVDAEELLRESKEAIKEVKRLLMSCAQESKRVVDETRKLSEENL

SEQ ID NO: 135 - protein, 169 aa, Artificial Sequence
  Synthetic sequence.
STEEVLDEIRKLHKTLTEDIKRVLREIEELHRRTIEENKEVLDKIAEDYKRVIDDVRTKDTPNVEKLLKDLEKSAKENIEHNERTLREDDRVLKEIRRRATELLKANEEMLRRIEEVARKGGVDAEELLRESKEAIKEVKRVLEELKMSCAQESDETRKLSEENLEHSE

SEQ ID NO: 136 - protein, 173 aa, Artificial Sequence
  Synthetic sequence.
STEEVLDEIRKLHKTLTEDIKRVLREIEELHRRTIEENKEVLDKIAEDYKRVIDDVRTKDTPNVEKLLKDLEKSAKENIEHNERTLREDDRVLKEIRRRATELLKANEEMLRRIEEVARKGGVDAEELLRESKEAIKEVKRVLEELRKELEMSCAQESKLSEENLEHSERVLR

SEQ ID NO: 137 - protein, 176 aa, Artificial Sequence
  Synthetic sequence.
STEEVLDEIRKLHKTLTEDIKRVLREIEELHRRTIEENKEVLDKIAEDYKRVIDDVRTKDTPNVEKLLKDLEKSAKENIEHNERTLREDDRVLKEIRRRATELLKANEEMLRRIEEVARKGGVDAEELLRESKEAIKEVKRVLEELRKESKRLTMSCAQESEENLEHSERVLRKVE

SEQ ID NO: 138 - protein, 180 aa, Artificial Sequence
  Synthetic sequence.
STEEVLDEIRKLHKTLTEDIKRVLREIEELHRRTIEENKEVLDKIAEDYKRVIDDVRTKDTPNVEKLLKDLEKSAKENIEHNERTLREDDRVLKEIRRRATELLKANEEMLRRIEEVARKGGVDAEELLRESKEAIKEVKRVLEELRKESKRVVDELRMSCAQESEHSERVLRKVEEDLR

SEQ ID NO: 139 - protein, 173 aa, Artificial Sequence
  Synthetic sequence.
SEIEKILKEIEDLARRDEEVSKKIVEDIRRLAKEVEDTSRDIVRKIEELAKRVLDRLRKDGSKEELEKEVREVVKTLEELVKDNHRLIRRAVEEMKRLVEENHRHSREVVKELEDLVRELRKGSGSEDSERLVREVEDLVRRLVRRSEKLDMSCAQESEELVRRMEESNDRVR

SEQ ID NO: 140 - protein, 177 aa, Artificial Sequence
  Synthetic sequence.
SEIEKILKEIEDLARRDEEVSKKIVEDIRRLAKEVEDTSRDIVRKIEELAKRVLDRLRKDGSKEELEKEVREVVKTLEELVKDNHRLIRRAVEEMKRLVEENHRHSREVVKELEDLVRELRKGSGSEDSERLVREVEDLVRRLVRRSEKSNEELKMSCAQESRRMEESNDRVRDLVR

SEQ ID NO: 141 - protein, 181 aa, Artificial Sequence
  Synthetic sequence.
SEIEKILKEIEDLARRDEEVSKKIVEDIRRLAKEVEDTSRDIVRKIEELAKRVLDRLRKDGSKEELEKEVREVVKTLEELVKDNHRLIRRAVEEMKRLVEENHRHSREVVKELEDLVRELRKGSGSEDSERLVREVEDLVRRLVRRSEKSNEEVKRTLEMSCAQESESNDRVRDLVRRLVE

SEQ ID NO: 142 - protein, 184 aa, Artificial Sequence
  Synthetic sequence.
SEIEKILKEIEDLARRDEEVSKKIVEDIRRLAKEVEDTSRDIVRKIEELAKRVLDRLRKDGSKEELEKEVREVVKTLEELVKDNHRLIRRAVEEMKRLVEENHRHSREVVKELEDLVRELRKGSGSEDSERLVREVEDLVRRLVRRSEKSNEEVKRTVEELVMSCAQESDRVRDLVRRLVEELK

SEQ ID NO: 143 - protein, 188 aa, Artificial Sequence
  Synthetic sequence.
SEIEKILKEIEDLARRDEEVSKKIVEDIRRLAKEVEDTSRDIVRKIEELAKRVLDRLRKDGSKEELEKEVREVVKTLEELVKDNHRLIRRAVEEMKRLVEENHRHSREVVKELEDLVRELRKGSGSEDSERLVREVEDLVRRLVRRSEKSNEEVKRTVEELVRRLLMSCAQESDLVRRLVEELKRAVD

SEQ ID NO: 144 - protein, 163 aa, Artificial Sequence
  Synthetic sequence.
SEAEKAKETIDRLADRVRKLLEEIKRSLDDSRRKSKETVEENEKTLDRMRKEVDAAKRGSVSEEELERLIRKLKKTLDELRRRHEKLVEDLRRNLERIKRRLEELTREMRETLERLAREGLDEEVLRTLEEIIRRLTKELIMSCAQESRELRRLEEENKRVID

SEQ ID NO: 145 - protein, 170 aa, Artificial Sequence
  Synthetic sequence.
SEAEKAKETIDRLADRVRKLLEEIKRSLDDSRRKSKETVEENEKTLDRMRKEVDAAKRGSVSEEELERLIRKLKKTLDELRRRHEKLVEDLRRNLERIKRRLEELTREMRETLERLAREGLDEEVLRTLEEIIRRLTKELEDVLRELKMSCAQESEENKRVIDKTEEEIR

SEQ ID NO: 146 - protein, 163 aa, Artificial Sequence; identical to SEQ ID NO: 144
  Synthetic sequence.

SEQ ID NO: 147 - protein, 166 aa, Artificial Sequence
  Synthetic sequence.
SEAEKAKETIDRLADRVRKLLEEIKRSLDDSRRKSKETVEENEKTLDRMRKEVDAAKRGSVSEEELERLIRKLKKTLDELRRRHEKLVEDLRRNLERIKRRLEELTREMRETLERLAREGLDEEVLRTLEEIIRRLTKELEDLLMSCAQESRRLEEENKRVIDKTE

SEQ ID NO: 148 - protein, 170 aa, Artificial Sequence; identical to SEQ ID NO: 145
  Synthetic sequence.

SEQ ID NO: 149 - protein, 164 aa, Artificial Sequence
  Synthetic sequence.
SEVEELIKRLAKVLKELVDKVRKVIEDTKELLERLKRRSEDHIRKLREVLKEAKDQPIDDEELKEILDRLRKTLEELEEELKKALEDDREEAKRLVDDARRVLKELEEEVREIRERRGESEELDRRIEKVLKEIEEKIRELIMSCAQESREVEELLKRLIDENR

SEQ ID NO: 150 - protein, 167 aa, Artificial Sequence
  Synthetic sequence.
SEVEELIKRLAKVLKELVDKVRKVIEDTKELLERLKRRSEDHIRKLREVLKEAKDQPIDDEELKEILDRLRKTLEELEEELKKALEDDREEAKRLVDDARRVLKELEEEVREIRERRGESEELDRRIEKVLKEIEEKIREVIKLLMSCAQESEELLKRLIDENRKVL

SEQ ID NO: 151 - protein, 168 aa, Artificial Sequence
  Synthetic sequence.
SEVEELIKRLAKVLKELVDKVRKVIEDTKELLERLKRRSEDHIRKLREVLKEAKDQPIDDEELKEILDRLRKTLEELEEELKKALEDDREEAKRLVDDARRVLKELEEEVREIRERRGESEELDRRIEKVLKEIEEKIREVIKELEMSCAQESELLKRLIDENRKVLD

SEQ ID NO: 152 - protein, 175 aa, Artificial Sequence
  Synthetic sequence.
SEVEELIKRLAKVLKELVDKVRKVIEDTKELLERLKRRSEDHIRKLREVLKEAKDQPIDDEELKEILDRLRKTLEELEEELKKALEDDREEAKRLVDDARRVLKELEEEVREIRERRGESEELDRRIEKVLKEIEEKIREVIKEWERVHRELEMSCAQESDENRKVLDEIRKLLE

SEQ ID NO: 153 - protein, 164 aa, Artificial Sequence; identical to SEQ ID NO: 149
  Synthetic sequence.

SEQ ID NO: 154 - protein, 167 aa, Artificial Sequence; identical to SEQ ID NO: 150
  Synthetic sequence.

SEQ ID NO: 155 - protein, 168 aa, Artificial Sequence
  Synthetic sequence.
SEVEELIKRLAKVLKELVDKVRKVIEDTKELLERLKRRSEDHIRKLREVLKEAKDQPIDDEELKEILDRLRKTLEELEEELKKALEDDREEAKRLVDDARRVLKELEEEVREIRERRGESEELDRRIEKVLKEIEEKIREVIKELKMSCAQESELLKRLIDENRKVLD

SEQ ID NO: 156 - protein, 175 aa, Artificial Sequence; identical to SEQ ID NO: 152
  Synthetic sequence.

SEQ ID NO: 157 - protein, 167 aa, Artificial Sequence
  Synthetic sequence.
SELEEIEKKVRELTKRHRELVERVRKTVKELIETNRRLLETLTERIKRVLEEVRDLERRGEPKEDLKARLEDIIRRLAEDIERVKRETDKLLEELARIIEEVEKEMRETNKELDKEIKDGGLDDKALEEAKRVLAENNEVIKDLIMSCAQESKELEKSVRESEERLR

SEQ ID NO: 158 - protein, 171 aa, Artificial Sequence
  Synthetic sequence.
SELEEIEKKVRELTKRHRELVERVRKTVKELIETNRRLLETLTERIKRVLEEVRDLERRGEPKEDLKARLEDIIRRLAEDIERVKRETDKLLEELARIIEEVEKEMRETNKELDKEIKDGGLDDKALEEAKRVLAENNEVIKDIKRALEMSCAQESKSVRESEERLRRLLE

SEQ ID NO: 159 - protein, 174 aa, Artificial Sequence
  Synthetic sequence.
SELEEIEKKVRELTKRHRELVERVRKTVKELIETNRRLLETLTERIKRVLEEVRDLERRGEPKEDLKARLEDIIRRLAEDIERVKRETDKLLEELARIIEEVEKEMRETNKELDKEIKDGGLDDKALEEAKRVLAENNEVIKDIKRALDELGMSCAQESRESEERLRRLLEEVK

SEQ ID NO: 160 - protein, 177 aa, Artificial Sequence
  Synthetic sequence.
SELEEIEKKVRELTKRHRELVERVRKTVKELIETNRRLLETLTERIKRVLEEVRDLERRGEPKEDLKARLEDIIRRLAEDIERVKRETDKLLEELARIIEEVEKEMRETNKELDKEIKDGGLDDKALEEAKRVLAENNEVIKDIKRALDELLKLAMSCAQESEERLRRLLEEVKRVI

SEQ ID NO: 161 - protein, 178 aa, Artificial Sequence
  Synthetic sequence.
SELEEIEKKVRELTKRHRELVERVRKTVKELIETNRRLLETLTERIKRVLEEVRDLERRGEPKEDLKARLEDIIRRLAEDIERVKRETDKLLEELARIIEEVEKEMRETNKELDKEIKDGGLDDKALEEAKRVLAENNEVIKDIKRALDELLKELEMSCAQESERLRRLLEEVKRVIE

SEQ ID NO: 162 - protein, 181 aa, Artificial Sequence
  Synthetic sequence.
SELEEIEKKVRELTKRHRELVERVRKTVKELIETNRRLLETLTERIKRVLEEVRDLERRGEPKEDLKARLEDIIRRLAEDIERVKRETDKLLEELARIIEEVEKEMRETNKELDKEIKDGGLDDKALEEAKRVLAENNEVIKDIKRALDELLKELEKLAMSCAQESRRLLEEVKRVIEEVA

SEQ ID NO: 163 - protein, 171 aa, Artificial Sequence
  Synthetic sequence.
SEAERLEARARELLRANEELMDDLRAKAEELLKRNDRLVKEIEKKVREVLAAIEELKRRGEPKEEVARKIEEILRRLEETLRRIKEESDRLDEELKRELERVKRESEELDRELRKLIEDVERRGSGSKRLEELLRRLNEEHKRISDELEMSCAQESEAHRELSRRLEEELE

SEQ ID NO: 164 - protein, 174 aa, Artificial Sequence
  Synthetic sequence.
SEAERLEARARELLRANEELMDDLRAKAEELLKRNDRLVKEIEKKVREVLAAIEELKRRGEPKEEVARKIEEILRRLEETLRRIKEESDRLDEELKRELERVKRESEELDRELRKLIEDVERRGSGSKRLEELLRRLNEEHKRISDELRKLGMSCAQESRELSRRLEEELERLL

SEQ ID NO: 165 - protein, 175 aa, Artificial Sequence
  Synthetic sequence.
SEAERLEARARELLRANEELMDDLRAKAEELLKRNDRLVKEIEKKVREVLAAIEELKRRGEPKEEVARKIEEILRRLEETLRRIKEESDRLDEELKRELERVKRESEELDRELRKLIEDVERRGSGSKRLEELLRRLNEEHKRISDELRKLLDMSCAQESELSRRLEEELERLLR

SEQ ID NO: 166 - protein, 177 aa, Artificial Sequence
  Synthetic sequence.
SEAERLEARARELLRANEELMDDLRAKAEELLKRNDRLVKEIEKKVREVLAAIEELKRRGEPKEEVARKIEEILRRLEETLRRIKEESDRLDEELKRELERVKRESEELDRELRKLIEDVERRGSGSKRLEELLRRLNEEHKRISDELRKLLDLAMSCAQESSRRLEEELERLLREI

SEQ ID NO: 167 - protein, 178 aa, Artificial Sequence
  Synthetic sequence.
SEAERLEARARELLRANEELMDDLRAKAEELLKRNDRLVKEIEKKVREVLAAIEELKRRGEPKEEVARKIEEILRRLEETLRRIKEESDRLDEELKRELERVKRESEELDRELRKLIEDVERRGSGSKRLEELLRRLNEEHKRISDELRKLLDELLMSCAQESRRLEEELERLLREIE

SEQ ID NO: 168 - protein, 181 aa, Artificial Sequence
  Synthetic sequence.
SEAERLEARARELLRANEELMDDLRAKAEELLKRNDRLVKEIEKKVREVLAAIEELKRRGEPKEEVARKIEEILRRLEETLRRIKEESDRLDEELKRELERVKRESEELDRELRKLIEDVERRGSGSKRLEELLRRLNEEHKRISDELRKLLDEALELSMSCAQESEEELERLLREIERLV

SEQ ID NO: 169 - protein, 182 aa, Artificial Sequence
  Synthetic sequence.
SEAERLEARARELLRANEELMDDLRAKAEELLKRNDRLVKEIEKKVREVLAAIEELKRRGEPKEEVARKIEEILRRLEETLRRIKEESDRLDEELKRELERVKRESEELDRELRKLIEDVERRGSGSKRLEELLRRLNEEHKRISDELRKLLDEALEALKMSCAQESEELERLLREIERLVE

SEQ ID NO: 170 - protein, 185 aa, Artificial Sequence
  Synthetic sequence.
SEAERLEARARELLRANEELMDDLRAKAEELLKRNDRLVKEIEKKVREVLAAIEELKRRGEPKEEVARKIEEILRRLEETLRRIKEESDRLDEELKRELERVKRESEELDRELRKLIEDVERRGSGSKRLEELLRRLNEEHKRISDELRKLLDEALEAHRELVMSCAQESERLLREIERLVEEVT

SEQ ID NO: 171 - protein, 165 aa, Artificial Sequence
  Synthetic sequence.
SVDEVLKEIEDALRRLKEEVERVLKENEDELRRLEEEVRRVLKEDEELLESLKRGVGESDEVDRVVDEIAKLSAEILEKVKKVVKEIRDSLETVKRRVDDVVRRLKELLDEIKRGSDEKAIRDVAKEIRDRLKELEEEIEELTMSCAQESADVEEEIRRVHEKTR

SEQ ID NO: 172 - protein, 169 aa, Artificial Sequence
  Synthetic sequence.
SVDEVLKEIEDALRRLKEEVERVLKENEDELRRLEEEVRRVLKEDEELLESLKRGVGESDEVDRVVDEIAKLSAEILEKVKKVVKEIRDSLETVKRRVDDVVRRLKELLDEIKRGSDEKAIRDVAKEIRDRLKELEEEIEEVTRRLLMSCAQESEEIRRVHEKTRRLLE

SEQ ID NO: 173 - protein, 172 aa, Artificial Sequence
  Synthetic sequence.
SVDEVLKEIEDALRRLKEEVERVLKENEDELRRLEEEVRRVLKEDEELLESLKRGVGESDEVDRVVDEIAKLSAEILEKVKKVVKEIRDSLETVKRRVDDVVRRLKELLDEIKRGSDEKAIRDVAKEIRDRLKELEEEIEEVTRRNLKLLMSCAQESRRVHEKTRRLLETVL

SEQ ID NO: 174 - protein, 176 aa, Artificial Sequence
  Synthetic sequence.
SVDEVLKEIEDALRRLKEEVERVLKENEDELRRLEEEVRRVLKEDEELLESLKRGVGESDEVDRVVDEIAKLSAEILEKVKKVVKEIRDSLETVKRRVDDVVRRLKELLDEIKRGSDEKAIRDVAKEIRDRLKELEEEIEEVTRRNLKLLADLEMSCAQESEKTRRLLETVLRRAT

SEQ ID NO: 175 - protein, 169 aa, Artificial Sequence
  Synthetic sequence.
DDLERAREEVADLIRKHEEKTRRILEESRRLNERHRELSARILDEIRKLAERIEELIKRERGKDELRRKVEDLEARVEDLIRRLEEHLRRVHDKDRRLIEDLRRHLKRVVEELKRLIDELRRGVPKEELDRIEEELKRLIDTLRELVMSCAQESRDSNRDLKRTNDEIA

SEQ ID NO: 176 - protein, 173 aa, Artificial Sequence
  Synthetic sequence.
DDLERAREEVADLIRKHEEKTRRILEESRRLNERHRELSARILDEIRKLAERIEELIKRERGKDELRRKVEDLEARVEDLIRRLEEHLRRVHDKDRRLIEDLRRHLKRVVEELKRLIDELRRGVPKEELDRIEEELKRLIDTLREKNRELAMSCAQESRDLKRTNDEIAKEVR

SEQ ID NO: 177 - protein, 180 aa, Artificial Sequence
  Synthetic sequence.
DDLERAREEVADLIRKHEEKTRRILEESRRLNERHRELSARILDEIRKLAERIEELIKRERGKDELRRKVEDLEARVEDLIRRLEEHLRRVHDKDRRLIEDLRRHLKRVVEELKRLIDELRRGVPKEELDRIEEELKRLIDTLREKNREVEKRARDLVMSCAQESDEIAKEVRELIKKLR

SEQ ID NO: 178 - protein, 184 aa, Artificial Sequence
  Synthetic sequence.
DDLERAREEVADLIRKHEEKTRRILEESRRLNERHRELSARILDEIRKLAERIEELIKRERGKDELRRKVEDLEARVEDLIRRLEEHLRRVHDKDRRLIEDLRRHLKRVVEELKRLIDELRRGVPKEELDRIEEELKRLIDTLREKNREVEKRARDSNRDLAMSCAQESKEVRELIKKLREDLK

SEQ ID NO: 179 - protein, 159 aa, Artificial Sequence
  Synthetic sequence.
KEVEDAVKELEDLLRANEDKTRSIVEDMRASNKDLEDHSRASEEEVRKLLDDLRRAGVPRDSLKRLAEDVERVTRESRELLERVHRADRELIERLKESNERLRRAIEEIRKAIKGGSDIKTLLDRVRKLAEEDAELAMSCAQESEELNERVRRVDKKLL

SEQ ID NO: 180 - protein, 163 aa, Artificial Sequence
  Synthetic sequence.
KEVEDAVKELEDLLRANEDKTRSIVEDMRASNKDLEDHSRASEEEVRKLLDDLRRAGVPRDSLKRLAEDVERVTRESRELLERVHRADRELIERLKESNERLRRAIEEIRKAIKGGSDIKTLLDRVRKLAEEDAERLDRLKMSCAQESERVRRVDKKLLEEIR

SEQ ID NO: 181 - protein, 166 aa, Artificial Sequence
  Synthetic sequence.
KEVEDAVKELEDLLRANEDKTRSIVEDMRASNKDLEDHSRASEEEVRKLLDDLRRAGVPRDSLKRLAEDVERVTRESRELLERVHRADRELIERLKESNERLRRAIEEIRKAIKGGSDIKTLLDRVRKLAEEDAERLDRLRRLAMSCAQESRRVDKKLLEEIRRKA

SEQ ID NO: 182 - protein, 167 aa, Artificial Sequence
  Synthetic sequence.
KEVEDAVKELEDLLRANEDKTRSIVEDMRASNKDLEDHSRASEEEVRKLLDDLRRAGVPRDSLKRLAEDVERVTRESRELLERVHRADRELIERLKESNERLRRAIEEIRKAIKGGSDIKTLLDRVRKLAEEDAERLDRLRRELEMSCAQESRVDKKLLEEIRRKAK

SEQ ID NO: 183 - protein, 170 aa, Artificial Sequence
  Synthetic sequence.
KEVEDAVKELEDLLRANEDKTRSIVEDMRASNKDLEDHSRASEEEVRKLLDDLRRAGVPRDSLKRLAEDVERVTRESRELLERVHRADRELIERLKESNERLRRAIEEIRKAIKGGSDIKTLLDRVRKLAEEDAERLDRLRRESEELAMSCAQESKKLLEEIRRKAKKVE

SEQ ID NO: 184 - protein, 174 aa, Artificial Sequence
  Synthetic sequence.
KEVEDAVKELEDLLRANEDKTRSIVEDMRASNKDLEDHSRASEEEVRKLLDDLRRAGVPRDSLKRLAEDVERVTRESRELLERVHRADRELIERLKESNERLRRAIEEIRKAIKGGSDIKTLLDRVRKLAEEDAERLDRLRRESEELNERLRMSCAQESEEIRRKAKKVEDDTR

SEQ ID NO: 185 - protein, 159 aa, Artificial Sequence
  Synthetic sequence.
KEVEDAVKELEDLLRANEDKTRSIVEDMRASNKDLEDHSRASEEEVRKLLDDLRRAGVPRDSLKRLAEDVERVTRESRELLERVHRADRELIERLKESNERLRRAIEEIRKAIKGGSDIKTLLDRVRKLAEEDAELLMSCAQESEELNERVRRVDKKLL

SEQ ID NO: 186 - protein, 163 aa, Artificial Sequence
  Synthetic sequence.
KEVEDAVKELEDLLRANEDKTRSIVEDMRASNKDLEDHSRASEEEVRKLLDDLRRAGVPRDSLKRLAEDVERVTRESRELLERVHRADRELIERLKESNERLRRAIEEIRKAIKGGSDIKTLLDRVRKLAEEDAERLDRLAMSCAQESERVRRVDKKLLEEIR

SEQ ID NO: 187 - protein, 166 aa, Artificial Sequence; identical to SEQ ID NO: 181
  Synthetic sequence.

SEQ ID NO: 188 - protein, 170 aa, Artificial Sequence; identical to SEQ ID NO: 183
  Synthetic sequence.

SEQ ID NO: 189 - protein, 174 aa, Artificial Sequence; identical to SEQ ID NO: 184
  Synthetic sequence.

SEQ ID NO: 190 - protein, 163 aa, Artificial Sequence
  Synthetic sequence.
DEEEDLERAIKKLLDENRELLKRIAEELRRLLEELRRLTEESADRLRRLLKELKDRGVPEEDLADVAEKVKKVLKESEDSNADVARKLEKLLRDLERSTERLEREARKVRKLLRGGKDAETLLRELEKLSRDNKELLKKLLMSCAQESKEDKERNIELSERLR

SEQ ID NO: 191 - protein, 170 aa, Artificial Sequence
  Synthetic sequence.
DEEEDLERAIKKLLDENRELLKRIAEELRRLLEELRRLTEESADRLRRLLKELKDRGVPEEDLADVAEKVKKVLKESEDSNADVARKLEKLLRDLERSTERLEREARKVRKLLRGGKDAETLLRELEKLSRDNKELLKKIEKEIRDLIMSCAQESIELSERLRKLVEELK

SEQ ID NO: 192 - protein, 174 aa, Artificial Sequence
  Synthetic sequence.
DEEEDLERAIKKLLDENRELLKRIAEELRRLLEELRRLTEESADRLRRLLKELKDRGVPEEDLADVAEKVKKVLKESEDSNADVARKLEKLLRDLERSTERLEREARKVRKLLRGGKDAETLLRELEKLSRDNKELLKKIEKEIRDLIKELKMSCAQESERLRKLVEELKKKAT

SEQ ID NO: 193 - protein, 163 aa, Artificial Sequence; identical to SEQ ID NO: 190
  Synthetic sequence.

SEQ ID NO: 194 - protein, 170 aa, Artificial Sequence
  Synthetic sequence.
DEEEDLERAIKKLLDENRELLKRIAEELRRLLEELRRLTEESADRLRRLLKELKDRGVPEEDLADVAEKVKKVLKESEDSNADVARKLEKLLRDLERSTERLEREARKVRKLLRGGKDAETLLRELEKLSRDNKELLKKIEKEIRDLVMSCAQESIELSERLRKLVEELK

SEQ ID NO: 195 - protein, 174 aa, Artificial Sequence; identical to SEQ ID NO: 192
  Synthetic sequence.

SEQ ID NO: 196 - protein, 163 aa, Artificial Sequence
  Synthetic sequence.
DDAERILREMERLLEENKEISDEIAKELKRLLDENRKLSEDVVKALEDLLRDLERRSGVSEEVLKRVREVLERIKRELDRSDDELRKVAERILRDAERSNDELRKVIEEIEEELRGSRDKDTLRELARSIRKLSAENKELLMSCAQESKKLSDENKERIKKLL

SEQ ID NO: 197 - protein, 167 aa, Artificial Sequence
  Synthetic sequence.
DDAERILREMERLLEENKEISDEIAKELKRLLDENRKLSEDVVKALEDLLRDLERRSGVSEEVLKRVREVLERIKRELDRSDDELRKVAERILRDAERSNDELRKVIEEIEEELRGSRDKDTLRELARSIRKLSAENKERLKELAMSCAQESDENKERIKKLLSDAE

SEQ ID NO: 198 - protein, 170 aa, Artificial Sequence
  Synthetic sequence.
DDAERILREMERLLEENKEISDEIAKELKRLLDENRKLSEDVVKALEDLLRDLERRSGVSEEVLKRVREVLERIKRELDRSDDELRKVAERILRDAERSNDELRKVIEEIEEELRGSRDKDTLRELARSIRKLSAENKERLKELLRLAMSCAQESKERIKKLLSDAEKII

SEQ ID NO: 199 - protein, 171 aa, Artificial Sequence
  Synthetic sequence.
DDAERILREMERLLEENKEISDEIAKELKRLLDENRKLSEDVVKALEDLLRDLERRSGVSEEVLKRVREVLERIKRELDRSDDELRKVAERILRDAERSNDELRKVIEEIEEELRGSRDKDTLRELARSIRKLSAENKERLKELLRELKMSCAQESERIKKLLSDAEKIIE

SEQ ID NO: 200 - protein, 174 aa, Artificial Sequence
  Synthetic sequence.
DDAERILREMERLLEENKEISDEIAKELKRLLDENRKLSEDVVKALEDLLRDLERRSGVSEEVLKRVREVLERIKRELDRSDDELRKVAERILRDAERSNDELRKVIEEIEEELRGSRDKDTLRELARSIRKLSAENKERLKELLRELKKLAMSCAQESKKLLSDAEKIIEDVA

SEQ ID NO: 201 - protein, 178 aa, Artificial Sequence
  Synthetic sequence.
DDAERILREMERLLEENKEISDEIAKELKRLLDENRKLSEDVVKALEDLLRDLERRSGVSEEVLKRVREVLERIKRELDRSDDELRKVAERILRDAERSNDELRKVIEEIEEELRGSRDKDTLRELARSIRKLSAENKERLKELLRELKKLSDELKMSCAQESSDAEKIIEDVARRAK

SEQ ID NO: 202 - protein, 162 aa, Artificial Sequence
  Synthetic sequence.
SSEERLRAVIEDLKRLAEESRKRHKELIDELAKAVERIERRHKKLLDEIKAVVDDIRRGVSEELLKRIEEVLDEIRKELEENIKRIRKVLDELRRTSEENIARIEKVLRELEDLVRKGGSDADTIIEEVKRVLEELARLTMSCAQESRDAIEELERSSEELA

SEQ ID NO: 203 - protein, 166 aa, Artificial Sequence
  Synthetic sequence.
SSEERLRAVIEDLKRLAEESRKRHKELIDELAKAVERIERRHKKLLDEIKAVVDDIRRGVSEELLKRIEEVLDEIRKELEENIKRIRKVLDELRRTSEENIARIEKVLRELEDLVRKGGSDADTIIEEVKRVLEELARSTEELAMSCAQESEELERSSEELARRIK

SEQ ID NO: 204 - protein, 169 aa, Artificial Sequence
  Synthetic sequence.
SSEERLRAVIEDLKRLAEESRKRHKELIDELAKAVERIERRHKKLLDEIKAVVDDIRRGVSEELLKRIEEVLDEIRKELEENIKRIRKVLDELRRTSEENIARIEKVLRELEDLVRKGGSDADTIIEEVKRVLEELARSTEEVEKLVMSCAQESERSSEELARRIKEVL

SEQ ID NO: 205 - protein, 170 aa, Artificial Sequence
  Synthetic sequence.
SSEERLRAVIEDLKRLAEESRKRHKELIDELAKAVERIERRHKKLLDEIKAVVDDIRRGVSEELLKRIEEVLDEIRKELEENIKRIRKVLDELRRTSEENIARIEKVLRELEDLVRKGGSDADTIIEEVKRVLEELARSTEEVEKRLRMSCAQESRSSEELARRIKEVLK

SEQ ID NO: 206 - protein, 173 aa, Artificial Sequence
  Synthetic sequence.
SSEERLRAVIEDLKRLAEESRKRHKELIDELAKAVERIERRHKKLLDEIKAVVDDIRRGVSEELLKRIEEVLDEIRKELEENIKRIRKVLDELRRTSEENIARIEKVLRELEDLVRKGGSDADTIIEEVKRVLEELARSTEEVEKRVRDLIMSCAQESEELARRIKEVLKRLE

SEQ ID NO: 207 - protein, 163 aa, Artificial Sequence
  Synthetic sequence.
DEARELVKELEDLIREITKTVRRLLEESEELIKRIDDAVDDLRRADEDLNREIKEEIEKGKSKESLEALIERLKESLERVKRTIEKLIRDLERLNEKLRRDVESLVAELEKILSKIKRGGLDERILRELEERVKELEKELRMSCAQESDETDKLREKAERILE

SEQ ID NO: 208 - protein, 166 aa, Artificial Sequence
  Synthetic sequence.
DEARELVKELEDLIREITKTVRRLLEESEELIKRIDDAVDDLRRADEDLNREIKEEIEKGKSKESLEALIERLKESLERVKRTIEKLIRDLERLNEKLRRDVESLVAELEKILSKIKRGGLDERILRELEERVKELEKEARELLMSCAQESDKLREKAERILEDLE

SEQ ID NO: 209 - protein, 170 aa, Artificial Sequence
  Synthetic sequence.
DEARELVKELEDLIREITKTVRRLLEESEELIKRIDDAVDDLRRADEDLNREIKEEIEKGKSKESLEALIERLKESLERVKRTIEKLIRDLERLNEKLRRDVESLVAELEKILSKIKRGGLDERILRELEERVKELEKEAREILKRLAMSCAQESEKAERILEDLERANR

SEQ ID NO: 210 - protein, 173 aa, Artificial Sequence
  Synthetic sequence.
DEARELVKELEDLIREITKTVRRLLEESEELIKRIDDAVDDLRRADEDLNREIKEEIEKGKSKESLEALIERLKESLERVKRTIEKLIRDLERLNEKLRRDVESLVAELEKILSKIKRGGLDERILRELEERVKELEKEAREILKRSEDLTMSCAQESERILEDLERANRRTM

SEQ ID NO: 211 - protein, 177 aa, Artificial Sequence
  Synthetic sequence.
DEARELVKELEDLIREITKTVRRLLEESEELIKRIDDAVDDLRRADEDLNREIKEEIEKGKSKESLEALIERLKESLERVKRTIEKLIRDLERLNEKLRRDVESLVAELEKILSKIKRGGLDERILRELEERVKELEKEAREILKRSEDETDKLRMSCAQESEDLERANRRTMDEAR

SEQ ID NO: 212 - protein, 163 aa, Artificial Sequence; identical to SEQ ID NO: 207
  Synthetic sequence.

SEQ ID NO: 213 - protein, 166 aa, Artificial Sequence; identical to SEQ ID NO: 208
  Synthetic sequence.

SEQ ID NO: 214 - protein, 173 aa, Artificial Sequence; identical to SEQ ID NO: 210
  Synthetic sequence.

SEQ ID NO: 215 - protein, 177 aa, Artificial Sequence; identical to SEQ ID NO: 211
  Synthetic sequence.

SEQ ID NO: 216 - protein, 169 aa, Artificial Sequence
  Synthetic sequence.
DEIRKVVKEITDLLKASNDKNRKVVEEIRDLLRKSKKLADELVERLRALVEDLRRRIDKSGDKETAEDIVRRIIEELKRILKEIEDLARRINREIERLVEEVERDNRDVNRAIEELLKDIARRGGSEDLKRVEERAREVSRRNEELAMSCAQESDRVSEANKEVLDRVR

SEQ ID NO: 217 - protein, 173 aa, Artificial Sequence
  Synthetic sequence.
DEIRKVVKEITDLLKASNDKNRKVVEEIRDLLRKSKKLADELVERLRALVEDLRRRIDKSGDKETAEDIVRRIIEELKRILKEIEDLARRINREIERLVEEVERDNRDVNRAIEELLKDIARRGGSEDLKRVEERAREVSRRNEESMRRLKMSCAQESEANKEVLDRVREEVK

SEQ ID NO: 218 - protein, 176 aa, Artificial Sequence
  Synthetic sequence.
DEIRKVVKEITDLLKASNDKNRKVVEEIRDLLRKSKKLADELVERLRALVEDLRRRIDKSGDKETAEDIVRRIIEELKRILKEIEDLARRINREIERLVEEVERDNRDVNRAIEELLKDIARRGGSEDLKRVEERAREVSRRNEESMRRVKELAMSCAQESKEVLDRVREEVKRLI

SEQ ID NO: 219 - protein, 177 aa, Artificial Sequence
  Synthetic sequence.
DEIRKVVKEITDLLKASNDKNRKVVEEIRDLLRKSKKLADELVERLRALVEDLRRRIDKSGDKETAEDIVRRIIEELKRILKEIEDLARRINREIERLVEEVERDNRDVNRAIEELLKDIARRGGSEDLKRVEERAREVSRRNEESMRRVKEDLDMSCAQESEVLDRVREEVKRLIE

SEQ ID NO: 220 - protein, 180 aa, Artificial Sequence
  Synthetic sequence.
DEIRKVVKEITDLLKASNDKNRKVVEEIRDLLRKSKKLADELVERLRALVEDLRRRIDKSGDKETAEDIVRRIIEELKRILKEIEDLARRINREIERLVEEVERDNRDVNRAIEELLKDIARRGGSEDLKRVEERAREVSRRNEESMRRVKEDADRLKMSCAQESDRVREEVKRLIEEVR

SEQ ID NO: 221 - protein, 183 aa, Artificial Sequence
  Synthetic sequence.
DEIRKVVKEITDLLKASNDKNRKVVEEIRDLLRKSKKLADELVERLRALVEDLRRRIDKSGDKETAEDIVRRIIEELKRILKEIEDLARRINREIERLVEEVERDNRDVNRAIEELLKDIARRGGSEDLKRVEERAREVSRRNEESMRRVKEDADRVSELAMSCAQESREEVKRLIEEVRETL

SEQ ID NO: 222 - protein, 169 aa, Artificial Sequence
  Synthetic sequence.
DEIRKVVKEITDLLKASNDKNRKVVEEIRDLLRKSKKLADELVERLRALVEDLRRRIDKSGDKETAEDIVRRIIEELKRILKEIEDLARRINREIERLVEEVERDNRDVNRAIEELLKDIARRGGSEDLKRVEERAREVSRRNEELMMSCAQESDRVSEANKEVLDRVR

SEQ ID NO: 223 - protein, 173 aa, Artificial Sequence; identical to SEQ ID NO: 217
  Synthetic sequence.

SEQ ID NO: 224 - protein, 176 aa, Artificial Sequence; identical to SEQ ID NO: 218
  Synthetic sequence.

SEQ ID NO: 225 - protein, 180 aa, Artificial Sequence; identical to SEQ ID NO: 220
  Synthetic sequence.

SEQ ID NO: 226 - protein, 183 aa, Artificial Sequence
  Synthetic sequence.
DEIRKVVKEITDLLKASNDKNRKVVEEIRDLLRKSKKLADELVERLRALVEDLRRRIDKSGDKETAEDIVRRIIEELKRILKEIEDLARRINREIERLVEEVERDNRDVNRAIEELLKDIARRGGSEDLKRVEERAREVSRRNEESMRRVKEDADRVSELTMSCAQESREEVKRLIEEVRETL

SEQ ID NO: 227 - protein, 161 aa, Artificial Sequence
  Synthetic sequence.
STAETVEKKVEEVIRENEKSMRESEEKVDRSTKRIEDVLRRLEETIRKTSDDIAKGVKGERVKEVLEENRRLLEEAKKLVDEVLETNKKLLEDDKRLNEEVSKTLKKLLEEIKSVDTREDATRVIEEAKRILDEARKLNMSCAQESEELVRRIERVIEEII

SEQ ID NO: 228 - protein, 162 aa, Artificial Sequence
  Synthetic sequence.
STAETVEKKVEEVIRENEKSMRESEEKVDRSTKRIEDVLRRLEETIRKTSDDIAKGVKGERVKEVLEENRRLLEEAKKLVDEVLETNKKLLEDDKRLNEEVSKTLKKLLEEIKSVDTREDATRVIEEAKRILDEARKLLKMSCAQESELVRRIERVIEEIIK

SEQ ID NO: 229 - protein, 165 aa, Artificial Sequence
  Synthetic sequence.
STAETVEKKVEEVIRENEKSMRESEEKVDRSTKRIEDVLRRLEETIRKTSDDIAKGVKGERVKEVLEENRRLLEEAKKLVDEVLETNKKLLEDDKRLNEEVSKTLKKLLEEIKSVDTREDATRVIEEAKRILDEARKLNEELIMSCAQESRRIERVIEEIIKRSE

SEQ ID NO: 230 - protein, 168 aa, Artificial Sequence
  Synthetic sequence.
STAETVEKKVEEVIRENEKSMRESEEKVDRSTKRIEDVLRRLEETIRKTSDDIAKGVKGERVKEVLEENRRLLEEAKKLVDEVLETNKKLLEDDKRLNEEVSKTLKKLLEEIKSVDTREDATRVIEEAKRILDEARKLNEETIRLAMSCAQESERVIEEIIKRSEKLL

SEQ ID NO: 231 - protein, 169 aa, Artificial Sequence
  Synthetic sequence.
STAETVEKKVEEVIRENEKSMRESEEKVDRSTKRIEDVLRRLEETIRKTSDDIAKGVKGERVKEVLEENRRLLEEAKKLVDEVLETNKKLLEDDKRLNEEVSKTLKKLLEEIKSVDTREDATRVIEEAKRILDEARKLNEETIRRLEMSCAQESRVIEEIIKRSEKLLE

SEQ ID NO: 232 - protein, 172 aa, Artificial Sequence
  Synthetic sequence.
STAETVEKKVEEVIRENEKSMRESEEKVDRSTKRIEDVLRRLEETIRKTSDDIAKGVKGERVKEVLEENRRLLEEAKKLVDEVLETNKKLLEDDKRLNEEVSKTLKKLLEEIKSVDTREDATRVIEEAKRILDEARKLNEETIRRSEELAMSCAQESEEIIKRSEKLLEDVA

SEQ ID NO: 233 - protein, 176 aa, Artificial Sequence
  Synthetic sequence.
STAETVEKKVEEVIRENEKSMRESEEKVDRSTKRIEDVLRRLEETIRKTSDDIAKGVKGERVKEVLEENRRLLEEAKKLVDEVLETNKKLLEDDKRLNEEVSKTLKKLLEEIKSVDTREDATRVIEEAKRILDEARKLNEETIRRSEELVRRLEMSCAQESKRSEKLLEDVARESK

SEQ ID NO: 234 - protein, 161 aa, Artificial Sequence; identical to SEQ ID NO: 227
  Synthetic sequence.

SEQ ID NO: 235 - protein, 162 aa, Artificial Sequence; identical to SEQ ID NO: 228
  Synthetic sequence.

SEQ ID NO: 236 - protein, 165 aa, Artificial Sequence; identical to SEQ ID NO: 229
  Synthetic sequence.

SEQ ID NO: 237 - protein, 168 aa, Artificial Sequence; identical to SEQ ID NO: 230
  Synthetic sequence.

SEQ ID NO: 238 - protein, 169 aa, Artificial Sequence; identical to SEQ ID NO: 231
  Synthetic sequence.

SEQ ID NO: 239 - protein, 172 aa, Artificial Sequence; identical to SEQ ID NO: 232
  Synthetic sequence.

SEQ ID NO: 240 - protein, 176 aa, Artificial Sequence; identical to SEQ ID NO: 233
  Synthetic sequence.

SEQ ID NO: 241 - protein, 161 aa, Artificial Sequence
  Synthetic sequence.
STAETVAEEVERVLKHSDDLIKEVEDVNRRVEEEIKRVIRELEEENERLVAEVRKGVKGEILAEIEKRLADNSEKVREVAERAKKLLEENTARVKDILRESRKLVKDLLDEVRGTGSEEAAREIIKRLREVNKRTKELLMSCAQESEEVLERVKRLIDELR

SEQ ID NO: 242 - protein, 162 aa, Artificial Sequence
  Synthetic sequence.
STAETVAEEVERVLKHSDDLIKEVEDVNRRVEEEIKRVIRELEEENERLVAEVRKGVKGEILAEIEKRLADNSEKVREVAERAKKLLEENTARVKDILRESRKLVKDLLDEVRGTGSEEAAREIIKRLREVNKRTKEKLDMSCAQESEVLERVKRLIDELRK

SEQ ID NO: 243 - protein, 165 aa, Artificial Sequence
  Synthetic sequence.
STAETVAEEVERVLKHSDDLIKEVEDVNRRVEEEIKRVIRELEEENERLVAEVRKGVKGEILAEIEKRLADNSEKVREVAERAKKLLEENTARVKDILRESRKLVKDLLDEVRGTGSEEAAREIIKRLREVNKRTKEKLDELIMSCAQESERVKRLIDELRKHSE

SEQ ID NO: 244 - protein, 168 aa, Artificial Sequence
  Synthetic sequence.
STAETVAEEVERVLKHSDDLIKEVEDVNRRVEEEIKRVIRELEEENERLVAEVRKGVKGEILAEIEKRLADNSEKVREVAERAKKLLEENTARVKDILRESRKLVKDLLDEVRGTGSEEAAREIIKRLREVNKRTKEKLDELIKLAMSCAQESKRLIDELRKHSEEVL

SEQ ID NO: 245 - protein, 172 aa, Artificial Sequence
  Synthetic sequence.
STAETVAEEVERVLKHSDDLIKEVEDVNRRVEEEIKRVIRELEEENERLVAEVRKGVKGEILAEIEKRLADNSEKVREVAERAKKLLEENTARVKDILRESRKLVKDLLDEVRGTGSEEAAREIIKRLREVNKRTKEKLDELIKHSEELLMSCAQESDELRKHSEEVLEDLR

SEQ ID NO: 246 - protein, 176 aa, Artificial Sequence
  Synthetic sequence.
STAETVAEEVERVLKHSDDLIKEVEDVNRRVEEEIKRVIRELEEENERLVAEVRKGVKGEILAEIEKRLADNSEKVREVAERAKKLLEENTARVKDILRESRKLVKDLLDEVRGTGSEEAAREIIKRLREVNKRTKEKLDELIKHSEEVLERLKMSCAQESKHSEEVLEDLRRRAK

SEQ ID NO: 247 - protein, 161 aa, Artificial Sequence; identical to SEQ ID NO: 241
  Synthetic sequence.

SEQ ID NO: 248 - protein, 162 aa, Artificial Sequence; identical to SEQ ID NO: 242
  Synthetic sequence.

SEQ ID NO: 249 - protein, 165 aa, Artificial Sequence; identical to SEQ ID NO: 243
  Synthetic sequence.

SEQ ID NO: 250 - protein, 168 aa, Artificial Sequence; identical to SEQ ID NO: 244
  Synthetic sequence.

SEQ ID NO: 251 - protein, 176 aa, Artificial Sequence
  Synthetic sequence.
STAETVAEEVERVLKHSDDLIKEVEDVNRRVEEEIKRVIRELEEENERLVAEVRKGVKGEILAEIEKRLADNSEKVREVAERAKKLLEENTARVKDILRESRKLVKDLLDEVRGTGSEEAAREIIKRLREVNKRTKEKLDELIKHSEEVLERLIMSCAQESKHSEEVLEDLRRRAK

SEQ ID NO: 252 - protein, 167 aa, Artificial Sequence
  Synthetic sequence.
DEVREVAERLRRLVDESRKRNEEVIKESEALVDRVRKTNEEVMKRLRELIDKLEKDIRRSGDKETVEKIIREVLSAIDELLKRVERTNAEISKENARLLDEVRKTNEEISRRLAKLLEDIRRGSGDAETIERVVRELLEENKELLMSCAQESKRSTETNKRLLEASK

SEQ ID NO: 253 - protein, 170 aa, Artificial Sequence
  Synthetic sequence.
DEVREVAERLRRLVDESRKRNEEVIKESEALVDRVRKTNEEVMKRLRELIDKLEKDIRRSGDKETVEKIIREVLSAIDELLKRVERTNAEISKENARLLDEVRKTNEEISRRLAKLLEDIRRGSGDAETIERVVRELLEENKEVLRLAMSCAQESTETNKRLLEASKEVA

SEQ ID NO: 254 - protein, 171 aa, Artificial Sequence
  Synthetic sequence.
DEVREVAERLRRLVDESRKRNEEVIKESEALVDRVRKTNEEVMKRLRELIDKLEKDIRRSGDKETVEKIIREVLSAIDELLKRVERTNAEISKENARLLDEVRKTNEEISRRLAKLLEDIRRGSGDAETIERVVRELLEENKEVLRKLEMSCAQESETNKRLLEASKEVAD

SEQ ID NO: 255 - protein, 174 aa, Artificial Sequence
  Synthetic sequence.
DEVREVAERLRRLVDESRKRNEEVIKESEALVDRVRKTNEEVMKRLRELIDKLEKDIRRSGDKETVEKIIREVLSAIDELLKRVERTNAEISKENARLLDEVRKTNEEISRRLAKLLEDIRRGSGDAETIERVVRELLEENKEVLRKTEELAMSCAQESKRLLEASKEVADRLR

SEQ ID NO: 256 - protein, 175 aa, Artificial Sequence
  Synthetic sequence.
DEVREVAERLRRLVDESRKRNEEVIKESEALVDRVRKTNEEVMKRLRELIDKLEKDIRRSGDKETVEKIIREVLSAIDELLKRVERTNAEISKENARLLDEVRKTNEEISRRLAKLLEDIRRGSGDAETIERVVRELLEENKEVLRKTEEALKMSCAQESRLLEASKEVADRLRE

SEQ ID NO: 257 - protein, 178 aa, Artificial Sequence
  Synthetic sequence.
DEVREVAERLRRLVDESRKRNEEVIKESEALVDRVRKTNEEVMKRLRELIDKLEKDIRRSGDKETVEKIIREVLSAIDELLKRVERTNAEISKENARLLDEVRKTNEEISRRLAKLLEDIRRGSGDAETIERVVRELLEENKEVLRKTEEAVKRLAMSCAQESEASKEVADRLRERIK

SEQ ID NO: 258 - protein, 181 aa, Artificial Sequence
  Synthetic sequence.
DEVREVAERLRRLVDESRKRNEEVIKESEALVDRVRKTNEEVMKRLRELIDKLEKDIRRSGDKETVEKIIREVLSAIDELLKRVERTNAEISKENARLLDEVRKTNEEISRRLAKLLEDIRRGSGDAETIERVVRELLEENKEVLRKTEEAVKRSTELVMSCAQESKEVADRLRERIKEAA

SEQ ID NO: 259 - protein, 171 aa, Artificial Sequence
  Synthetic sequence.
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGDEDKARKVAEVAEKVLRDIDKLAMSCAQESRATNEEIAKLDEDTA

SEQ ID NO: 260 - protein, 174 aa, Artificial Sequence
  Synthetic sequence.
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGDEDKARKVAEVAEKVLRDIDKLDRLSMSCAQESNEEIAKLDEDTARVA

SEQ ID NO: 261 - protein, 175 aa, Artificial Sequence
  Synthetic sequence.
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGDEDKARKVAEVAEKVLRDIDKLDRELKMSCAQESEEIAKLDEDTARVAE

SEQ ID NO: 262 - protein, 178 aa, Artificial Sequence
  Synthetic sequence.
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGDEDKARKVAEVAEKVLRDIDKLDRESKELGMSCAQESAKLDEDTARVAERVK

SEQ ID NO: 263 - protein, 179 aa, Artificial Sequence
  Synthetic sequence.
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGDEDKARKVAEVAEKVLRDIDKLDRESKEALRMSCAQESKLDEDTARVAERVKK

SEQ ID NO: 264 - protein, 182 aa, Artificial Sequence
  Synthetic sequence.
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGDEDKARKVAEVAEKVLRDIDKLDRESKEAFRALNMSCAQESEDTARVAERVKKAIE

SEQ ID NO: 265 - protein, 185 aa, Artificial Sequence
  Synthetic sequence.
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGDEDKARKVAEVAEKVLRDIDKLDRESKEAFRATNELIMSCAQESARVAERVKKAIEDLA

SEQ ID NO: 266 - protein, 171 aa, Artificial Sequence
  Synthetic sequence.
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGDEDKARKVAEVAEKVLRDIDKLLMSCAQESRATNEEIAKLDEDTA

SEQ ID NO: 267 - protein, 175 aa, Artificial Sequence; identical to SEQ ID NO: 261
  Synthetic sequence.

SEQ ID NO: 268 - protein, 178 aa, Artificial Sequence
  Synthetic sequence.
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGDEDKARKVAEVAEKVLRDIDKLDRESKELFMSCAQESAKLDEDTARVAERVK

SEQ ID NO: 269 - protein, 179 aa, Artificial Sequence; identical to SEQ ID NO: 263
  Synthetic sequence.

SEQ ID NO: 270 - protein, 182 aa, Artificial Sequence
  Synthetic sequence.
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGDEDKARKVAEVAEKVLRDIDKLDRESKEAFRALAMSCAQESEDTARVAERVKKAIE

SEQ ID NO: 271 - protein, 185 aa, Artificial Sequence; identical to SEQ ID NO: 265
  Synthetic sequence.

SEQ ID NO: 272 - protein, 171 aa, Artificial Sequence
  Synthetic sequence.
SEVDEIIKELERLLAEIARENERIIRESRKLADEVRKRNEDAIRKLEELVARLADAVRRKGSESEEVKKLIEDVLREIERLLKRIEEENREVVKRNSELVERVRAINEEILRRVAELVEKIARDIGDKDEVTKVKKVADDVLAEIKKLLMSCAQESEDTNKKIADLDKATR

SEQ ID NO: 273 - protein, 174 aa, Artificial Sequence
  Synthetic sequence.
SEVDEIIKELERLLAEIARENERIIRESRKLADEVRKRNEDAIRKLEELVARLADAVRRKGSESEEVKKLIEDVLREIERLLKRIEEENREVVKRNSELVERVRAINEEILRRVAELVEKIARDIGDKDEVTKVKKVADDVLAEIKKLDDLTMSCAQESNKKIADLDKATRDVV

SEQ ID NO: 274 - protein, 175 aa, Artificial Sequence
  Synthetic sequence.
SEVDEIIKELERLLAEIARENERIIRESRKLADEVRKRNEDAIRKLEELVARLADAVRRKGSESEEVKKLIEDVLREIERLLKRIEEENREVVKRNSELVERVRAINEEILRRVAELVEKIARDIGDKDEVTKVKKVADDVLAEIKKLDDELRMSCAQESKKIADLDKATRDVVR

SEQ ID NO: 275 - protein, 178 aa, Artificial Sequence
  Synthetic sequence.
SEVDEIIKELERLLAEIARENERIIRESRKLADEVRKRNEDAIRKLEELVARLADAVRRKGSESEEVKKLIEDVLREIERLLKRIEEENREVVKRNSELVERVRAINEEILRRVAELVEKIARDIGDKDEVTKVKKVADDVLAEIKKLDDETRRLGMSCAQESADLDKATRDVVRKVL

SEQ ID NO: 276 - protein, 179 aa, Artificial Sequence
  Synthetic sequence.
SEVDEIIKELERLLAEIARENERIIRESRKLADEVRKRNEDAIRKLEELVARLADAVRRKGSESEEVKKLIEDVLREIERLLKRIEEENREVVKRNSELVERVRAINEEILRRVAELVEKIARDIGDKDEVTKVKKVADDVLAEIKKLDDETRRVLEMSCAQESDLDKATRDVVRKVLE

SEQ ID NO: 277 - protein, 182 aa, Artificial Sequence
  Synthetic sequence.
SEVDEIIKELERLLAEIARENERIIRESRKLADEVRKRNEDAIRKLEELVARLADAVRRKGSESEEVKKLIEDVLREIERLLKRIEEENREVVKRNSELVERVRAINEEILRRVAELVEKIARDIGDKDEVTKVKKVADDVLAEIKKLDDETRRVIEDLAMSCAQESKATRDVVRKVLEEVK

SEQ ID NO: 278 - protein, 185 aa, Artificial Sequence
  Synthetic sequence.
SEVDEIIKELERLLAEIARENERIIRESRKLADEVRKRNEDAIRKLEELVARLADAVRRKGSESEEVKKLIEDVLREIERLLKRIEEENREVVKRNSELVERVRAINEEILRRVAELVEKIARDIGDKDEVTKVKKVADDVLAEIKKLDDETRRVIEDTNKLIMSCAQESRDVVRKVLEEVKKLE

SEQ ID NO: 279 - protein, 165 aa, Artificial Sequence
  Synthetic sequence.
REVEEMIKELEELLKDLKEKNERASKRNRELVRRLEEENKRVIEELKKLVKELEDLVRSGEDEEVLREVLKRLEEVLERVRALNERVLEAIEKSLEEVKASNEAVKRRLKELLEEAERGVDSEKLKELRDVIAEVAKRIDELHMSCAQESRRAKKEIERLNRETK

SEQ ID NO: 280 - protein, 168 aa, Artificial Sequence
  Synthetic sequence.
REVEEMIKELEELLKDLKEKNERASKRNRELVRRLEEENKRVIEELKKLVKELEDLVRSGEDEEVLREVLKRLEEVLERVRALNERVLEAIEKSLEEVKASNEAVKRRLKELLEEAERGVDSEKLKELRDVIAEVAKRIDELDELTMSCAQESKKEIERLNRETKKVI

SEQ ID NO: 281 - protein, 169 aa, Artificial Sequence
  Synthetic sequence.
REVEEMIKELEELLKDLKEKNERASKRNRELVRRLEEENKRVIEELKKLVKELEDLVRSGEDEEVLREVLKRLEEVLERVRALNERVLEAIEKSLEEVKASNEAVKRRLKELLEEAERGVDSEKLKELRDVIAEVAKRIDELDEYLRMSCAQESKEIERLNRETKKVIE

SEQ ID NO: 282 - protein, 172 aa, Artificial Sequence
  Synthetic sequence.
REVEEMIKELEELLKDLKEKNERASKRNRELVRRLEEENKRVIEELKKLVKELEDLVRSGEDEEVLREVLKRLEEVLERVRALNERVLEAIEKSLEEVKASNEAVKRRLKELLEEAERGVDSEKLKELRDVIAEVAKRIDELDEYTRELAMSCAQESERLNRETKKVIEEVV

SEQ ID NO: 283 - protein, 176 aa, Artificial Sequence
  Synthetic sequence.
REVEEMIKELEELLKDLKEKNERASKRNRELVRRLEEENKRVIEELKKLVKELEDLVRSGEDEEVLREVLKRLEEVLERVRALNERVLEAIEKSLEEVKASNEAVKRRLKELLEEAERGVDSEKLKELRDVIAEVAKRIDELDEYTRESIRRLKMSCAQESRETKKVIEEVVKRIE

SEQ ID NO: 284 - protein, 179 aa, Artificial Sequence
  Synthetic sequence.
REVEEMIKELEELLKDLKEKNERASKRNRELVRRLEEENKRVIEELKKLVKELEDLVRSGEDEEVLREVLKRLEEVLERVRALNERVLEAIEKSLEEVKASNEAVKRRLKELLEEAERGVDSEKLKELRDVIAEVAKRIDELDEYTRESIRRAKKLIMSCAQESKKVIEEVVKRIEEER

SEQ ID NO: 285 - protein, 165 aa, Artificial Sequence; identical to SEQ ID NO: 279
  Synthetic sequence.

SEQ ID NO: 286 - protein, 168 aa, Artificial Sequence; identical to SEQ ID NO: 280
  Synthetic sequence.

SEQ ID NO: 287 - protein, 169 aa, Artificial Sequence; identical to SEQ ID NO: 281
  Synthetic sequence.

SEQ ID NO: 288 - protein, 172 aa, Artificial Sequence; identical to SEQ ID NO: 282
  Synthetic sequence.

SEQ ID NO: 289 - protein, 173 aa, Artificial Sequence
  Synthetic sequence.
REVEEMIKELEELLKDLKEKNERASKRNRELVRRLEEENKRVIEELKKLVKELEDLVRSGEDEEVLREVLKRLEEVLERVRALNERVLEAIEKSLEEVKASNEAVKRRLKELLEEAERGVDSEKLKELRDVIAEVAKRIDELDEYTRESLKMSCAQESRLNRETKKVIEEVVK

SEQ ID NO: 290 - protein, 176 aa, Artificial Sequence
  Synthetic sequence.
REVEEMIKELEELLKDLKEKNERASKRNRELVRRLEEENKRVIEELKKLVKELEDLVRSGEDEEVLREVLKRLEEVLERVRALNERVLEAIEKSLEEVKASNEAVKRRLKELLEEAERGVDSEKLKELRDVIAEVAKRIDELDEYTRESIRRLAMSCAQESRETKKVIEEVVKRIE

SEQ ID NO: 291 - protein, 179 aa, Artificial Sequence; identical to SEQ ID NO: 284
  Synthetic sequence.

SEQ ID NO: 292 - protein, 166 aa, Artificial Sequence
  Synthetic sequence.
DAVEEAEKLIRKVIADSEKLLRDLADLNAKSIRRSEKLVEDDRRANEDVIRKLEELRRNGGSEEELRALLKEVEDTNRASHETNKRLLDEDRALNKEVHDRNEKLLRDIKRLVEEVAKGIDSEELLRRIKKLLDEIKKAIEDLAMSCAQESEESERVMKRSSEDIK

SEQ ID NO: 293 - protein, 169 aa, Artificial Sequence
  Synthetic sequence.
DAVEEAEKLIRKVIADSEKLLRDLADLNAKSIRRSEKLVEDDRRANEDVIRKLEELRRNGGSEEELRALLKEVEDTNRASHETNKRLLDEDRALNKEVHDRNEKLLRDIKRLVEEVAKGIDSEELLRRIKKLLDEIKKAIEDSSRLIMSCAQESERVMKRSSEDIKRTL

SEQ ID NO: 294 - protein, 173 aa, Artificial Sequence
  Synthetic sequence.
DAVEEAEKLIRKVIADSEKLLRDLADLNAKSIRRSEKLVEDDRRANEDVIRKLEELRRNGGSEEELRALLKEVEDTNRASHETNKRLLDEDRALNKEVHDRNEKLLRDIKRLVEEVAKGIDSEELLRRIKKLLDEIKKAIEDSSREIKRLLMSCAQESKRSSEDIKRTLDDTR

SEQ ID NO: 295 - protein, 176 aa, Artificial Sequence
  Synthetic sequence.
DAVEEAEKLIRKVIADSEKLLRDLADLNAKSIRRSEKLVEDDRRANEDVIRKLEELRRNGGSEEELRALLKEVEDTNRASHETNKRLLDEDRALNKEVHDRNEKLLRDIKRLVEEVAKGIDSEELLRRIKKLLDEIKKAIEDSSREIKRLLELAMSCAQESSEDIKRTLDDTRRVV

SEQ ID NO: 296 - protein, 177 aa, Artificial Sequence
  Synthetic sequence.
DAVEEAEKLIRKVIADSEKLLRDLADLNAKSIRRSEKLVEDDRRANEDVIRKLEELRRNGGSEEELRALLKEVEDTNRASHETNKRLLDEDRALNKEVHDRNEKLLRDIKRLVEEVAKGIDSEELLRRIKKLLDEIKKAIEDSSREIKRLLEELEMSCAQESEDIKRTLDDTRRVVE

SEQ ID NO: 297 - protein, 180 aa, Artificial Sequence
  Synthetic sequence.
DAVEEAEKLIRKVIADSEKLLRDLADLNAKSIRRSEKLVEDDRRANEDVIRKLEELRRNGGSEEELRALLKEVEDTNRASHETNKRLLDEDRALNKEVHDRNEKLLRDIKRLVEEVAKGIDSEELLRRIKKLLDEIKKAIEDSSREIKRLLEESERLAMSCAQESKRTLDDTRRVVEEVR

SEQ ID NO: 298 - protein, 181 aa, Artificial Sequence
  Synthetic sequence.
DAVEEAEKLIRKVIADSEKLLRDLADLNAKSIRRSEKLVEDDRRANEDVIRKLEELRRNGGSEEELRALLKEVEDTNRASHETNKRLLDEDRALNKEVHDRNEKLLRDIKRLVEEVAKGIDSEELLRRIKKLLDEIKKAIEDSSREIKRLLEESERVLIMSCAQESRTLDDTRRVVEEVRR

SEQ ID NO: 299 - protein, 166 aa, Artificial Sequence
  Synthetic sequence.
DAVEEAEKLIRKVIADSEKLLRDLADLNAKSIRRSEKLVEDDRRANEDVIRKLEELRRNGGSEEELRALLKEVEDTNRASHETNKRLLDEDRALNKEVHDRNEKLLRDIKRLVEEVAKGIDSEELLRRIKKLLDEIKKAIEDLNMSCAQESEESERVMKRSSEDIK

SEQ ID NO: 300 - protein, 169 aa, Artificial Sequence; identical to SEQ ID NO: 293
  Synthetic sequence.

SEQ ID NO: 301 - protein, 173 aa, Artificial Sequence; identical to SEQ ID NO: 294
  Synthetic sequence.

SEQ ID NO: 302 - protein, 176 aa, Artificial Sequence; identical to SEQ ID NO: 295
  Synthetic sequence.

SEQ ID NO: 303 - protein, 177 aa, Artificial Sequence; identical to SEQ ID NO: 296
  Synthetic sequence.

SEQ ID NO: 304 - protein, 180 aa, Artificial Sequence; identical to SEQ ID NO: 297
  Synthetic sequence.

SEQ ID NO: 305 - protein, 166 aa, Artificial Sequence
  Synthetic sequence.
SSDEVLKEIEEIIRRLEAEVRRVNAEVNASTEDLAREVEEVLRATNELIEELERRVTGTEELKRVIDELRDRDRKVRRRVERVIEESAKRDDESRKRLTRAVEKLRADLKKLADDGVPEEALSKAIKDVRDIVKKVKDELKELLMSCAQESDRLSEELKEWLKDVE

SEQ ID NO: 306 - protein, 160 aa, Artificial Sequence
  Synthetic sequence.
SEADDVLKKLAETVKRIIERLKKLTDDSRRLVEEVHRRNDKLSKESAEAVRKAEERGIDEKDVRKLLEDLKKKSEEVAERNKRILDTLREISKRAEDEVRKVLKELEKTLKELEDRRPDSEELSAEVKKLLDEVRKLLMSCAQESDKLLKEIEDSLRRHK

SEQ ID NO: 307 - protein, 164 aa, Artificial Sequence
  Synthetic sequence.
SEADDVLKKLAETVKRIIERLKKLTDDSRRLVEEVHRRNDKLSKESAEAVRKAEERGIDEKDVRKLLEDLKKKSEEVAERNKRILDTLREISKRAEDEVRKVLKELEKTLKELEDRRPDSEELSAEVKKLLDEVRKALARLLMSCAQESKEIEDSLRRHKEEND

SEQ ID NO: 308 - protein, 167 aa, Artificial Sequence
  Synthetic sequence.
SEADDVLKKLAETVKRIIERLKKLTDDSRRLVEEVHRRNDKLSKESAEAVRKAEERGIDEKDVRKLLEDLKKKSEEVAERNKRILDTLREISKRAEDEVRKVLKELEKTLKELEDRRPDSEELSAEVKKLLDEVRKALARHKDLVMSCAQESEDSLRRHKEENDRLL

SEQ ID NO: 309 - protein, 168 aa, Artificial Sequence
  Synthetic sequence.
SEADDVLKKLAETVKRIIERLKKLTDDSRRLVEEVHRRNDKLSKESAEAVRKAEERGIDEKDVRKLLEDLKKKSEEVAERNKRILDTLREISKRAEDEVRKVLKELEKTLKELEDRRPDSEELSAEVKKLLDEVRKALARHKDELDMSCAQESDSLRRHKEENDRLLE

SEQ ID NO: 310 - protein, 171 aa, Artificial Sequence
  Synthetic sequence.
SEADDVLKKLAETVKRIIERLKKLTDDSRRLVEEVHRRNDKLSKESAEAVRKAEERGIDEKDVRKLLEDLKKKSEEVAERNKRILDTLREISKRAEDEVRKVLKELEKTLKELEDRRPDSEELSAEVKKLLDEVRKALARHKDENDKLCMSCAQESRRHKEENDRLLEKLK

SEQ ID NO: 311 - protein, 174 aa, Artificial Sequence
  Synthetic sequence.
SEADDVLKKLAETVKRIIERLKKLTDDSRRLVEEVHRRNDKLSKESAEAVRKAEERGIDEKDVRKLLEDLKKKSEEVAERNKRILDTLREISKRAEDEVRKVLKELEKTLKELEDRRPDSEELSAEVKKLLDEVRKALARHKDENDKLLKLIMSCAQESKEENDRLLEKLKEST

SEQ ID NO: 312 - protein, 175 aa, Artificial Sequence
  Synthetic sequence.
SEADDVLKKLAETVKRIIERLKKLTDDSRRLVEEVHRRNDKLSKESAEAVRKAEERGIDEKDVRKLLEDLKKKSEEVAERNKRILDTLREISKRAEDEVRKVLKELEKTLKELEDRRPDSEELSAEVKKLLDEVRKALARHKDENDKLLKELEMSCAQESEENDRLLEKLKESTR

SEQ ID NO: 313 - protein, 160 aa, Artificial Sequence; identical to SEQ ID NO: 306
  Synthetic sequence.

SEQ ID NO: 314 - protein, 164 aa, Artificial Sequence; identical to SEQ ID NO: 307
  Synthetic sequence.

SEQ ID NO: 315 - protein, 167 aa, Artificial Sequence
  Synthetic sequence.
SEADDVLKKLAETVKRIIERLKKLTDDSRRLVEEVHRRNDKLSKESAEAVRKAEERGIDEKDVRKLLEDLKKKSEEVAERNKRILDTLREISKRAEDEVRKVLKELEKTLKELEDRRPDSEELSAEVKKLLDEVRKALARHKDLAMSCAQESEDSLRRHKEENDRLL

SEQ ID NO: 316 - protein, 168 aa, Artificial Sequence
  Synthetic sequence.
SEADDVLKKLAETVKRIIERLKKLTDDSRRLVEEVHRRNDKLSKESAEAVRKAEERGIDEKDVRKLLEDLKKKSEEVAERNKRILDTLREISKRAEDEVRKVLKELEKTLKELEDRRPDSEELSAEVKKLLDEVRKALARHKDELLMSCAQESDSLRRHKEENDRLLE

SEQ ID NO: 317 - protein, 171 aa, Artificial Sequence
  Synthetic sequence.
SEADDVLKKLAETVKRIIERLKKLTDDSRRLVEEVHRRNDKLSKESAEAVRKAEERGIDEKDVRKLLEDLKKKSEEVAERNKRILDTLREISKRAEDEVRKVLKELEKTLKELEDRRPDSEELSAEVKKLLDEVRKALARHKDENDKLMMSCAQESRRHKEENDRLLEKLK

SEQ ID NO: 318 - protein, 174 aa, Artificial Sequence; identical to SEQ ID NO: 311
  Synthetic sequence.

SEQ ID NO: 319 - protein, 170 aa, Artificial Sequence
  Synthetic sequence.
SEIDEVLTRLRKISKDLNETSDRVNERARKIIDDIKKESKRVNDEAREIVERLKREIDKTRDRDVLRRILKEIEDVARRVKEINEELLARVEKVVREVEEINRELVKRSREAVEAVKRLLDRGVSDEDKVERVVREVEKLHEEDRKLLMSCAQESRKLLEELKRELEKST

SEQ ID NO: 320 - protein, 171 aa, Artificial Sequence
  Synthetic sequence.
SEIDEVLTRLRKISKDLNETSDRVNERARKIIDDIKKESKRVNDEAREIVERLKREIDKTRDRDVLRRILKEIEDVARRVKEINEELLARVEKVVREVEEINRELVKRSREAVEAVKRLLDRGVSDEDKVERVVREVEKLHEEDRKRLEMSCAQESKLLEELKRELEKSTR

SEQ ID NO: 321 - protein, 174 aa, Artificial Sequence
  Synthetic sequence.
SEIDEVLTRLRKISKDLNETSDRVNERARKIIDDIKKESKRVNDEAREIVERLKREIDKTRDRDVLRRILKEIEDVARRVKEINEELLARVEKVVREVEEINRELVKRSREAVEAVKRLLDRGVSDEDKVERVVREVEKLHEEDRKRLEELTMSCAQESEELKRELEKSTRSVK

SEQ ID NO: 322 - protein, 181 aa, Artificial Sequence
  Synthetic sequence.
SEIDEVLTRLRKISKDLNETSDRVNERARKIIDDIKKESKRVNDEAREIVERLKREIDKTRDRDVLRRILKEIEDVARRVKEINEELLARVEKVVREVEEINRELVKRSREAVEAVKRLLDRGVSDEDKVERVVREVEKLHEEDRKRLEESTRSVRKLMMSCAQESEKSTRSVKALVDELR

SEQ ID NO: 323 - protein, 185 aa, Artificial Sequence
  Synthetic sequence.
SEIDEVLTRLRKISKDLNETSDRVNERARKIIDDIKKESKRVNDEAREIVERLKREIDKTRDRDVLRRILKEIEDVARRVKEINEELLARVEKVVREVEEINRELVKRSREAVEAVKRLLDRGVSDEDKVERVVREVEKLHEEDRKRLEESTRSVRKLLEELKMSCAQESRSVKALVDELRERVR

SEQ ID NO: 324 - protein, 170 aa, Artificial Sequence; identical to SEQ ID NO: 319
  Synthetic sequence.

SEQ ID NO: 325 - protein, 171 aa, Artificial Sequence; identical to SEQ ID NO: 320
  Synthetic sequence.

SEQ ID NO: 326 - protein, 174 aa, Artificial Sequence; identical to SEQ ID NO: 321
  Synthetic sequence.

SEQ ID NO: 327 - protein, 181 aa, Artificial Sequence
  Synthetic sequence.
SEIDEVLTRLRKISKDLNETSDRVNERARKIIDDIKKESKRVNDEAREIVERLKREIDKTRDRDVLRRILKEIEDVARRVKEINEELLARVEKVVREVEEINRELVKRSREAVEAVKRLLDRGVSDEDKVERVVREVEKLHEEDRKRLEESTRSVRKLWMSCAQESEKSTRSVKALVDELR

SEQ ID NO: 328 - protein, 184 aa, Artificial Sequence
  Synthetic sequence.
SEIDEVLTRLRKISKDLNETSDRVNERARKIIDDIKKESKRVNDEAREIVERLKREIDKTRDRDVLRRILKEIEDVARRVKEINEELLARVEKVVREVEEINRELVKRSREAVEAVKRLLDRGVSDEDKVERVVREVEKLHEEDRKRLEESTRSVRKLLELAMSCAQESTRSVKALVDELRERV

SEQ ID NO: 329 - protein, 185 aa, Artificial Sequence; identical to SEQ ID NO: 323
  Synthetic sequence.

SEQ ID NO: 330 - protein, 163 aa, Artificial Sequence
  Synthetic sequence.
SEAEEIRRRLEEISRRSVEHLRKVLEEIKRISERSKRHLDRVLEENARRLEELAELLKRGGDKEELLADLKAVHDESRKVIEKNAEENDRALKAAKEVIDENRERNKRVLDEVRKGGLPEEVLRELEELLKESEERIKRLGMSCAQESDKSREDIKRVLEEIE

SEQ ID NO: 331 - protein, 166 aa, Artificial Sequence
  Synthetic sequence.
SEAEEIRRRLEEISRRSVEHLRKVLEEIKRISERSKRHLDRVLEENARRLEELAELLKRGGDKEELLADLKAVHDESRKVIEKNAEENDRALKAAKEVIDENRERNKRVLDEVRKGGLPEEVLRELEELLKESEERIKRIEELVMSCAQESREDIKRVLEEIERLN

SEQ ID NO: 332 - protein, 167 aa, Artificial Sequence
  Synthetic sequence.
SEAEEIRRRLEEISRRSVEHLRKVLEEIKRISERSKRHLDRVLEENARRLEELAELLKRGGDKEELLADLKAVHDESRKVIEKNAEENDRALKAAKEVIDENRERNKRVLDEVRKGGLPEEVLRELEELLKESEERIKRIEEELKMSCAQESEDIKRVLEEIERLNA

SEQ ID NO: 333 - protein, 170 aa, Artificial Sequence
  Synthetic sequence.
SEAEEIRRRLEEISRRSVEHLRKVLEEIKRISERSKRHLDRVLEENARRLEELAELLKRGGDKEELLADLKAVHDESRKVIEKNAEENDRALKAAKEVIDENRERNKRVLDEVRKGGLPEEVLRELEELLKESEERIKRIEEEIKKLCMSCAQESKRVLEEIERLNAKAA

SEQ ID NO: 334 - protein, 174 aa, Artificial Sequence
  Synthetic sequence.
SEAEEIRRRLEEISRRSVEHLRKVLEEIKRISERSKRHLDRVLEENARRLEELAELLKRGGDKEELLADLKAVHDESRKVIEKNAEENDRALKAAKEVIDENRERNKRVLDEVRKGGLPEEVLRELEELLKESEERIKRIEEEIKKIIDKLRMSCAQESEEIERLNAKAADDLR

SEQ ID NO: 335 - protein, 169 aa, Artificial Sequence
  Synthetic sequence.
SEVDDVLRRLEELIKTLEDINAKSLEDIKKLIDDLAKILEDALRKHEKLIRELREAKKGIDSREAEEIAKRVLEELKRTSDDLRKKVERVDEDLRRLLRENHERNKKILRDLERLLRDAARRGVPKEALDRMREEIRRLEEESRKLLMSCAQESRELRRRVEEVLKTST

SEQ ID NO: 336 - protein, 172 aa, Artificial Sequence
  Synthetic sequence.
SEVDDVLRRLEELIKTLEDINAKSLEDIKKLIDDLAKILEDALRKHEKLIRELREAKKGIDSREAEEIAKRVLEELKRTSDDLRKKVERVDEDLRRLLRENHERNKKILRDLERLLRDAARRGVPKEALDRMREEIRRLEEESRKSDELIMSCAQESRRRVEEVLKTSTDLI

SEQ ID NO: 337 - protein, 169 aa, Artificial Sequence; identical to SEQ ID NO: 335
  Synthetic sequence.

SEQ ID NO: 338 - protein, 172 aa, Artificial Sequence; identical to SEQ ID NO: 336
  Synthetic sequence.

SEQ ID NO: 339 - protein, 163 aa, Artificial Sequence
  Synthetic sequence.
SDAEELLKRVADLLKASLESLEKILRDSKELMDRWRKKLEDLLRESEELVDRAEKILRRGGSDKEVLDKIAEEVRRTNDDSRRLDEELHRLSRDTLRKLEENLRRTEKEVREMDKRAAERGVDERVREELKKLLTRVEELAMSCAQESKKILKEAHKESKEVN

SEQ ID NO: 340 - protein, 167 aa, Artificial Sequence
  Synthetic sequence.
SDAEELLKRVADLLKASLESLEKILRDSKELMDRWRKKLEDLLRESEELVDRAEKILRRGGSDKEVLDKIAEEVRRTNDDSRRLDEELHRLSRDTLRKLEENLRRTEKEVREMDKRAAERGVDERVREELKKLLTRVEEEHRKLIMSCAQESKEAHKESKEVNDRDR

SEQ ID NO: 341 - protein, 174 aa, Artificial Sequence
  Synthetic sequence.
SDAEELLKRVADLLKASLESLEKILRDSKELMDRWRKKLEDLLRESEELVDRAEKILRRGGSDKEVLDKIAEEVRRTNDDSRRLDEELHRLSRDTLRKLEENLRRTEKEVREMDKRAAERGVDERVREELKKLLTRVEEEHRKVLETDKKLMMSCAQESKEVNDRDRELLERLE

SEQ ID NO: 342 - protein, 178 aa, Artificial Sequence
  Synthetic sequence.
SDAEELLKRVADLLKASLESLEKILRDSKELMDRWRKKLEDLLRESEELVDRAEKILRRGGSDKEVLDKIAEEVRRTNDDSRRLDEELHRLSRDTLRKLEENLRRTEKEVREMDKRAAERGVDERVREELKKLLTRVEEEHRKVLETDKKILKELEMSCAQESDRDRELLERLEESVR

SEQ ID NO: 343 - protein, 163 aa, Artificial Sequence
  Synthetic sequence.
DAAERAKEKLDKILEDLRDVVRASKENLDRLHAENAETLERSKANLDRLLEKVKKDGVPEELLKELERIIRDLKRKHAKLLEDHRKIIEELKREHDRLLKEAEEIVRRIKDELEKGSDDERDIERILRELEAVLKKLTDLAMSCAQESERVSRDTKKKSKELN

SEQ ID NO: 344 - protein, 167 aa, Artificial Sequence
  Synthetic sequence.
DAAERAKEKLDKILEDLRDVVRASKENLDRLHAENAETLERSKANLDRLLEKVKKDGVPEELLKELERIIRDLKRKHAKLLEDHRKIIEELKREHDRLLKEAEEIVRRIKDELEKGSDDERDIERILRELEAVLKKLTDESERLKMSCAQESRDTKKKSKELNEELK

SEQ ID NO: 345 - protein, 174 aa, Artificial Sequence
  Synthetic sequence.
DAAERAKEKLDKILEDLRDVVRASKENLDRLHAENAETLERSKANLDRLLEKVKKDGVPEELLKELERIIRDLKRKHAKLLEDHRKIIEELKREHDRLLKEAEEIVRRIKDELEKGSDDERDIERILRELEAVLKKLTDESERLNREVERLTMSCAQESKELNEELKAVLDEVK

SEQ ID NO: 346 - protein, 178 aa, Artificial Sequence
  Synthetic sequence.
DAAERAKEKLDKILEDLRDVVRASKENLDRLHAENAETLERSKANLDRLLEKVKKDGVPEELLKELERIIRDLKRKHAKLLEDHRKIIEELKREHDRLLKEAEEIVRRIKDELEKGSDDERDIERILRELEAVLKKLTDESERLNREVERVSRDLKMSCAQESEELKAVLDEVKRKAD

SEQ ID NO: 347 - protein, 166 aa, Artificial Sequence
  Synthetic sequence.
SEIETVRREIEKILDDLRRTVKRIEDEVRKIHEDLRRSLEDSKRNIEEILKDLERAARRDGLDKKVEDDMRKLVEDLKRKHDKLRADNEAVTKELKDRLKKLEDDLARAIEELRRRLDKGLDKEDIDKLLKELRDLVEKIKKLLMSCAQESEEIVRRIKELLKDLN

SEQ ID NO: 348 - protein, 167 aa, Artificial Sequence
  Synthetic sequence.
SEIETVRREIEKILDDLRRTVKRIEDEVRKIHEDLRRSLEDSKRNIEEILKDLERAARRDGLDKKVEDDMRKLVEDLKRKHDKLRADNEAVTKELKDRLKKLEDDLARAIEELRRRLDKGLDKEDIDKLLKELRDLVEKIKKDLKMSCAQESEIVRRIKELLKDLNR

SEQ ID NO: 349 - protein, 170 aa, Artificial Sequence
  Synthetic sequence.
SEIETVRREIEKILDDLRRTVKRIEDEVRKIHEDLRRSLEDSKRNIEEILKDLERAARRDGLDKKVEDDMRKLVEDLKRKHDKLRADNEAVTKELKDRLKKLEDDLARAIEELRRRLDKGLDKEDIDKLLKELRDLVEKIKKDLKELLMSCAQESRRIKELLKDLNREAE

SEQ ID NO: 350 - protein, 174 aa, Artificial Sequence
  Synthetic sequence.
SEIETVRREIEKILDDLRRTVKRIEDEVRKIHEDLRRSLEDSKRNIEEILKDLERAARRDGLDKKVEDDMRKLVEDLKRKHDKLRADNEAVTKELKDRLKKLEDDLARAIEELRRRLDKGLDKEDIDKLLKELRDLVEKIKKDLKELLERLKMSCAQESELLKDLNREAEEVVR

SEQ ID NO: 351 - protein, 177 aa, Artificial Sequence
  Synthetic sequence.
SEIETVRREIEKILDDLRRTVKRIEDEVRKIHEDLRRSLEDSKRNIEEILKDLERAARRDGLDKKVEDDMRKLVEDLKRKHDKLRADNEAVTKELKDRLKKLEDDLARAIEELRRRLDKGLDKEDIDKLLKELRDLVEKIKKDLKELLERYEELAMSCAQESKDLNREAEEVVRRLK

SEQ ID NO: 352 - protein, 181 aa, Artificial Sequence
  Synthetic sequence.
SEIETVRREIEKILDDLRRTVKRIEDEVRKIHEDLRRSLEDSKRNIEEILKDLERAARRDGLDKKVEDDMRKLVEDLKRKHDKLRADNEAVTKELKDRLKKLEDDLARAIEELRRRLDKGLDKEDIDKLLKELRDLVEKIKKDLKELLERYEEIVRRLQMSCAQESREAEEVVRRLKEELR

SEQ ID NO: 353 - protein, 159 aa, Artificial Sequence
  Synthetic sequence.
KELEDVIEEVKKLLKTVNEESRRVAEEVRKLIREVSEELTEVIRRVERLVEEVAKGVDSEEALDAVRKRIEELVRRVEEVNAASKRRIEELEDELRKVDEESRETIERLIDLLRRGLDAETVLRSAEDIVAKNRKLAMSCAQESKKIVEENRKIASEVL

SEQ ID NO: 354 - protein, 162 aa, Artificial Sequence
  Synthetic sequence.
KELEDVIEEVKKLLKTVNEESRRVAEEVRKLIREVSEELTEVIRRVERLVEEVAKGVDSEEALDAVRKRIEELVRRVEEVNAASKRRIEELEDELRKVDEESRETIERLIDLLRRGLDAETVLRSAEDIVAKNRKLAELVMSCAQESVEENRKIASEVLDDV

SEQ ID NO: 355 - protein, 163 aa, Artificial Sequence
  Synthetic sequence.
KELEDVIEEVKKLLKTVNEESRRVAEEVRKLIREVSEELTEVIRRVERLVEEVAKGVDSEEALDAVRKRIEELVRRVEEVNAASKRRIEELEDELRKVDEESRETIERLIDLLRRGLDAETVLRSAEDIVAKNRKLAEELLMSCAQESEENRKIASEVLDDVR

SEQ ID NO: 356 - protein, 166 aa, Artificial Sequence
  Synthetic sequence.
KELEDVIEEVKKLLKTVNEESRRVAEEVRKLIREVSEELTEVIRRVERLVEEVAKGVDSEEALDAVRKRIEELVRRVEEVNAASKRRIEELEDELRKVDEESRETIERLIDLLRRGLDAETVLRSAEDIVAKNRKLAEEVLRLAMSCAQESRKIASEVLDDVRKLV

SEQ ID NO: 357 - protein, 167 aa, Artificial Sequence
  Synthetic sequence.
KELEDVIEEVKKLLKTVNEESRRVAEEVRKLIREVSEELTEVIRRVERLVEEVAKGVDSEEALDAVRKRIEELVRRVEEVNAASKRRIEELEDELRKVDEESRETIERLIDLLRRGLDAETVLRSAEDIVAKNRKLAEEVLRRLLMSCAQESKIASEVLDDVRKLVE

SEQ ID NO: 358 - protein, 170 aa, Artificial Sequence
  Synthetic sequence.
KELEDVIEEVKKLLKTVNEESRRVAEEVRKLIREVSEELTEVIRRVERLVEEVAKGVDSEEALDAVRKRIEELVRRVEEVNAASKRRIEELEDELRKVDEESRETIERLIDLLRRGLDAETVLRSAEDIVAKNRKLAEEVLRRVKKLVMSCAQESSEVLDDVRKLVEDVL

SEQ ID NO: 359 - protein, 174 aa, Artificial Sequence
  Synthetic sequence.
KELEDVIEEVKKLLKTVNEESRRVAEEVRKLIREVSEELTEVIRRVERLVEEVAKGVDSEEALDAVRKRIEELVRRVEEVNAASKRRIEELEDELRKVDEESRETIERLIDLLRRGLDAETVLRSAEDIVAKNRKLAEEVLRRVKKIVEELQMSCAQESDDVRKLVEDVLARAS

SEQ ID NO: 360 - protein, 168 aa, Artificial Sequence
  Synthetic sequence.
SKLEEVEKAVRKVIEDSRRVNEEVNRRSEEVVRELEKVHREVNDASRRVVEKARRVLKGSGDERLAAEVERIIEEIRELNERDRKRVEEIRKEIEDLNRDLNRRSKESEDRLRKLLEDATRGGVTKEADEVVERAERISEENKRLAMSCAQESKELVEDVRRHSEEVV

SEQ ID NO: 361 - protein, 169 aa, Artificial Sequence
  Synthetic sequence.
SKLEEVEKAVRKVIEDSRRVNEEVNRRSEEVVRELEKVHREVNDASRRVVEKARRVLKGSGDERLAAEVERIIEEIRELNERDRKRVEEIRKEIEDLNRDLNRRSKESEDRLRKLLEDATRGGVTKEADEVVERAERISEENKRRLDMSCAQESELVEDVRRHSEEVVR

SEQ ID NO: 362 - protein, 172 aa, Artificial Sequence
  Synthetic sequence.
SKLEEVEKAVRKVIEDSRRVNEEVNRRSEEVVRELEKVHREVNDASRRVVEKARRVLKGSGDERLAAEVERIIEEIRELNERDRKRVEEIRKEIEDLNRDLNRRSKESEDRLRKLLEDATRGGVTKEADEVVERAERISEENKRRVEDLGMSCAQESEDVRRHSEEVVRRVE

SEQ ID NO: 363 - protein, 176 aa, Artificial Sequence
  Synthetic sequence.
SKLEEVEKAVRKVIEDSRRVNEEVNRRSEEVVRELEKVHREVNDASRRVVEKARRVLKGSGDERLAAEVERIIEEIRELNERDRKRVEEIRKEIEDLNRDLNRRSKESEDRLRKLLEDATRGGVTKEADEVVERAERISEENKRRVEDVARKLKMSCAQESRHSEEVVRRVEELVK

SEQ ID NO: 364 - protein, 179 aa, Artificial Sequence
  Synthetic sequence.
SKLEEVEKAVRKVIEDSRRVNEEVNRRSEEVVRELEKVHREVNDASRRVVEKARRVLKGSGDERLAAEVERIIEEIRELNERDRKRVEEIRKEIEDLNRDLNRRSKESEDRLRKLLEDATRGGVTKEADEVVERAERISEENKRRVEDVARKSKELAMSCAQESEEVVRRVEELVKEVE

SEQ ID NO: 365 - protein, 183 aa, Artificial Sequence
  Synthetic sequence.
SKLEEVEKAVRKVIEDSRRVNEEVNRRSEEVVRELEKVHREVNDASRRVVEKARRVLKGSGDERLAAEVERIIEEIRELNERDRKRVEEIRKEIEDLNRDLNRRSKESEDRLRKLLEDATRGGVTKEADEVVERAERISEENKRRVEDVARKSKELVEDLKMSCAQESRRVEELVKEVEERVR

SEQ ID NO: 366 - protein, 168 aa, Artificial Sequence; identical to SEQ ID NO: 360
  Synthetic sequence.

SEQ ID NO: 367 - protein, 169 aa, Artificial Sequence
  Synthetic sequence.
SKLEEVEKAVRKVIEDSRRVNEEVNRRSEEVVRELEKVHREVNDASRRVVEKARRVLKGSGDERLAAEVERIIEEIRELNERDRKRVEEIRKEIEDLNRDLNRRSKESEDRLRKLLEDATRGGVTKEADEVVERAERISEENKRRLKMSCAQESELVEDVRRHSEEVVR

SEQ ID NO: 368 - protein, 171 aa, Artificial Sequence
  Synthetic sequence.
SKLEEVEKAVRKVIEDSRRVNEEVNRRSEEVVRELEKVHREVNDASRRVVEKARRVLKGSGDERLAAEVERIIEEIRELNERDRKRVEEIRKEIEDLNRDLNRRSKESEDRLRKLLEDATRGGVTKEADEVVERAERISEENKRRVELVMSCAQESVEDVRRHSEEVVRRV

SEQ ID NO: 369 - protein, 172 aa, Artificial Sequence; identical to SEQ ID NO: 362
  Synthetic sequence.

SEQ ID NO: 370 - protein, 176 aa, Artificial Sequence; identical to SEQ ID NO: 363
  Synthetic sequence.

SEQ ID NO: 371 - protein, 179 aa, Artificial Sequence
  Synthetic sequence.
SKLEEVEKAVRKVIEDSRRVNEEVNRRSEEVVRELEKVHREVNDASRRVVEKARRVLKGSGDERLAAEVERIIEEIRELNERDRKRVEEIRKEIEDLNRDLNRRSKESEDRLRKLLEDATRGGVTKEADEVVERAERISEENKRRVEDVARKSKELVMSCAQESEEVVRRVEELVKEVE

SEQ ID NO: 372 - protein, 183 aa, Artificial Sequence; identical to SEQ ID NO: 365
  Synthetic sequence.

SEQ ID NO: 373 - protein, 162 aa, Artificial Sequence
  Synthetic sequence.
SAEEVKEELKRIATKLKEEIKENIRRLEESVEKIAKELAENIKRLEDILRDVKRGLRDERIVKTVEDIARRVVEDNERIMEEDKDVVRRLVERNEEIVRRVDETVKKIVELIDRGEPGEELVERLRRVVEEVRERLKDLLMSCAQESEDSRKAVEDSSAEVA

SEQ ID NO: 374 - protein, 166 aa, Artificial Sequence
  Synthetic sequence.
SAEEVKEELKRIATKLKEEIKENIRRLEESVEKIAKELAENIKRLEDILRDVKRGLRDERIVKTVEDIARRVVEDNERIMEEDKDVVRRLVERNEEIVRRVDETVKKIVELIDRGEPGEELVERLRRVVEEVRERLKDSSRELKMSCAQESKAVEDSSAEVAKVVE

SEQ ID NO: 375 - protein, 169 aa, Artificial Sequence
  Synthetic sequence.
SAEEVKEELKRIATKLKEEIKENIRRLEESVEKIAKELAENIKRLEDILRDVKRGLRDERIVKTVEDIARRVVEDNERIMEEDKDVVRRLVERNEEIVRRVDETVKKIVELIDRGEPGEELVERLRRVVEEVRERLKDSSRELRKLGMSCAQESEDSSAEVAKVVEELE

SEQ ID NO: 376 - protein, 173 aa, Artificial Sequence
  Synthetic sequence.
SAEEVKEELKRIATKLKEEIKENIRRLEESVEKIAKELAENIKRLEDILRDVKRGLRDERIVKTVEDIARRVVEDNERIMEEDKDVVRRLVERNEEIVRRVDETVKKIVELIDRGEPGEELVERLRRVVEEVRERLKDSSRELRKINEDLRMSCAQESAEVAKVVEELERRDT

SEQ ID NO: 377 - protein, 160 aa, Artificial Sequence
  Synthetic sequence.
SEIERVKKRLEELLAEVEESTRRLEERLKRLLEEAKRSSEEVEKELRRLLEAVRRGLSRDEKLVSELEARVKELLEDSRASLEELKKRVRKLAEDSARLLEEVKREVEKLKAKLDRGGDADDVLARVEELAKRAHDLNMSCAQESEELVRAHNKRNKELV

SEQ ID NO: 378 - protein, 164 aa, Artificial Sequence
  Synthetic sequence.
SEIERVKKRLEELLAEVEESTRRLEERLKRLLEEAKRSSEEVEKELRRLLEAVRRGLSRDEKLVSELEARVKELLEDSRASLEELKKRVRKLAEDSARLLEEVKREVEKLKAKLDRGGDADDVLARVEELAKRAHDENERLAMSCAQESRAHNKRNKELVDEVK

SEQ ID NO: 379 - protein, 168 aa, Artificial Sequence
  Synthetic sequence.
SEIERVKKRLEELLAEVEESTRRLEERLKRLLEEAKRSSEEVEKELRRLLEAVRRGLSRDEKLVSELEARVKELLEDSRASLEELKKRVRKLAEDSARLLEEVKREVEKLKAKLDRGGDADDVLARVEELAKRAHDENERLIRELKMSCAQESKRNKELVDEVKRLVE

SEQ ID NO: 380 - protein, 171 aa, Artificial Sequence
  Synthetic sequence.
SEIERVKKRLEELLAEVEESTRRLEERLKRLLEEAKRSSEEVEKELRRLLEAVRRGLSRDEKLVSELEARVKELLEDSRASLEELKKRVRKLAEDSARLLEEVKREVEKLKAKLDRGGDADDVLARVEELAKRAHDENERLIREVEELVMSCAQESKELVDEVKRLVEKVI

SEQ ID NO: 381 - protein, 175 aa, Artificial Sequence
  Synthetic sequence.
SEIERVKKRLEELLAEVEESTRRLEERLKRLLEEAKRSSEEVEKELRRLLEAVRRGLSRDEKLVSELEARVKELLEDSRASLEELKKRVRKLAEDSARLLEEVKREVEKLKAKLDRGGDADDVLARVEELAKRAHDENERLIREVEELVRALQMSCAQESDEVKRLVEKVIEEER

SEQ ID NO: 382 - protein, 160 aa, Artificial Sequence; identical to SEQ ID NO: 377
  Synthetic sequence.

SEQ ID NO: 383 - protein, 164 aa, Artificial Sequence
  Synthetic sequence.
SEIERVKKRLEELLAEVEESTRRLEERLKRLLEEAKRSSEEVEKELRRLLEAVRRGLSRDEKLVSELEARVKELLEDSRASLEELKKRVRKLAEDSARLLEEVKREVEKLKAKLDRGGDADDVLARVEELAKRAHDENERLIMSCAQESRAHNKRNKELVDEVK

SEQ ID NO: 384 - protein, 168 aa, Artificial Sequence; identical to SEQ ID NO: 379
  Synthetic sequence.

SEQ ID NO: 385 - protein, 171 aa, Artificial Sequence; identical to SEQ ID NO: 380
  Synthetic sequence.

SEQ ID NO: 386 - protein, 175 aa, Artificial Sequence
  Synthetic sequence.
SEIERVKKRLEELLAEVEESTRRLEERLKRLLEEAKRSSEEVEKELRRLLEAVRRGLSRDEKLVSELEARVKELLEDSRASLEELKKRVRKLAEDSARLLEEVKREVEKLKAKLDRGGDADDVLARVEELAKRAHDENERLIREVEELVRALAMSCAQESDEVKRLVEKVIEEER

SEQ ID NO: 387 - protein, 168 aa, Artificial Sequence
  Synthetic sequence.
SDVDRVLEEIRKLLEDLKRHSEKVSEENEDLLRANTELNKRVSEDNERLLEELKRLRERGGISEEDLKRALDRVRKTVETVKEENKRSLEDVRRTVETNKRKLERVVEEIKKLIEDAKRRGSGDEEAKKKLDEVLERAKRTIDRLVMSCAQESEKVEADLRRLNEELD

SEQ ID NO: 388 - protein, 171 aa, Artificial Sequence
  Synthetic sequence.
SDVDRVLEEIRKLLEDLKRHSEKVSEENEDLLRANTELNKRVSEDNERLLEELKRLRERGGISEEDLKRALDRVRKTVETVKEENKRSLEDVRRTVETNKRKLERVVEEIKKLIEDAKRRGSGDEEAKKKLDEVLERAKRTIDRLLELAMSCAQESEADLRRLNEELDRSL

SEQ ID NO: 389 - protein, 172 aa, Artificial Sequence
  Synthetic sequence.
SDVDRVLEEIRKLLEDLKRHSEKVSEENEDLLRANTELNKRVSEDNERLLEELKRLRERGGISEEDLKRALDRVRKTVETVKEENKRSLEDVRRTVETNKRKLERVVEEIKKLIEDAKRRGSGDEEAKKKLDEVLERAKRTIDRLLETLEMSCAQESADLRRLNEELDRSLE

SEQ ID NO: 390 - protein, 175 aa, Artificial Sequence
  Synthetic sequence.
SDVDRVLEEIRKLLEDLKRHSEKVSEENEDLLRANTELNKRVSEDNERLLEELKRLRERGGISEEDLKRALDRVRKTVETVKEENKRSLEDVRRTVETNKRKLERVVEEIKKLIEDAKRRGSGDEEAKKKLDEVLERAKRTIDRLLETSDRLLMSCAQESRRLNEELDRSLERAE

SEQ ID NO: 391 - protein, 182 aa, Artificial Sequence
  Synthetic sequence.
SDVDRVLEEIRKLLEDLKRHSEKVSEENEDLLRANTELNKRVSEDNERLLEELKRLRERGGISEEDLKRALDRVRKTVETVKEENKRSLEDVRRTVETNKRKLERVVEEIKKLIEDAKRRGSGDEEAKKKLDEVLERAKRTIDRLLETSDRSLEKVEALLMSCAQESDRSLERAERTIRELA

SEQ ID NO: 392 - protein, 183 aa, Artificial Sequence
  Synthetic sequence.
SDVDRVLEEIRKLLEDLKRHSEKVSEENEDLLRANTELNKRVSEDNERLLEELKRLRERGGISEEDLKRALDRVRKTVETVKEENKRSLEDVRRTVETNKRKLERVVEEIKKLIEDAKRRGSGDEEAKKKLDEVLERAKRTIDRLLETSDRSLEKVEADLRMSCAQESRSLERAERTIRELAK

SEQ ID NO: 393 - protein, 168 aa, Artificial Sequence
  Synthetic sequence.
SDVDRVLEEIRKLLEDLKRHSEKVSEENEDLLRANTELNKRVSEDNERLLEELKRLRERGGISEEDLKRALDRVRKTVETVKEENKRSLEDVRRTVETNKRKLERVVEEIKKLIEDAKRRGSGDEEAKKKLDEVLERAKRTIDRLLMSCAQESEKVEADLRRLNEELD

SEQ ID NO: 394 - protein, 171 aa, Artificial Sequence; identical to SEQ ID NO: 388
  Synthetic sequence.

SEQ ID NO: 395 - protein, 172 aa, Artificial Sequence
  Synthetic sequence.
SDVDRVLEEIRKLLEDLKRHSEKVSEENEDLLRANTELNKRVSEDNERLLEELKRLRERGGISEEDLKRALDRVRKTVETVKEENKRSLEDVRRTVETNKRKLERVVEEIKKLIEDAKRRGSGDEEAKKKLDEVLERAKRTIDRLLETLDMSCAQESADLRRLNEELDRSLE

SEQ ID NO: 396 - protein, 175 aa, Artificial Sequence; identical to SEQ ID NO: 390
  Synthetic sequence.

SEQ ID NO: 397 - protein, 182 aa, Artificial Sequence; identical to SEQ ID NO: 391
  Synthetic sequence.

SEQ ID NO: 398 - protein, 183 aa, Artificial Sequence
  Synthetic sequence.
SDVDRVLEEIRKLLEDLKRHSEKVSEENEDLLRANTELNKRVSEDNERLLEELKRLRERGGISEEDLKRALDRVRKTVETVKEENKRSLEDVRRTVETNKRKLERVVEEIKKLIEDAKRRGSGDEEAKKKLDEVLERAKRTIDRLLETSDRSLEKVEADLSMSCAQESRSLERAERTIRELAK

SEQ ID NO: 399 - protein, 159 aa, Artificial Sequence
  Synthetic sequence.
STEDVLRKIKEDVKRVIDDNRRILDEVRRTSKRVLDDLRANLKHIAEEVERVLRGSDSEEVVRELAKILDEIREEHRRLIRTNEKVLEDIERDHRRISEELKRILDEVDELLRGGKPSKELLEKAKAVVDEIKRLLLMSCAQESDLSRDHKRRAKELND

SEQ ID NO: 400 - protein, 162 aa, Artificial Sequence
  Synthetic sequence.
STEDVLRKIKEDVKRVIDDNRRILDEVRRTSKRVLDDLRANLKHIAEEVERVLRGSDSEEVVRELAKILDEIREEHRRLIRTNEKVLEDIERDHRRISEELKRILDEVDELLRGGKPSKELLEKAKAVVDEIKRLAEELLMSCAQESRDHKRRAKELNDEIA

SEQ ID NO: 401 - protein, 166 aa, Artificial Sequence
  Synthetic sequence.
STEDVLRKIKEDVKRVIDDNRRILDEVRRTSKRVLDDLRANLKHIAEEVERVLRGSDSEEVVRELAKILDEIREEHRRLIRTNEKVLEDIERDHRRISEELKRILDEVDELLRGGKPSKELLEKAKAVVDEIKRLAEESLKRLAMSCAQESRRAKELNDEIAKVVD

SEQ ID NO: 402 - protein, 169 aa, Artificial Sequence
  Synthetic sequence.
STEDVLRKIKEDVKRVIDDNRRILDEVRRTSKRVLDDLRANLKHIAEEVERVLRGSDSEEVVRELAKILDEIREEHRRLIRTNEKVLEDIERDHRRISEELKRILDEVDELLRGGKPSKELLEKAKAVVDEIKRLAEESLKRLEDLCMSCAQESKELNDEIAKVVDELA

SEQ ID NO: 403 - protein, 170 aa, Artificial Sequence
  Synthetic sequence.
STEDVLRKIKEDVKRVIDDNRRILDEVRRTSKRVLDDLRANLKHIAEEVERVLRGSDSEEVVRELAKILDEIREEHRRLIRTNEKVLEDIERDHRRISEELKRILDEVDELLRGGKPSKELLEKAKAVVDEIKRLAEESLKRLEDLLRMSCAQESELNDEIAKVVDELAK

SEQ ID NO: 404 - protein, 173 aa, Artificial Sequence
  Synthetic sequence.
STEDVLRKIKEDVKRVIDDNRRILDEVRRTSKRVLDDLRANLKHIAEEVERVLRGSDSEEVVRELAKILDEIREEHRRLIRTNEKVLEDIERDHRRISEELKRILDEVDELLRGGKPSKELLEKAKAVVDEIKRLAEESLKRLEDLSRDLKMSCAQESDEIAKVVDELAKRAT

SEQ ID NO: 405 - protein, 165 aa, Artificial Sequence
  Synthetic sequence.
SAEELLREVAELVKRVDEDLRRLLEEVRASNEEVIRRLEEILKRIEEENRKVVEELRRGGVSEDLVRESKRLVDESRRVIEKLVKESADSVERTRETVDRLREELKRLVEEIAKMVKGGSSEETVKRLLDELRELLERLKRLIMSCAQESRDLLADAEEKARRLL

SEQ ID NO: 406 - protein, 166 aa, Artificial Sequence
  Synthetic sequence.
SAEELLREVAELVKRVDEDLRRLLEEVRASNEEVIRRLEEILKRIEEENRKVVEELRRGGVSEDLVRESKRLVDESRRVIEKLVKESADSVERTRETVDRLREELKRLVEEIAKMVKGGSSEETVKRLLDELRELLERLKRTLEMSCAQESDLLADAEEKARRLLE

SEQ ID NO: 407 - protein, 169 aa, Artificial Sequence
  Synthetic sequence.
SAEELLREVAELVKRVDEDLRRLLEEVRASNEEVIRRLEEILKRIEEENRKVVEELRRGGVSEDLVRESKRLVDESRRVIEKLVKESADSVERTRETVDRLREELKRLVEEIAKMVKGGSSEETVKRLLDELRELLERLKRTIEELLMSCAQESADAEEKARRLLEENR

SEQ ID NO: 408 - protein, 176 aa, Artificial Sequence
  Synthetic sequence.
SAEELLREVAELVKRVDEDLRRLLEEVRASNEEVIRRLEEILKRIEEENRKVVEELRRGGVSEDLVRESKRLVDESRRVIEKLVKESADSVERTRETVDRLREELKRLVEEIAKMVKGGSSEETVKRLLDELRELLERLKRTIEELLKRNRDLCMSCAQESRRLLEENRKLLKAAR

SEQ ID NO: 409 - protein, 180 aa, Artificial Sequence
  Synthetic sequence.
SAEELLREVAELVKRVDEDLRRLLEEVRASNEEVIRRLEEILKRIEEENRKVVEELRRGGVSEDLVRESKRLVDESRRVIEKLVKESADSVERTRETVDRLREELKRLVEEIAKMVKGGSSEETVKRLLDELRELLERLKRTIEELLKRNRDLLADLLMSCAQESEENRKLLKAARDTAT

SEQ ID NO: 410 - protein, 162 aa, Artificial Sequence
  Synthetic sequence.
SEDEDLDRVAEKLAREHKKSVEEIKRVLKSADEESKKLVRDTERVIEEIKREVEEARRGNIDEELVERLKKKIEDILRTLEERHKKLIKELREILKRLSDESRRLAEETEKVLEDLERKGVDEEVLKKLAEIVRRVKELNMSCAQESEKRLRELEEENKKVI

SEQ ID NO: 411 - protein, 163 aa, Artificial Sequence
  Synthetic sequence.
SEDEDLDRVAEKLAREHKKSVEEIKRVLKSADEESKKLVRDTERVIEEIKREVEEARRGNIDEELVERLKKKIEDILRTLEERHKKLIKELREILKRLSDESRRLAEETEKVLEDLERKGVDEEVLKKLAEIVRRVKEELRMSCAQESKRLRELEEENKKVIE

SEQ ID NO: 412 - protein, 166 aa, Artificial Sequence
  Synthetic sequence.
SEDEDLDRVAEKLAREHKKSVEEIKRVLKSADEESKKLVRDTERVIEEIKREVEEARRGNIDEELVERLKKKIEDILRTLEERHKKLIKELREILKRLSDESRRLAEETEKVLEDLERKGVDEEVLKKLAEIVRRVKEENRKLVMSCAQESRELEEENKKVIEDLK

SEQ ID NO: 413 - protein, 170 aa, Artificial Sequence
  Synthetic sequence.
SEDEDLDRVAEKLAREHKKSVEEIKRVLKSADEESKKLVRDTERVIEEIKREVEEARRGNIDEELVERLKKKIEDILRTLEERHKKLIKELREILKRLSDESRRLAEETEKVLEDLERKGVDEEVLKKLAEIVRRVKEENRKVNEELKMSCAQESEENKKVIEDLKSTVE

SEQ ID NO: 414 - protein, 162 aa, Artificial Sequence
  Synthetic sequence.
SEDEDLDRVAEKLAREHKKSVEEIKRVLKSADEESKKLVRDTERVIEEIKREVEEARRGNIDEELVERLKKKIEDILRTLEERHKKLIKELREILKRLSDESRRLAEETEKVLEDLERKGVDEEVLKKLAEIVRRVKELAMSCAQESEKRLRELEEENKKVI

SEQ ID NO: 415 - protein, 163 aa, Artificial Sequence; identical to SEQ ID NO: 411
  Synthetic sequence.

SEQ ID NO: 416 - protein, 166 aa, Artificial Sequence; identical to SEQ ID NO: 412
  Synthetic sequence.

SEQ ID NO: 417 - protein, 170 aa, Artificial Sequence
  Synthetic sequence.
SEDEDLDRVAEKLAREHKKSVEEIKRVLKSADEESKKLVRDTERVIEEIKREVEEARRGNIDEELVERLKKKIEDILRTLEERHKKLIKELREILKRLSDESRRLAEETEKVLEDLERKGVDEEVLKKLAEIVRRVKEENRKVNEELAMSCAQESEENKKVIEDLKSTVE

SEQ ID NO: 418 - protein, 173 aa, Artificial Sequence
  Synthetic sequence.
SEDEDLDRVAEKLAREHKKSVEEIKRVLKSADEESKKLVRDTERVIEEIKREVEEARRGNIDEELVERLKKKIEDILRTLEERHKKLIKELREILKRLSDESRRLAEETEKVLEDLERKGVDEEVLKKLAEIVRRVKEENRKVNEEVEKLLMSCAQESKKVIEDLKSTVEELV

SEQ ID NO: 419 - protein, 165 aa, Artificial Sequence
  Synthetic sequence.
DEVEDVLRKIEKILDDHRKRIEKNSRDMARIIDEHRRKVEENSREMKKLVDDLKKAVDRGEGDEETAEDVKAKLEKSNRELEKHSEEVKRALDESNEDLRRHSEEVKERIERLVKKLREDGVEREEELKEVADRVKEKLDRLDMSCAQESEELKRELDKINDENR

SEQ ID NO: 420 - protein, 169 aa, Artificial Sequence
  Synthetic sequence.
DEVEDVLRKIEKILDDHRKRIEKNSRDMARIIDEHRRKVEENSREMKKLVDDLKKAVDRGEGDEETAEDVKAKLEKSNRELEKHSEEVKRALDESNEDLRRHSEEVKERIERLVKKLREDGVEREEELKEVADRVKEKLDRLNRELEMSCAQESRELDKINDENRETSE

SEQ ID NO: 421 - protein, 172 aa, Artificial Sequence
  Synthetic sequence.
DEVEDVLRKIEKILDDHRKRIEKNSRDMARIIDEHRRKVEENSREMKKLVDDLKKAVDRGEGDEETAEDVKAKLEKSNRELEKHSEEVKRALDESNEDLRRHSEEVKERIERLVKKLREDGVEREEELKEVADRVKEKLDRLNRENEKLAMSCAQESDKINDENRETSERLK

SEQ ID NO: 422 - protein, 176 aa, Artificial Sequence
  Synthetic sequence.
DEVEDVLRKIEKILDDHRKRIEKNSRDMARIIDEHRRKVEENSREMKKLVDDLKKAVDRGEGDEETAEDVKAKLEKSNRELEKHSEEVKRALDESNEDLRRHSEEVKERIERLVKKLREDGVEREEELKEVADRVKEKLDRLNRENEKSSEELKMSCAQESDENRETSERLKREID

SEQ ID NO: 423 - protein, 179 aa, Artificial Sequence
  Synthetic sequence.
DEVEDVLRKIEKILDDHRKRIEKNSRDMARIIDEHRRKVEENSREMKKLVDDLKKAVDRGEGDEETAEDVKAKLEKSNRELEKHSEEVKRALDESNEDLRRHSEEVKERIERLVKKLREDGVEREEELKEVADRVKEKLDRLNRENEKSSEELKRLAMSCAQESRETSERLKREIDETT

SEQ ID NO: 424 - protein, 180 aa, Artificial Sequence
  Synthetic sequence.
DEVEDVLRKIEKILDDHRKRIEKNSRDMARIIDEHRRKVEENSREMKKLVDDLKKAVDRGEGDEETAEDVKAKLEKSNRELEKHSEEVKRALDESNEDLRRHSEEVKERIERLVKKLREDGVEREEELKEVADRVKEKLDRLNRENEKSSEELKRELDMSCAQESETSERLKREIDETTR

SEQ ID NO: 425 - protein, 163 aa, Artificial Sequence
  Synthetic sequence.
SKEDRLREELKKLLARLAEEIERLKRALEESNKDLKRTIDASEKHLRDVNEDVKRGGVSEELLRELERSTAENKERAKELLKRHEDLVRKVEKELADLLRRLEEIVARVDEALKRGISEEELDKLLKEARDLIREIEKRLEMSCAQESKLTEDAKRDLERSNR

SEQ ID NO: 426 - protein, 166 aa, Artificial Sequence
  Synthetic sequence.
SKEDRLREELKKLLARLAEEIERLKRALEESNKDLKRTIDASEKHLRDVNEDVKRGGVSEELLRELERSTAENKERAKELLKRHEDLVRKVEKELADLLRRLEEIVARVDEALKRGISEEELDKLLKEARDLIREIEKRLEELLMSCAQESEDAKRDLERSNREHK

SEQ ID NO: 427 - protein, 169 aa, Artificial Sequence
  Synthetic sequence.
SKEDRLREELKKLLARLAEEIERLKRALEESNKDLKRTIDASEKHLRDVNEDVKRGGVSEELLRELERSTAENKERAKELLKRHEDLVRKVEKELADLLRRLEEIVARVDEALKRGISEEELDKLLKEARDLIREIEKRLEELLKLTMSCAQESKRDLERSNREHKELA

SEQ ID NO: 428 - protein, 170 aa, Artificial Sequence
  Synthetic sequence.
SKEDRLREELKKLLARLAEEIERLKRALEESNKDLKRTIDASEKHLRDVNEDVKRGGVSEELLRELERSTAENKERAKELLKRHEDLVRKVEKELADLLRRLEEIVARVDEALKRGISEEELDKLLKEARDLIREIEKRLEELLKRLQMSCAQESRDLERSNREHKELAD

SEQ ID NO: 429 - protein, 173 aa, Artificial Sequence
  Synthetic sequence.
SKEDRLREELKKLLARLAEEIERLKRALEESNKDLKRTIDASEKHLRDVNEDVKRGGVSEELLRELERSTAENKERAKELLKRHEDLVRKVEKELADLLRRLEEIVARVDEALKRGISEEELDKLLKEARDLIREIEKRLEELLKRVEKLAMSCAQESERSNREHKELADRIK

SEQ ID NO: 430 - protein, 177 aa, Artificial Sequence
  Synthetic sequence.
SKEDRLREELKKLLARLAEEIERLKRALEESNKDLKRTIDASEKHLRDVNEDVKRGGVSEELLRELERSTAENKERAKELLKRHEDLVRKVEKELADLLRRLEEIVARVDEALKRGISEEELDKLLKEARDLIREIEKRLEELLKRVEKLTEDLKMSCAQESREHKELADRIKETAR

SEQ ID NO: 431 - protein, 162 aa, Artificial Sequence
  Synthetic sequence.
SKEDRLREELKKLLARLAEEIERLKRALEESNKDLKRTIDASEKHLRDVNEDVKRGGVSEELLRELERSTAENKERAKELLKRHEDLVRKVEKELADLLRRLEEIVARVDEALKRGISEEELDKLLKEARDLIREIEKLLMSCAQESEKLTEDAKRDLERSN

SEQ ID NO: 432 - protein, 163 aa, Artificial Sequence; identical to SEQ ID NO: 425
  Synthetic sequence.

SEQ ID NO: 433 - protein, 166 aa, Artificial Sequence; identical to SEQ ID NO: 426
  Synthetic sequence.

SEQ ID NO: 434 - protein, 170 aa, Artificial Sequence; identical to SEQ ID NO: 428
  Synthetic sequence.

SEQ ID NO: 435 - protein, 173 aa, Artificial Sequence; identical to SEQ ID NO: 429
  Synthetic sequence.

SEQ ID NO: 436 - protein, 177 aa, Artificial Sequence; identical to SEQ ID NO: 430
  Synthetic sequence.

SEQ ID NO: 437 - protein, 170 aa, Artificial Sequence
  Synthetic sequence.
SSVEELLERLRRISEENKRRIEKLLREVEKVLRELKDRHRKLLKRVEEIIRKVKEEIKSGLPEEAVKRVLERVRERVKEVLEEADRLNDEMRRIVTEVEKELDKSDKEVEDAVRDILKKIEEGVRDRETAERARETLKRLLDENRDLSMSCAQESRRILEDLTRTTERVK

SEQ ID NO: 438 - protein, 171 aa, Artificial Sequence
  Synthetic sequence.
SSVEELLERLRRISEENKRRIEKLLREVEKVLRELKDRHRKLLKRVEEIIRKVKEEIKSGLPEEAVKRVLERVRERVKEVLEEADRLNDEMRRIVTEVEKELDKSDKEVEDAVRDILKKIEEGVRDRETAERARETLKRLLDENRDRLRMSCAQESRILEDLTRTTERVKR

SEQ ID NO: 439 - protein, 174 aa, Artificial Sequence
  Synthetic sequence.
SSVEELLERLRRISEENKRRIEKLLREVEKVLRELKDRHRKLLKRVEEIIRKVKEEIKSGLPEEAVKRVLERVRERVKEVLEEADRLNDEMRRIVTEVEKELDKSDKEVEDAVRDILKKIEEGVRDRETAERARETLKRLLDENRDRSKKLKMSCAQESEDLTRTTERVKREIA

SEQ ID NO: 440 - protein, 177 aa, Artificial Sequence
  Synthetic sequence.
SSVEELLERLRRISEENKRRIEKLLREVEKVLRELKDRHRKLLKRVEEIIRKVKEEIKSGLPEEAVKRVLERVRERVKEVLEEADRLNDEMRRIVTEVEKELDKSDKEVEDAVRDILKKIEEGVRDRETAERARETLKRLLDENRDRSKKVKELIMSCAQESTRTTERVKREIAKLL

SEQ ID NO: 441 - protein, 178 aa, Artificial Sequence
  Synthetic sequence.
SSVEELLERLRRISEENKRRIEKLLREVEKVLRELKDRHRKLLKRVEEIIRKVKEEIKSGLPEEAVKRVLERVRERVKEVLEEADRLNDEMRRIVTEVEKELDKSDKEVEDAVRDILKKIEEGVRDRETAERARETLKRLLDENRDRSKKVKEELRMSCAQESRTTERVKREIAKLLK

SEQ ID NO: 442 - protein, 181 aa, Artificial Sequence
  Synthetic sequence.
SSVEELLERLRRISEENKRRIEKLLREVEKVLRELKDRHRKLLKRVEEIIRKVKEEIKSGLPEEAVKRVLERVRERVKEVLEEADRLNDEMRRIVTEVEKELDKSDKEVEDAVRDILKKIEEGVRDRETAERARETLKRLLDENRDRSKKVKEEIRRLLMSCAQESERVKREIAKLLKELE

SEQ ID NO: 443 - protein, 184 aa, Artificial Sequence
  Synthetic sequence.
SSVEELLERLRRISEENKRRIEKLLREVEKVLRELKDRHRKLLKRVEEIIRKVKEEIKSGLPEEAVKRVLERVRERVKEVLEEADRLNDEMRRIVTEVEKELDKSDKEVEDAVRDILKKIEEGVRDRETAERARETLKRLLDENRDRSKKVKEEIRRILELLMSCAQESKREIAKLLKELEDTA

SEQ ID NO: 444 - protein, 185 aa, Artificial Sequence
  Synthetic sequence.
SSVEELLERLRRISEENKRRIEKLLREVEKVLRELKDRHRKLLKRVEEIIRKVKEEIKSGLPEEAVKRVLERVRERVKEVLEEADRLNDEMRRIVTEVEKELDKSDKEVEDAVRDILKKIEEGVRDRETAERARETLKRLLDENRDRSKKVKEEIRRILEDLTMSCAQESREIAKLLKELEDTAR

SEQ ID NO: 445 - protein, 170 aa, Artificial Sequence; identical to SEQ ID NO: 437
  Synthetic sequence.

SEQ ID NO: 446 - protein, 171 aa, Artificial Sequence; identical to SEQ ID NO: 438
  Synthetic sequence.

SEQ ID NO: 447 - protein, 174 aa, Artificial Sequence; identical to SEQ ID NO: 439
  Synthetic sequence.

SEQ ID NO: 448 - protein, 177 aa, Artificial Sequence; identical to SEQ ID NO: 440
  Synthetic sequence.

SEQ ID NO: 449 - protein, 178 aa, Artificial Sequence; identical to SEQ ID NO: 441
  Synthetic sequence.

SEQ ID NO: 450 - protein, 181 aa, Artificial Sequence; identical to SEQ ID NO: 442
  Synthetic sequence.

SEQ ID NO: 451 - protein, 185 aa, Artificial Sequence; identical to SEQ ID NO: 444
  Synthetic sequence.

SEQ ID NO: 452 - protein, 165 aa, Artificial Sequence
  Synthetic sequence.
SELEEVLRRIEALVRKAHKENEDVLREIERLVRTAHRLNKKVDDDSAKIAEDLKRGGREDKDKVEEALRRLRELYRRLEEENRRILREIEELVKELEKRNREILKELEDLVADAERKGSDGSEAVRRLKEILERLKEEVRRLLMSCAQESERLKKEVEDSLRELK

SEQ ID NO: 453 - protein, 169 aa, Artificial Sequence
  Synthetic sequence.
SELEEVLRRIEALVRKAHKENEDVLREIERLVRTAHRLNKKVDDDSAKIAEDLKRGGREDKDKVEEALRRLRELYRRLEEENRRILREIEELVKELEKRNREILKELEDLVADAERKGSDGSEAVRRLKEILERLKEEVRRSLEELRMSCAQESKEVEDSLRELKKSLE

SEQ ID NO: 454 - protein, 176 aa, Artificial Sequence
  Synthetic sequence.
SELEEVLRRIEALVRKAHKENEDVLREIERLVRTAHRLNKKVDDDSAKIAEDLKRGGREDKDKVEEALRRLRELYRRLEEENRRILREIEELVKELEKRNREILKELEDLVADAERKGSDGSEAVRRLKEILERLKEEVRRSLEELRKEVERLQMSCAQESRELKKSLEEWVKSLE

SEQ ID NO: 455 - protein, 179 aa, Artificial Sequence
  Synthetic sequence.
SELEEVLRRIEALVRKAHKENEDVLREIERLVRTAHRLNKKVDDDSAKIAEDLKRGGREDKDKVEEALRRLRELYRRLEEENRRILREIEELVKELEKRNREILKELEDLVADAERKGSDGSEAVRRLKEILERLKEEVRRSLEELRKEVERLKKLVMSCAQESKKSLEEWVKSLEEAT

SEQ ID NO: 456 - protein, 180 aa, Artificial Sequence
  Synthetic sequence.
SELEEVLRRIEALVRKAHKENEDVLREIERLVRTAHRLNKKVDDDSAKIAEDLKRGGREDKDKVEEALRRLRELYRRLEEENRRILREIEELVKELEKRNREILKELEDLVADAERKGSDGSEAVRRLKEILERLKEEVRRSLEELRKEVERLKKELEMSCAQESKSLEEWVKSLEEATR

SEQ ID NO: 457 - protein, 165 aa, Artificial Sequence; identical to SEQ ID NO: 452
  Synthetic sequence.

SEQ ID NO: 458 - protein, 169 aa, Artificial Sequence; identical to SEQ ID NO: 453
  Synthetic sequence.

SEQ ID NO: 459 - protein, 176 aa, Artificial Sequence; identical to SEQ ID NO: 454
  Synthetic sequence.

SEQ ID NO: 460 - protein, 179 aa, Artificial Sequence; identical to SEQ ID NO: 455
  Synthetic sequence.

SEQ ID NO: 461 - protein, 180 aa, Artificial Sequence; identical to SEQ ID NO: 456
  Synthetic sequence.

SEQ ID NO: 462 - protein, 157 aa, Artificial Sequence
  Synthetic sequence.
SKEEELEKLLREHHEKIKRLKEESKRINDRIRRTVEELIKESEKINRDINDTVRKGDRDEEVIRRLLEDVRRKHEELRERLKRELDKVRERHKELLDRARRATEAVKERLDRGGLSEDSVERIARELERNLDDLRMSCAQESDDLAEILRRLKEVLE

SEQ ID NO: 463 - protein, 160 aa, Artificial Sequence
  Synthetic sequence.
SKEEELEKLLREHHEKIKRLKEESKRINDRIRRTVEELIKESEKINRDINDTVRKGDRDEEVIRRLLEDVRRKHEELRERLKRELDKVRERHKELLDRARRATEAVKERLDRGGLSEDSVERIARELERNLDDLARLVMSCAQESAEILRRLKEVLEESE

SEQ ID NO: 464 - protein, 164 aa, Artificial Sequence
  Synthetic sequence.
SKEEELEKLLREHHEKIKRLKEESKRINDRIRRTVEELIKESEKINRDINDTVRKGDRDEEVIRRLLEDVRRKHEELRERLKRELDKVRERHKELLDRARRATEAVKERLDRGGLSEDSVERIARELERNLDDLARVLKELEMSCAQESRRLKEVLEESERDLE

SEQ ID NO: 465 - protein, 167 aa, Artificial Sequence
  Synthetic sequence.
SKEEELEKLLREHHEKIKRLKEESKRINDRIRRTVEELIKESEKINRDINDTVRKGDRDEEVIRRLLEDVRRKHEELRERLKRELDKVRERHKELLDRARRATEAVKERLDRGGLSEDSVERIARELERNLDDLARVLKESEDLLMSCAQESKEVLEESERDLERVE

SEQ ID NO: 466 - protein, 168 aa, Artificial Sequence
  Synthetic sequence.
SKEEELEKLLREHHEKIKRLKEESKRINDRIRRTVEELIKESEKINRDINDTVRKGDRDEEVIRRLLEDVRRKHEELRERLKRELDKVRERHKELLDRARRATEAVKERLDRGGLSEDSVERIARELERNLDDLARVLKESEDDLRMSCAQESEVLEESERDLERVER

SEQ ID NO: 467 - protein, 171 aa, Artificial Sequence
  Synthetic sequence.
SKEEELEKLLREHHEKIKRLKEESKRINDRIRRTVEELIKESEKINRDINDTVRKGDRDEEVIRRLLEDVRRKHEELRERLKRELDKVRERHKELLDRARRATEAVKERLDRGGLSEDSVERIARELERNLDDLARVLKESEDDLAELYMSCAQESEESERDLERVEREVR

SEQ ID NO: 468 - protein, 223 aa, Artificial Sequence
  Synthetic sequence.
EEDERLTKRVEEIKRENRELLRRLEEEVKELERKSEKIVRDLKEKVDRAKEKLDSGKGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKDVLTELKRILDELLKLLKMSCAQESRLLEELLRLVREILR

SEQ ID NO: 469 - protein, 226 aa, Artificial Sequence
  Synthetic sequence.
EEDERLTKRVEEIKRENRELLRRLEEEVKELERKSEKIVRDLKEKVDRAKEKLDSGKGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKDVLTELKRILDELLKLVEKLIMSCAQESEELLRLVREILRTSN

SEQ ID NO: 470 - protein, 230 aa, Artificial Sequence
  Synthetic sequence.
EEDERLTKRVEEIKRENRELLRRLEEEVKELERKSEKIVRDLKEKVDRAKEKLDSGKGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKDVLTELKRILDELLKLVEKLIRRLLMSCAQESRLVREILRTSNEILE

SEQ ID NO: 471 - protein, 237 aa, Artificial Sequence
  Synthetic sequence.
EEDERLTKRVEEIKRENRELLRRLEEEVKELERKSEKIVRDLKEKVDRAKEKLDSGKGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKDVLTELKRILDELLKLVEKLIRRNLRLLEELLMSCAQESRTSNEILEEILKDAR

SEQ ID NO: 472 - protein, 223 aa, Artificial Sequence
  Synthetic sequence.
EEDERLTKRVEEIKRENRELLRRLEEEVKELERKSEKIVRDLKEKVDRAKEKLDSGKGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKDVLTELKRILDELLKLLVMSCAQESRLLEELLRLVREILR

SEQ ID NO: 473 - protein, 226 aa, Artificial Sequence; identical to SEQ ID NO: 469
  Synthetic sequence.

SEQ ID NO: 474 - protein, 230 aa, Artificial Sequence; identical to SEQ ID NO: 470
  Synthetic sequence.

SEQ ID NO: 475 - protein, 236 aa, Artificial Sequence
  Synthetic sequence.
EEDERLTKRVEEIKRENRELLRRLEEEVKELERKSEKIVRDLKEKVDRAKEKLDSGKGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKDVLTELKRILDELLKLVEKLIRRNLRLLELLMSCAQESLRTSNEILEEILKDA

SEQ ID NO: 476 - protein, 237 aa, Artificial Sequence; identical to SEQ ID NO: 471
  Synthetic sequence.

SEQ ID NO: 477 - protein, 230 aa, Artificial Sequence
  Synthetic sequence.
TEEEVLRKVEKLIKDLLDVLRDLLRASEEVVREALRVLEELIEENKRVIEELSRALSGGSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGSEEKLRRDLTETKKELEKRHEDLIMSCAQESRDYKRELEEIERALE

SEQ ID NO: 478 - protein, 230 aa, Artificial Sequence
  Synthetic sequence.
TEEEVLRKVEKLIKDLLDVLRDLLRASEEVVREALRVLEELIEENKRVIEELSRALSGGSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGSEEKLRRDLTETKKELEKRHEDLLMSCAQESRDYKRELEEIERALE

SEQ ID NO: 479 - protein, 219 aa, Artificial Sequence
  Synthetic sequence.
SAKETIRKLIEENKDIIRKLAEKLKRLLEESERIAEEALRLIKELLERIERALRRVGSGIDEELLKELEKELARLEEELKEILDRVRDLHRRLAEEIRKILEESKKLNEELEDRLRKDGDVEELLELLERVHATDVRLLRELLKLLKKVHEDVVSLLERLLELLKRVLDRIVEELGLSDKELEKLLEDLEREIRRLKMSCAQESDRLEEKIRKIKRELD

SEQ ID NO: 480 - protein, 226 aa, Artificial Sequence
  Synthetic sequence.
SAKETIRKLIEENKDIIRKLAEKLKRLLEESERIAEEALRLIKELLERIERALRRVGSGIDEELLKELEKELARLEEELKEILDRVRDLHRRLAEEIRKILEESKKLNEELEDRLRKDGDVEELLELLERVHATDVRLLRELLKLLKKVHEDVVSLLERLLELLKRVLDRIVEELGLSDKELEKLLEDLEREIRRLAKRLKELAMSCAQESRKIKRELDDLSARLR

SEQ ID NO: 481 - protein, 230 aa, Artificial Sequence
  Synthetic sequence.
SAKETIRKLIEENKDIIRKLAEKLKRLLEESERIAEEALRLIKELLERIERALRRVGSGIDEELLKELEKELARLEEELKEILDRVRDLHRRLAEEIRKILEESKKLNEELEDRLRKDGDVEELLELLERVHATDVRLLRELLKLLKKVHEDVVSLLERLLELLKRVLDRIVEELGLSDKELEKLLEDLEREIRRLAKRLKELSDRLAMSCAQESRELDDLSARLREKIE

SEQ ID NO: 482 - protein, 219 aa, Artificial Sequence; identical to SEQ ID NO: 479
  Synthetic sequence.

SEQ ID NO: 483 - protein, 230 aa, Artificial Sequence
  Synthetic sequence.
SAKETIRKLIEENKDIIRKLAEKLKRLLEESERIAEEALRLIKELLERIERALRRVGSGIDEELLKELEKELARLEEELKEILDRVRDLHRRLAEEIRKILEESKKLNEELEDRLRKDGDVEELLELLERVHATDVRLLRELLKLLKKVHEDVVSLLERLLELLKRVLDRIVEELGLSDKELEKLLEDLEREIRRLAKRLKELSDRLIMSCAQESRELDDLSARLREKIE

SEQ ID NO: 484 - protein, 230 aa, Artificial Sequence
  Synthetic sequence.
SKEDKARELEKRLRDNLKKLEEVVRELAEVLKRNLEKLRRLAEELLRALKRLLDKLRAGGLPKDELEDLRREVEDVLRRLEDLLRKLKKANDESLTRLEELLRRAEEENRRVLTTLRELLRGNGDDRDLARLVARLVEANNRALEELLRLVAKNVEDNNRVLEELLRLVKELAKRLLGRIRDEDLVRDIRRELKELEERARKILRDLKMSCAQESKRIRDIIREDREELE

SEQ ID NO: 485 - protein, 237 aa, Artificial Sequence
  Synthetic sequence.
SKEDKARELEKRLRDNLKKLEEVVRELAEVLKRNLEKLRRLAEELLRALKRLLDKLRAGGLPKDELEDLRREVEDVLRRLEDLLRKLKKANDESLTRLEELLRRAEEENRRVLTTLRELLRGNGDDRDLARLVARLVEANNRALEELLRLVAKNVEDNNRVLEELLRLVKELAKRLLGRIRDEDLVRDIRRELKELEERARKILRDDERDLRALEMSCAQESREDREELERLKERAR

SEQ ID NO: 486 - protein, 223 aa, Artificial Sequence
  Synthetic sequence.
SKEDKARELEKRLRDNLKKLEEVVRELAEVLKRNLEKLRRLAEELLRALKRLLDKLRAGGLPKDELEDLRREVEDVLRRLEDLLRKLKKANDESLTRLEELLRRAEEENRRVLTTLRELLRGNGDDRDLARLVARLVEANNRALEELLRLVAKNVEDNNRVLEELLRLVKELAKRLLGRIRDEDLVRDIRRELKELEERLKMSCAQESRDLRALEKRIRDIIR

SEQ ID NO: 487 - protein, 239 aa, Artificial Sequence
  Synthetic sequence.
KREDILKKLEDIIRDIIDKLRRILEKVKRLNEDIIREIKRLLDESLKTLEDLLKRIADKSRDRELEDILRRVLEKLRRSLDKLRDTLRKLKEETDTVLERAERTLKELKDRLEKLLRDGEKVSEEDLVEALKALIDELRKVLEDVIRVSKELVERLLRALREHLETNKRLVKELLDALRKTTGDDEEIKRLKEELERRHRRLEEEVERVARELEKLHMSCAQESRRVAEELKKLLKKLR

SEQ ID NO: 488 - protein, 239 aa, Artificial Sequence
  Synthetic sequence.
KREDILKKLEDIIRDIIDKLRRILEKVKRLNEDIIREIKRLLDESLKTLEDLLKRIADKSRDRELEDILRRVLEKLRRSLDKLRDTLRKLKEETDTVLERAERTLKELKDRLEKLLRDGEKVSEEDLVEALKALIDELRKVLEDVIRVSKELVERLLRALREHLETNKRLVKELLDALRKTTGDDEEIKRLKEELERRHRRLEEEVERVARELEKLLMSCAQESRRVAEELKKLLKKLR

SEQ ID NO: 489 - protein, 221 aa, Artificial Sequence
  Synthetic sequence.
SAEETVERLLEEARKRHEEIIKKAKELLDRAREEHERIIREAEKLLEEIKKRVDELVRDGQPAEEVLRDLERVVEEILEVLRRLLDANRRVVDDVLRVLEELLRVNEEVNRRIIETIGLPEEVVEELKEENKRLRDRLDKLVKDLKKTNKEIEDKLRKLAEELKEELERIADRIRKTGTDRKTLLREIEKLLKTLEDLAMSCAQESEKTLKELEEILKDLV

SEQ ID NO: 490 - protein, 225 aa, Artificial Sequence
  Synthetic sequence.
SAEETVERLLEEARKRHEEIIKKAKELLDRAREEHERIIREAEKLLEEIKKRVDELVRDGQPAEEVLRDLERVVEEILEVLRRLLDANRRVVDDVLRVLEELLRVNEEVNRRIIETIGLPEEVVEELKEENKRLRDRLDKLVKDLKKTNKEIEDKLRKLAEELKEELERIADRIRKTGTDRKTLLREIEKLLKTLEDILRDLGMSCAQESKELEEILKDLVDKAR

SEQ ID NO: 491 - protein, 228 aa, Artificial Sequence
  Synthetic sequence.
SAEETVERLLEEARKRHEEIIKKAKELLDRAREEHERIIREAEKLLEEIKKRVDELVRDGQPAEEVLRDLERVVEEILEVLRRLLDANRRVVDDVLRVLEELLRVNEEVNRRIIETIGLPEEVVEELKEENKRLRDRLDKLVKDLKKTNKEIEDKLRKLAEELKEELERIADRIRKTGTDRKTLLREIEKLLKTLEDILRDLLRLVMSCAQESEEILKDLVDKARENL

SEQ ID NO: 492 - protein, 229 aa, Artificial Sequence
  Synthetic sequence.
SAEETVERLLEEARKRHEEIIKKAKELLDRAREEHERIIREAEKLLEEIKKRVDELVRDGQPAEEVLRDLERVVEEILEVLRRLLDANRRVVDDVLRVLEELLRVNEEVNRRIIETIGLPEEVVEELKEENKRLRDRLDKLVKDLKKTNKEIEDKLRKLAEELKEELERIADRIRKTGTDRKTLLREIEKLLKTLEDILRDLLRLLLMSCAQESEILKDLVDKARENLK

SEQ ID NO: 493 - protein, 221 aa, Artificial Sequence; identical to SEQ ID NO: 489
  Synthetic sequence.

SEQ ID NO: 494 - protein, 225 aa, Artificial Sequence; identical to SEQ ID NO: 490
  Synthetic sequence.

SEQ ID NO: 495 - protein, 228 aa, Artificial Sequence; identical to SEQ ID NO: 491
  Synthetic sequence.

SEQ ID NO: 496 - protein, 229 aa, Artificial Sequence; identical to SEQ ID NO: 492
  Synthetic sequence.

SEQ ID NO: 497 - protein, 232 aa, Artificial Sequence
  Synthetic sequence.
SAEETVERLLEEARKRHEEIIKKAKELLDRAREEHERIIREAEKLLEEIKKRVDELVRDGQPAEEVLRDLERVVEEILEVLRRLLDANRRVVDDVLRVLEELLRVNEEVNRRIIETIGLPEEVVEELKEENKRLRDRLDKLVKDLKKTNKEIEDKLRKLAEELKEELERIADRIRKTGTDRKTLLREIEKLLKTLEDILRDLLRLVEKLLMSCAQESKDLVDKARENLKRLR

SEQ ID NO: 498 - protein, 224 aa, Artificial Sequence
  Synthetic sequence.
SEKEELKRLLDKLLKELKRLSDELKATIDKILKILKEVSEEVKRTADELLDAIRRGGVDEEVLREIKREIEEIEKKLRKVNKEIEDEIREIKKKLDEVDDKITKEVEKIKEALDKGGVDAKEVIKALKEILKEHADVFEDVLRRLKEIIKRHRDVVKEVLEELRKILEKVAEVLKRQGRSEDELRKVEEDLKRLEDKLKKLLMSCAQESRELEETLDDLLRKYE

SEQ ID NO: 499 - protein, 224 aa, Artificial Sequence; identical to SEQ ID NO: 498
  Synthetic sequence.

SEQ ID NO: 500 - protein, 231 aa, Artificial Sequence
  Synthetic sequence.
SEKEELKRLLDKLLKELKRLSDELKATIDKILKILKEVSEEVKRTADELLDAIRRGGVDEEVLREIKREIEEIEKKLRKVNKEIEDEIREIKKKLDEVDDKITKEVEKIKEALDKGGVDAKEVIKALKEILKEHADVFEDVLRRLKEIIKRHRDVVKEVLEELRKILEKVAEVLKRQGRSEDELRKVEEDLKRLEDKLKKLLEDYEKLVMSCAQESDDLLRKYEETLRRLE

SEQ ID NO: 501 - protein, 232 aa, Artificial Sequence
  Synthetic sequence.
SEKEELKRLLDKLLKELKRLSDELKATIDKILKILKEVSEEVKRTADELLDAIRRGGVDEEVLREIKREIEEIEKKLRKVNKEIEDEIREIKKKLDEVDDKITKEVEKIKEALDKGGVDAKEVIKALKEILKEHADVFEDVLRRLKEIIKRHRDVVKEVLEELRKILEKVAEVLKRQGRSEDELRKVEEDLKRLEDKLKKLLEDYEKKLTMSCAQESDLLRKYEETLRRLEK

SEQ ID NO: 502 - protein, 235 aa, Artificial Sequence
  Synthetic sequence.
SEKEELKRLLDKLLKELKRLSDELKATIDKILKILKEVSEEVKRTADELLDAIRRGGVDEEVLREIKREIEEIEKKLRKVNKEIEDEIREIKKKLDEVDDKITKEVEKIKEALDKGGVDAKEVIKALKEILKEHADVFEDVLRRLKEIIKRHRDVVKEVLEELRKILEKVAEVLKRQGRSEDELRKVEEDLKRLEDKLKKLLEDYEKKVRELEMSCAQESRKYEETLRRLEKELE

SEQ ID NO: 503 - protein, 229 aa, Artificial Sequence
  Synthetic sequence.
SDAERLVKKIADSLRAYEDLLRKLVERIRDLLRAYEEELRKLLTEIEKTLEDVRDVLRRGNVDERAKEVAKRLVEAVKSLIEIVKRILEKTARVVKKLEDLLRRAAELNRDVVEKILEIIKRGGPEDDFRRIVRRLEELHREVEDAVRKLVEDLKRLHREVVEELADIIRKLDKLLAEVERDIDLGDLLEALRRLVERLKRLIERLAMSCAQESKKLLELLEEALRANR

SEQ ID NO: 504 - protein, 232 aa, Artificial Sequence
  Synthetic sequence.
SDAERLVKKIADSLRAYEDLLRKLVERIRDLLRAYEEELRKLLTEIEKTLEDVRDVLRRGNVDERAKEVAKRLVEAVKSLIEIVKRILEKTARVVKKLEDLLRRAAELNRDVVEKILEIIKRGGPEDDFRRIVRRLEELHREVEDAVRKLVEDLKRLHREVVEELADIIRKLDKLLAEVERDIDLGDLLEALRRLVERLKRLIERVLKLNMSCAQESLELLEEALRANRRLV

SEQ ID NO: 505 - protein, 233 aa, Artificial Sequence
  Synthetic sequence.
SDAERLVKKIADSLRAYEDLLRKLVERIRDLLRAYEEELRKLLTEIEKTLEDVRDVLRRGNVDERAKEVAKRLVEAVKSLIEIVKRILEKTARVVKKLEDLLRRAAELNRDVVEKILEIIKRGGPEDDFRRIVRRLEELHREVEDAVRKLVEDLKRLHREVVEELADIIRKLDKLLAEVERDIDLGDLLEALRRLVERLKRLIERVLKLLAMSCAQESELLEEALRANRRLVE

SEQ ID NO: 506 - protein, 236 aa, Artificial Sequence
  Synthetic sequence.
SDAERLVKKIADSLRAYEDLLRKLVERIRDLLRAYEEELRKLLTEIEKTLEDVRDVLRRGNVDERAKEVAKRLVEAVKSLIEIVKRILEKTARVVKKLEDLLRRAAELNRDVVEKILEIIKRGGPEDDFRRIVRRLEELHREVEDAVRKLVEDLKRLHREVVEELADIIRKLDKLLAEVERDIDLGDLLEALRRLVERLKRLIERVLKLNRELVMSCAQESEEALRANRRLVEDIL

SEQ ID NO: 507 - protein, 239 aa, Artificial Sequence
  Synthetic sequence.
SDAERLVKKIADSLRAYEDLLRKLVERIRDLLRAYEEELRKLLTEIEKTLEDVRDVLRRGNVDERAKEVAKRLVEAVKSLIEIVKRILEKTARVVKKLEDLLRRAAELNRDVVEKILEIIKRGGPEDDFRRIVRRLEELHREVEDAVRKLVEDLKRLHREVVEELADIIRKLDKLLAEVERDIDLGDLLEALRRLVERLKRLIERVLKLNRELVKLLMSCAQESLRANRRLVEDILKIA

SEQ ID NO: 508 - protein, 240 aa, Artificial Sequence
  Synthetic sequence.
SDAERLVKKIADSLRAYEDLLRKLVERIRDLLRAYEEELRKLLTEIEKTLEDVRDVLRRGNVDERAKEVAKRLVEAVKSLIEIVKRILEKTARVVKKLEDLLRRAAELNRDVVEKILEIIKRGGPEDDFRRIVRRLEELHREVEDAVRKLVEDLKRLHREVVEELADIIRKLDKLLAEVERDIDLGDLLEALRRLVERLKRLIERVLKLNRELVKKLAMSCAQESRANRRLVEDILKIAD

SEQ ID NO: 509 - protein, 243 aa, Artificial Sequence
  Synthetic sequence.
SDAERLVKKIADSLRAYEDLLRKLVERIRDLLRAYEEELRKLLTEIEKTLEDVRDVLRRGNVDERAKEVAKRLVEAVKSLIEIVKRILEKTARVVKKLEDLLRRAAELNRDVVEKILEIIKRGGPEDDFRRIVRRLEELHREVEDAVRKLVEDLKRLHREVVEELADIIRKLDKLLAEVERDIDLGDLLEALRRLVERLKRLIERVLKLNRELVKKLLELAMSCAQESRRLVEDILKIADEAR

SEQ ID NO: 510 - protein, 244 aa, Artificial Sequence
  Synthetic sequence.
SDAERLVKKIADSLRAYEDLLRKLVERIRDLLRAYEEELRKLLTEIEKTLEDVRDVLRRGNVDERAKEVAKRLVEAVKSLIEIVKRILEKTARVVKKLEDLLRRAAELNRDVVEKILEIIKRGGPEDDFRRIVRRLEELHREVEDAVRKLVEDLKRLHREVVEELADIIRKLDKLLAEVERDIDLGDLLEALRRLVERLKRLIERVLKLNRELVKKLLELLKMSCAQESRLVEDILKIADEARK

SEQ ID NO: 511 - protein, 229 aa, Artificial Sequence
  Synthetic sequence.
SDAERLVKKIADSLRAYEDLLRKLVERIRDLLRAYEEELRKLLTEIEKTLEDVRDVLRRGNVDERAKEVAKRLVEAVKSLIEIVKRILEKTARVVKKLEDLLRRAAELNRDVVEKILEIIKRGGPEDDFRRIVRRLEELHREVEDAVRKLVEDLKRLHREVVEELADIIRKLDKLLAEVERDIDLGDLLEALRRLVERLKRLIERLGMSCAQESKKLLELLEEALRANR

SEQ ID NO: 512 - protein, 233 aa, Artificial Sequence
  Synthetic sequence.
SDAERLVKKIADSLRAYEDLLRKLVERIRDLLRAYEEELRKLLTEIEKTLEDVRDVLRRGNVDERAKEVAKRLVEAVKSLIEIVKRILEKTARVVKKLEDLLRRAAELNRDVVEKILEIIKRGGPEDDFRRIVRRLEELHREVEDAVRKLVEDLKRLHREVVEELADIIRKLDKLLAEVERDIDLGDLLEALRRLVERLKRLIERVLKLLGMSCAQESELLEEALRANRRLVE

SEQ ID NO: 513 - protein, 236 aa, Artificial Sequence; identical to SEQ ID NO: 506
  Synthetic sequence.

SEQ ID NO: 514 - protein, 239 aa, Artificial Sequence
  Synthetic sequence.
SDAERLVKKIADSLRAYEDLLRKLVERIRDLLRAYEEELRKLLTEIEKTLEDVRDVLRRGNVDERAKEVAKRLVEAVKSLIEIVKRILEKTARVVKKLEDLLRRAAELNRDVVEKILEIIKRGGPEDDFRRIVRRLEELHREVEDAVRKLVEDLKRLHREVVEELADIIRKLDKLLAEVERDIDLGDLLEALRRLVERLKRLIERVLKLNRELVKLCMSCAQESLRANRRLVEDILKIA

SEQ ID NO: 515 - protein, 240 aa, Artificial Sequence
  Synthetic sequence.
SDAERLVKKIADSLRAYEDLLRKLVERIRDLLRAYEEELRKLLTEIEKTLEDVRDVLRRGNVDERAKEVAKRLVEAVKSLIEIVKRILEKTARVVKKLEDLLRRAAELNRDVVEKILEIIKRGGPEDDFRRIVRRLEELHREVEDAVRKLVEDLKRLHREVVEELADIIRKLDKLLAEVERDIDLGDLLEALRRLVERLKRLIERVLKLNRELVKKLNMSCAQESRANRRLVEDILKIAD

SEQ ID NO: 516 - protein, 243 aa, Artificial Sequence
  Synthetic sequence.
SDAERLVKKIADSLRAYEDLLRKLVERIRDLLRAYEEELRKLLTEIEKTLEDVRDVLRRGNVDERAKEVAKRLVEAVKSLIEIVKRILEKTARVVKKLEDLLRRAAELNRDVVEKILEIIKRGGPEDDFRRIVRRLEELHREVEDAVRKLVEDLKRLHREVVEELADIIRKLDKLLAEVERDIDLGDLLEALRRLVERLKRLIERVLKLNRELVKKLLELLMSCAQESRRLVEDILKIADEAR

SEQ ID NO: 517 - protein, 235 aa, Artificial Sequence
  Synthetic sequence.
SATERVLDLARDLIRILLEIHKRALKLIAELVSKLLKIHEDVLKLSEELVEELLEIVKRGLPREDLLRALKELLEKIEDVVRDIERRHRDLLREAEEVVEKLKREHEEVKERIERAVKKLAEDGVDKDKLKELVDVLEEILRLSKTTLEELVKALRDVIRASLEALKENLRILRKIIRELEGLEGVDEDTLRRVLERIREEVERVKEKHRRLLMSCAQESEELRARSADLLEDIK

SEQ ID NO: 518 - protein, 239 aa, Artificial Sequence
  Synthetic sequence.
SATERVLDLARDLIRILLEIHKRALKLIAELVSKLLKIHEDVLKLSEELVEELLEIVKRGLPREDLLRALKELLEKIEDVVRDIERRHRDLLREAEEVVEKLKREHEEVKERIERAVKKLAEDGVDKDKLKELVDVLEEILRLSKTTLEELVKALRDVIRASLEALKENLRILRKIIRELEGLEGVDEDTLRRVLERIREEVERVKEKHRRLLEELKMSCAQESARSADLLEDIKRKVR

SEQ ID NO: 519 - protein, 242 aa, Artificial Sequence
  Synthetic sequence.
SATERVLDLARDLIRILLEIHKRALKLIAELVSKLLKIHEDVLKLSEELVEELLEIVKRGLPREDLLRALKELLEKIEDVVRDIERRHRDLLREAEEVVEKLKREHEEVKERIERAVKKLAEDGVDKDKLKELVDVLEEILRLSKTTLEELVKALRDVIRASLEALKENLRILRKIIRELEGLEGVDEDTLRRVLERIREEVERVKEKHRRLLEELKKLLMSCAQESADLLEDIKRKVRELE

SEQ ID NO: 520 - protein, 239 aa, Artificial Sequence; identical to SEQ ID NO: 518
  Synthetic sequence.

SEQ ID NO: 521 - protein, 242 aa, Artificial Sequence; identical to SEQ ID NO: 519
  Synthetic sequence.

SEQ ID NO: 522 - protein, 246 aa, Artificial Sequence
  Synthetic sequence.
SATERVLDLARDLIRILLEIHKRALKLIAELVSKLLKIHEDVLKLSEELVEELLEIVKRGLPREDLLRALKELLEKIEDVVRDIERRHRDLLREAEEVVEKLKREHEEVKERIERAVKKLAEDGVDKDKLKELVDVLEEILRLSKTTLEELVKALRDVIRASLEALKENLRILRKIIRELEGLEGVDEDTLRRVLERIREEVERVKEKHRRLLEELKKLLEELAMSCAQESEDIKRKVRELEEKTR

SEQ ID NO: 523 - protein, 229 aa, Artificial Sequence
  Synthetic sequence.
SAEETLRRITEESKRVLEEITKKYEDLERESREVLRKLREDLDRIKRELEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARLLKALADKLIRVLEELLMSCAQESRKIIKFARENLERNR

SEQ ID NO: 524 - protein, 236 aa, Artificial Sequence
  Synthetic sequence.
SAEETLRRITEESKRVLEEITKKYEDLERESREVLRKLREDLDRIKRELEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARLLKALADKLIRVLEEILKINEELNMSCAQESRENLERNRRVNKKVI

SEQ ID NO: 525 - protein, 237 aa, Artificial Sequence
  Synthetic sequence.
SAEETLRRITEESKRVLEEITKKYEDLERESREVLRKLREDLDRIKRELEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARLLKALADKLIRVLEEILKINEELLKMSCAQESENLERNRRVNKKVIE

SEQ ID NO: 526 - protein, 240 aa, Artificial Sequence
  Synthetic sequence.
SAEETLRRITEESKRVLEEITKKYEDLERESREVLRKLREDLDRIKRELEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARLLKALADKLIRVLEEILKINEELNRKLIMSCAQESERNRRVNKKVIEVLR

SEQ ID NO: 527 - protein, 243 aa, Artificial Sequence
  Synthetic sequence.
SAEETLRRITEESKRVLEEITKKYEDLERESREVLRKLREDLDRIKRELEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARLLKALADKLIRVLEEILKINEELNRKIIKLAMSCAQESRRVNKKVIEVLREAA

SEQ ID NO: 528 - protein, 236 aa, Artificial Sequence; identical to SEQ ID NO: 524
  Synthetic sequence.

SEQ ID NO: 529 - protein, 240 aa, Artificial Sequence
  Synthetic sequence.
SAEETLRRITEESKRVLEEITKKYEDLERESREVLRKLREDLDRIKRELEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARLLKALADKLIRVLEEILKINEELNRKLVMSCAQESERNRRVNKKVIEVLR

SEQ ID NO: 530 - protein, 243 aa, Artificial Sequence; identical to SEQ ID NO: 527
  Synthetic sequence.

SEQ ID NO: 531 - protein, 235 aa, Artificial Sequence
  Synthetic sequence.
STEEILKRVKEILDELAKELRDIIRESLRTIEELLDELRRILEESERTLEELVKTIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPDEVKRRLEEKERRIRTRYEELKMSCAQESKDYEDKLREIEKKVR

SEQ ID NO: 532 - protein, 235 aa, Artificial Sequence
  Synthetic sequence.
STEEILKRVKEILDELAKELRDIIRESLRTIEELLDELRRILEESERTLEELVKTIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPDEVKRRLEEKERRIRTRYEELRMSCAQESKDYEDKLREIEKKVR

SEQ ID NO: 533 - protein, 249 aa, Artificial Sequence
  Synthetic sequence.
STEEILKRVKEILDELAKELRDIIRESLRTIEELLDELRRILEESERTLEELVKTIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPDEVKRRLEEKERRIRTRYEELRRRLRKRVKDYEDLMMSCAQESRRDAERIEEELERAK

SEQ ID NO: 534 - protein, 232 aa, Artificial Sequence
  Synthetic sequence.
SEKEELLKLIKRVIELLKRVLEEHLRLVEDVIRRLKELLDSNEKIVREVIEDLKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASEDLLRKAKKVITEVREKLKRLLMSCAQESEDVKRKSARILEEAR

SEQ ID NO: 535 - protein, 239 aa, Artificial Sequence
  Synthetic sequence.
SEKEELLKLIKRVIELLKRVLEEHLRLVEDVIRRLKELLDSNEKIVREVIEDLKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASEDLLRKAKKVITEVREKLKRNLEDVRRLIMSCAQESARILEEARRLIEEVE

SEQ ID NO: 536 - protein, 243 aa, Artificial Sequence
  Synthetic sequence.
SEKEELLKLIKRVIELLKRVLEEHLRLVEDVIRRLKELLDSNEKIVREVIEDLKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASEDLLRKAKKVITEVREKLKRNLEDVRRVIEDLKMSCAQESEEARRLIEEVERELE

SEQ ID NO: 537 - protein, 246 aa, Artificial Sequence
  Synthetic sequence.
SEKEELLKLIKRVIELLKRVLEEHLRLVEDVIRRLKELLDSNEKIVREVIEDLKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASEDLLRKAKKVITEVREKLKRNLEDVRRVIEDVKRLAMSCAQESRRLIEEVERELEKIR

SEQ ID NO: 538 - protein, 232 aa, Artificial Sequence; identical to SEQ ID NO: 534
  Synthetic sequence.

SEQ ID NO: 539 - protein, 236 aa, Artificial Sequence
  Synthetic sequence.
SEKEELLKLIKRVIELLKRVLEEHLRLVEDVIRRLKELLDSNEKIVREVIEDLKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASEDLLRKAKKVITEVREKLKRNLEDLAMSCAQESRKSARILEEARRLIE

SEQ ID NO: 540 - protein, 239 aa, Artificial Sequence; identical to SEQ ID NO: 535
  Synthetic sequence.

SEQ ID NO: 541 - protein, 246 aa, Artificial Sequence; identical to SEQ ID NO: 537
  Synthetic sequence.

SEQ ID NO: 542 - protein, 247 aa, Artificial Sequence
  Synthetic sequence.
SEKEELLKLIKRVIELLKRVLEEHLRLVEDVIRRLKELLDSNEKIVREVIEDLKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASEDLLRKAKKVITEVREKLKRNLEDVRRVIEDVKRKLKMSCAQESRLIEEVERELEKIRK

SEQ ID NO: 543 - protein, 224 aa, Artificial Sequence
  Synthetic sequence.
SRAERIKRALEEHIRKLKEITDEVRKTNEELLELTRRILEEAKKANEELVKKIREAGDKSKELEEEIRKLIEESERIVEELEERSKELLKRSREEVEEWRRRSEELLRRLEAILRGVKDEKELVERAVKILRDDSRIAKEILRRNLRLIEENLERLKEIIERNLDLLRRLLELLKRAGVDEEALKELEEKLDRYRRKLEDLLMSCAQESEDYKRKVKKLEEENE

SEQ ID NO: 544 - protein, 228 aa, Artificial Sequence
  Synthetic sequence.
SRAERIKRALEEHIRKLKEITDEVRKTNEELLELTRRILEEAKKANEELVKKIREAGDKSKELEEEIRKLIEESERIVEELEERSKELLKRSREEVEEWRRRSEELLRRLEAILRGVKDEKELVERAVKILRDDSRIAKEILRRNLRLIEENLERLKEIIERNLDLLRRLLELLKRAGVDEEALKELEEKLDRYRRKLEDLLRKLAMSCAQESRKVKKLEEENEELLK

SEQ ID NO: 545 - protein, 224 aa, Artificial Sequence; identical to SEQ ID NO: 543
  Synthetic sequence.

SEQ ID NO: 546 - protein, 228 aa, Artificial Sequence; identical to SEQ ID NO: 544
  Synthetic sequence.

SEQ ID NO: 547 - protein, 230 aa, Artificial Sequence
  Synthetic sequence.
SEAEKIREALETNLRLLEELIKRLKEILDTHNELLRRVIETLERLLKELLELLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKEDLERLRRKVEELEDRLRRLLEKLKMSCAQESRELERILDRYARESE

SEQ ID NO: 548 - protein, 233 aa, Artificial Sequence
  Synthetic sequence.
SEAEKIREALETNLRLLEELIKRLKEILDTHNELLRRVIETLERLLKELLELLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKEDLERLRRKVEELEDRLRRLLEKLARLAMSCAQESERILDRYARESEELD

SEQ ID NO: 549 - protein, 234 aa, Artificial Sequence
  Synthetic sequence.
SEAEKIREALETNLRLLEELIKRLKEILDTHNELLRRVIETLERLLKELLELLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKEDLERLRRKVEELEDRLRRLLEKLARDLKMSCAQESRILDRYARESEELDR

SEQ ID NO: 550 - protein, 237 aa, Artificial Sequence
  Synthetic sequence.
SEAEKIREALETNLRLLEELIKRLKEILDTHNELLRRVIETLERLLKELLELLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKEDLERLRRKVEELEDRLRRLLEKLARDSAELMMSCAQESDRYARESEELDRRLA

SEQ ID NO: 551 - protein, 230 aa, Artificial Sequence
  Synthetic sequence.
SEAEKIREALETNLRLLEELIKRLKEILDTHNELLRRVIETLERLLKELLELLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKEDLERLRRKVEELEDRLRRLLEKLLMSCAQESRELERILDRYARESE

SEQ ID NO: 552 - protein, 233 aa, Artificial Sequence; identical to SEQ ID NO: 548
  Synthetic sequence.

SEQ ID NO: 553 - protein, 234 aa, Artificial Sequence; identical to SEQ ID NO: 549
  Synthetic sequence.

SEQ ID NO: 554 - protein, 237 aa, Artificial Sequence; identical to SEQ ID NO: 550
  Synthetic sequence.

SEQ ID NO: 555 - protein, 233 aa, Artificial Sequence
  Synthetic sequence.
SAEEELEKLVRKVEEDLKRLEEESERIKKEIKDTLRAIRKRSEDLKRKVKELLRRLEEEGRRVSLEEAIKIIKEILDELAKVNEDIIRIIKELLKRLVDTNRRVIETIDRILKKLVDDLRRGNLPEDKLREVERELRELKKELEEIVRESEKMLKELEDKLREIVRESRELLEKLRRDLKRIKDGNLSADEALEMLKRLLDKALKVHEDLVMSCAQESDEVLKVHEESLRKLL

SEQ ID NO: 556 - protein, 236 aa, Artificial Sequence
  Synthetic sequence.
SAEEELEKLVRKVEEDLKRLEEESERIKKEIKDTLRAIRKRSEDLKRKVKELLRRLEEEGRRVSLEEAIKIIKEILDELAKVNEDIIRIIKELLKRLVDTNRRVIETIDRILKKLVDDLRRGNLPEDKLREVERELRELKKELEEIVRESEKMLKELEDKLREIVRESRELLEKLRRDLKRIKDGNLSADEALEMLKRLLDKALKVHEDVLRLLMSCAQESLKVHEESLRKLLTLA

SEQ ID NO: 557 - protein, 237 aa, Artificial Sequence
  Synthetic sequence.
SAEEELEKLVRKVEEDLKRLEEESERIKKEIKDTLRAIRKRSEDLKRKVKELLRRLEEEGRRVSLEEAIKIIKEILDELAKVNEDIIRIIKELLKRLVDTNRRVIETIDRILKKLVDDLRRGNLPEDKLREVERELRELKKELEEIVRESEKMLKELEDKLREIVRESRELLEKLRRDLKRIKDGNLSADEALEMLKRLLDKALKVHEDVLRKLVMSCAQESKVHEESLRKLLTLAA

SEQ ID NO: 558 - protein, 240 aa, Artificial Sequence
  Synthetic sequence.
SAEEELEKLVRKVEEDLKRLEEESERIKKEIKDTLRAIRKRSEDLKRKVKELLRRLEEEGRRVSLEEAIKIIKEILDELAKVNEDIIRIIKELLKRLVDTNRRVIETIDRILKKLVDDLRRGNLPEDKLREVERELRELKKELEEIVRESEKMLKELEDKLREIVRESRELLEKLRRDLKRIKDGNLSADEALEMLKRLLDKALKVHEDVLRKLVELVMSCAQESEESLRKLLTLAAKVL

SEQ ID NO: 559 - protein, 244 aa, Artificial Sequence
  Synthetic sequence.
SAEEELEKLVRKVEEDLKRLEEESERIKKEIKDTLRAIRKRSEDLKRKVKELLRRLEEEGRRVSLEEAIKIIKEILDELAKVNEDIIRIIKELLKRLVDTNRRVIETIDRILKKLVDDLRRGNLPEDKLREVERELRELKKELEEIVRESEKMLKELEDKLREIVRESRELLEKLRRDLKRIKDGNLSADEALEMLKRLLDKALKVHEDVLRKLVELVDELLMSCAQESRKLLTLAAKVLEVLR

SEQ ID NO: 560 - protein, 248 aa, Artificial Sequence
  Synthetic sequence.
SAEEELEKLVRKVEEDLKRLEEESERIKKEIKDTLRAIRKRSEDLKRKVKELLRRLEEEGRRVSLEEAIKIIKEILDELAKVNEDIIRIIKELLKRLVDTNRRVIETIDRILKKLVDDLRRGNLPEDKLREVERELRELKKELEEIVRESEKMLKELEDKLREIVRESRELLEKLRRDLKRIKDGNLSADEALEMLKRLLDKALKVHEDVLRKLVELVDEVLKVLEMSCAQESTLAAKVLEVLRKITK

SEQ ID NO: 561 - protein, 233 aa, Artificial Sequence
  Synthetic sequence.
SAEEELEKLVRKVEEDLKRLEEESERIKKEIKDTLRAIRKRSEDLKRKVKELLRRLEEEGRRVSLEEAIKIIKEILDELAKVNEDIIRIIKELLKRLVDTNRRVIETIDRILKKLVDDLRRGNLPEDKLREVERELRELKKELEEIVRESEKMLKELEDKLREIVRESRELLEKLRRDLKRIKDGNLSADEALEMLKRLLDKALKVHEDLAMSCAQESDEVLKVHEESLRKLL

SEQ ID NO: 562 - protein, 236 aa, Artificial Sequence
  Synthetic sequence.
SAEEELEKLVRKVEEDLKRLEEESERIKKEIKDTLRAIRKRSEDLKRKVKELLRRLEEEGRRVSLEEAIKIIKEILDELAKVNEDIIRIIKELLKRLVDTNRRVIETIDRILKKLVDDLRRGNLPEDKLREVERELRELKKELEEIVRESEKMLKELEDKLREIVRESRELLEKLRRDLKRIKDGNLSADEALEMLKRLLDKALKVHEDVLRLGMSCAQESLKVHEESLRKLLTLA

SEQ ID NO: 563 - protein, 237 aa, Artificial Sequence
  Synthetic sequence.
SAEEELEKLVRKVEEDLKRLEEESERIKKEIKDTLRAIRKRSEDLKRKVKELLRRLEEEGRRVSLEEAIKIIKEILDELAKVNEDIIRIIKELLKRLVDTNRRVIETIDRILKKLVDDLRRGNLPEDKLREVERELRELKKELEEIVRESEKMLKELEDKLREIVRESRELLEKLRRDLKRIKDGNLSADEALEMLKRLLDKALKVHEDVLRKLTMSCAQESKVHEESLRKLLTLAA

SEQ ID NO: 564 - protein, 240 aa, Artificial Sequence; identical to SEQ ID NO: 558
  Synthetic sequence.

SEQ ID NO: 565 - protein, 241 aa, Artificial Sequence
  Synthetic sequence.
SAEEELEKLVRKVEEDLKRLEEESERIKKEIKDTLRAIRKRSEDLKRKVKELLRRLEEEGRRVSLEEAIKIIKEILDELAKVNEDIIRIIKELLKRLVDTNRRVIETIDRILKKLVDDLRRGNLPEDKLREVERELRELKKELEEIVRESEKMLKELEDKLREIVRESRELLEKLRRDLKRIKDGNLSADEALEMLKRLLDKALKVHEDVLRKLVELLLMSCAQESESLRKLLTLAAKVLE

SEQ ID NO: 566 - protein, 244 aa, Artificial Sequence
  Synthetic sequence.
SAEEELEKLVRKVEEDLKRLEEESERIKKEIKDTLRAIRKRSEDLKRKVKELLRRLEEEGRRVSLEEAIKIIKEILDELAKVNEDIIRIIKELLKRLVDTNRRVIETIDRILKKLVDDLRRGNLPEDKLREVERELRELKKELEEIVRESEKMLKELEDKLREIVRESRELLEKLRRDLKRIKDGNLSADEALEMLKRLLDKALKVHEDVLRKLVELVDELMMSCAQESRKLLTLAAKVLEVLR

SEQ ID NO: 567 - protein, 247 aa, Artificial Sequence
  Synthetic sequence.
SAEEELEKLVRKVEEDLKRLEEESERIKKEIKDTLRAIRKRSEDLKRKVKELLRRLEEEGRRVSLEEAIKIIKEILDELAKVNEDIIRIIKELLKRLVDTNRRVIETIDRILKKLVDDLRRGNLPEDKLREVERELRELKKELEEIVRESEKMLKELEDKLREIVRESRELLEKLRRDLKRIKDGNLSADEALEMLKRLLDKALKVHEDVLRKLVELVDEVLKLHMSCAQESLTLAAKVLEVLRKIT

SEQ ID NO: 568 - protein, 229 aa, Artificial Sequence
  Synthetic sequence.
DDERRKLEDLERMVEELKRKSDKLLKEIREEVERLERETRKLLEELKAKVDELREDLRRNPGDRVLEKLVKLLEDILDKVRKLLKENLDLLKRLLDIIEKLLRDNVRLLEELLRIVRELGKSGDEEKLTRKLEKALKEVRDAARETRERLKEAKKEVKTVADRNRARLEELEEEVKRVLDEIRKEGGPSEDLEKAERLVKDILRLLEMSCAQESDVVRDLLRALEKHTR

SEQ ID NO: 569 - protein, 236 aa, Artificial Sequence
  Synthetic sequence.
DDERRKLEDLERMVEELKRKSDKLLKEIREEVERLERETRKLLEELKAKVDELREDLRRNPGDRVLEKLVKLLEDILDKVRKLLKENLDLLKRLLDIIEKLLRDNVRLLEELLRIVRELGKSGDEEKLTRKLEKALKEVRDAARETRERLKEAKKEVKTVADRNRARLEELEEEVKRVLDEIRKEGGPSEDLEKAERLVKDILRLNEEHTAELEMSCAQESRALEKHTRDLEKLVK

SEQ ID NO: 570 - protein, 243 aa, Artificial Sequence
  Synthetic sequence.
DDERRKLEDLERMVEELKRKSDKLLKEIREEVERLERETRKLLEELKAKVDELREDLRRNPGDRVLEKLVKLLEDILDKVRKLLKENLDLLKRLLDIIEKLLRDNVRLLEELLRIVRELGKSGDEEKLTRKLEKALKEVRDAARETRERLKEAKKEVKTVADRNRARLEELEEEVKRVLDEIRKEGGPSEDLEKAERLVKDILRLNEEHTAELEDVVRDLNMSCAQESRDLEKLVKDALDKVK

SEQ ID NO: 571 - protein, 229 aa, Artificial Sequence; identical to SEQ ID NO: 568
  Synthetic sequence.

SEQ ID NO: 572 - protein, 240 aa, Artificial Sequence
  Synthetic sequence.
DDERRKLEDLERMVEELKRKSDKLLKEIREEVERLERETRKLLEELKAKVDELREDLRRNPGDRVLEKLVKLLEDILDKVRKLLKENLDLLKRLLDIIEKLLRDNVRLLEELLRIVRELGKSGDEEKLTRKLEKALKEVRDAARETRERLKEAKKEVKTVADRNRARLEELEEEVKRVLDEIRKEGGPSEDLEKAERLVKDILRLNEEHTAELEDVLKMSCAQESKHTRDLEKLVKDALD

SEQ ID NO: 573 - protein, 243 aa, Artificial Sequence
  Synthetic sequence.
DDERRKLEDLERMVEELKRKSDKLLKEIREEVERLERETRKLLEELKAKVDELREDLRRNPGDRVLEKLVKLLEDILDKVRKLLKENLDLLKRLLDIIEKLLRDNVRLLEELLRIVRELGKSGDEEKLTRKLEKALKEVRDAARETRERLKEAKKEVKTVADRNRARLEELEEEVKRVLDEIRKEGGPSEDLEKAERLVKDILRLNEEHTAELEDVVRDLIMSCAQESRDLEKLVKDALDKVK

SEQ ID NO: 574 - protein, 236 aa, Artificial Sequence
  Synthetic sequence.
SKIDEALKKLAKILEDAIKLNKELNDTTAEILKEIIKLNAEVLEKIRRILKELVDLILKGLKDDEEAKKELKKVLEEVARRLEEIKKETDRIVKEVEELNERNDREVKRAAEEVRRLLEEIKRSDRDEKELIKALKEIVDRIREAHRRSVEELSEVVKRILDALKDTLRKLEDVVRKLLELARRIAGDTEELRRVVEKVRKELEDDKERYKRLEMSCAQESEEMKRRSEDLERKVE

SEQ ID NO: 575 - protein, 240 aa, Artificial Sequence
  Synthetic sequence.
SKIDEALKKLAKILEDAIKLNKELNDTTAEILKEIIKLNAEVLEKIRRILKELVDLILKGLKDDEEAKKELKKVLEEVARRLEEIKKETDRIVKEVEELNERNDREVKRAAEEVRRLLEEIKRSDRDEKELIKALKEIVDRIREAHRRSVEELSEVVKRILDALKDTLRKLEDVVRKLLELARRIAGDTEELRRVVEKVRKELEDDKERYKRLEEELRMSCAQESRRSEDLERKVEEILR

SEQ ID NO: 576 - protein, 236 aa, Artificial Sequence; identical to SEQ ID NO: 574
  Synthetic sequence.

SEQ ID NO: 577 - protein, 231 aa, Artificial Sequence
  Synthetic sequence.
DEEEKIREDLERTLREYERELRRAKEELKETLKRYEEELREVKEDLDRTLEEVDDLLRRGSLSDREAIRILRELLKKLEEIIRRSKEVLDKLIKDLEDISRRSIEVLEELVKKVRKDGLPEEVLRRIKDLIRRLRERNKEILDRIRKLIEELVERNKRALDRLRKLIKELEERVRRTDDKETLARDLKEALKTLIKLIREILEDNLRLLMSCAQESETLLEDNRRVLEEII

SEQ ID NO: 578 - protein, 234 aa, Artificial Sequence
  Synthetic sequence.
DEEEKIREDLERTLREYERELRRAKEELKETLKRYEEELREVKEDLDRTLEEVDDLLRRGSLSDREAIRILRELLKKLEEIIRRSKEVLDKLIKDLEDISRRSIEVLEELVKKVRKDGLPEEVLRRIKDLIRRLRERNKEILDRIRKLIEELVERNKRALDRLRKLIKELEERVRRTDDKETLARDLKEALKTLIKLIREILEDNLRVLRLAMSCAQESLEDNRRVLEEIIKLI

SEQ ID NO: 579 - protein, 225 aa, Artificial Sequence
  Synthetic sequence.
DEEEKIREDLERTLREYERELRRAKEELKETLKRYEEELREVKEDLDRTLEEVDDLLRRGSLSDREAIRILRELLKKLEEIIRRSKEVLDKLIKDLEDISRRSIEVLEELVKKVRKDGLPEEVLRRIKDLIRRLRERNKEILDRIRKLIEELVERNKRALDRLRKLIKELEERVRRTDDKETLARDLKEALKTLIKLIREILEMSCAQESRIIELIETLLEDNRR

SEQ ID NO: 580 - protein, 227 aa, Artificial Sequence
  Synthetic sequence.
DEEEKIREDLERTLREYERELRRAKEELKETLKRYEEELREVKEDLDRTLEEVDDLLRRGSLSDREAIRILRELLKKLEEIIRRSKEVLDKLIKDLEDISRRSIEVLEELVKKVRKDGLPEEVLRRIKDLIRRLRERNKEILDRIRKLIEELVERNKRALDRLRKLIKELEERVRRTDDKETLARDLKEALKTLIKLIREILELAMSCAQESIELIETLLEDNRRVL

SEQ ID NO: 581 - protein, 231 aa, Artificial Sequence; identical to SEQ ID NO: 577
  Synthetic sequence.

SEQ ID NO: 582 - protein, 232 aa, Artificial Sequence
  Synthetic sequence.
DEEEKIREDLERTLREYERELRRAKEELKETLKRYEEELREVKEDLDRTLEEVDDLLRRGSLSDREAIRILRELLKKLEEIIRRSKEVLDKLIKDLEDISRRSIEVLEELVKKVRKDGLPEEVLRRIKDLIRRLRERNKEILDRIRKLIEELVERNKRALDRLRKLIKELEERVRRTDDKETLARDLKEALKTLIKLIREILEDNLRVLRMSCAQESTLLEDNRRVLEEIIK

SEQ ID NO: 583 - protein, 234 aa, Artificial Sequence
  Synthetic sequence.
DEEEKIREDLERTLREYERELRRAKEELKETLKRYEEELREVKEDLDRTLEEVDDLLRRGSLSDREAIRILRELLKKLEEIIRRSKEVLDKLIKDLEDISRRSIEVLEELVKKVRKDGLPEEVLRRIKDLIRRLRERNKEILDRIRKLIEELVERNKRALDRLRKLIKELEERVRRTDDKETLARDLKEALKTLIKLIREILEDNLRVLRLVMSCAQESLEDNRRVLEEIIKLI

SEQ ID NO: 584 - protein, 229 aa, Artificial Sequence
  Synthetic sequence.
DELEKVERLLEEIEKIIEDLIRRVEELVRRILEFNKTTLKRNEELVRELEKLVKETTGGTEELKKIVEKLEKLHREVKKKSDDLVKRAEELLKEVKERLKEIVKTIREELRKVKESGGDREELLKLLAEILDKLLKLLKRIIEELLRILKELIKASKESLDDLKRINEELLRDIEDLIRKGIKESKEVVRKLEEDLRRVRERSKKLVMSCAQESEDLEETIKEEKRRVD

SEQ ID NO: 585 - protein, 229 aa, Artificial Sequence
  Synthetic sequence.
DELEKVERLLEEIEKIIEDLIRRVEELVRRILEFNKTTLKRNEELVRELEKLVKETTGGTEELKKIVEKLEKLHREVKKKSDDLVKRAEELLKEVKERLKEIVKTIREELRKVKESGGDREELLKLLAEILDKLLKLLKRIIEELLRILKELIKASKESLDDLKRINEELLRDIEDLIRKGIKESKEVVRKLEEDLRRVRERSKKLYMSCAQESEDLEETIKEEKRRVD

SEQ ID NO: 586 - protein, 240 aa, Artificial Sequence
  Synthetic sequence.
DELEKVERLLEEIEKIIEDLIRRVEELVRRILEFNKTTLKRNEELVRELEKLVKETTGGTEELKKIVEKLEKLHREVKKKSDDLVKRAEELLKEVKERLKEIVKTIREELRKVKESGGDREELLKLLAEILDKLLKLLKRIIEELLRILKELIKASKESLDDLKRINEELLRDIEDLIRKGIKESKEVVRKLEEDLRRVRERSKKLVREHEKFLEDLKMSCAQESRRVDEELKRIKEEIK

SEQ ID NO: 587 - protein, 234 aa, Artificial Sequence
  Synthetic sequence.
SEKERLMRLLDKLKDLNRRLVERIKELLDKALELHKKLVKELRELLERLKELVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSEETVRRLREALKKLEDDLRKIERDAERLYMSCAQESEELTERYRREIRKLK

SEQ ID NO: 588 - protein, 238 aa, Artificial Sequence
  Synthetic sequence.
SEKERLMRLLDKLKDLNRRLVERIKELLDKALELHKKLVKELRELLERLKELVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSEETVRRLREALKKLEDDLRKIERDAEREYKKLLMSCAQESERYRREIRKLKEELK

SEQ ID NO: 589 - protein, 234 aa, Artificial Sequence; identical to SEQ ID NO: 587
  Synthetic sequence.

SEQ ID NO: 590 - protein, 238 aa, Artificial Sequence; identical to SEQ ID NO: 588
  Synthetic sequence.

SEQ ID NO: 591 - protein, 233 aa, Artificial Sequence
  Synthetic sequence.
SEAEDLEELIKELAELLKDVIRKLEKINRRLVKILEDIIRRLKEISKEAEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDEAERRRRELKDKLDRLREELLMSCAQESEELTRLRETHKKIEK

SEQ ID NO: 592 - protein, 236 aa, Artificial Sequence
  Synthetic sequence.
SEAEDLEELIKELAELLKDVIRKLEKINRRLVKILEDIIRRLKEISKEAEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDEAERRRRELKDKLDRLREEHEELKMSCAQESTRLRETHKKIEKELR

SEQ ID NO: 593 - protein, 243 aa, Artificial Sequence
  Synthetic sequence.
SEAEDLEELIKELAELLKDVIRKLEKINRRLVKILEDIIRRLKEISKEAEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDEAERRRRELKDKLDRLREEHEEVKRRLEELLMSCAQESKKIEKELREALKRVR

SEQ ID NO: 594 - protein, 247 aa, Artificial Sequence
  Synthetic sequence.
SEAEDLEELIKELAELLKDVIRKLEKINRRLVKILEDIIRRLKEISKEAEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDEAERRRRELKDKLDRLREEHEEVKRRLEEELTRLRMSCAQESKELREALKRVRDRST

SEQ ID NO: 595 - protein, 232 aa, Artificial Sequence
  Synthetic sequence.
SEAEDLEELIKELAELLKDVIRKLEKINRRLVKILEDIIRRLKEISKEAEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDEAERRRRELKDKLDRLRELHMSCAQESEEELTRLRETHKKIE

SEQ ID NO: 596 - protein, 233 aa, Artificial Sequence
  Synthetic sequence.
SEAEDLEELIKELAELLKDVIRKLEKINRRLVKILEDIIRRLKEISKEAEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDEAERRRRELKDKLDRLREELKMSCAQESEELTRLRETHKKIEK

SEQ ID NO: 597 - protein, 243 aa, Artificial Sequence; identical to SEQ ID NO: 593
  Synthetic sequence.

SEQ ID NO: 598 - protein, 247 aa, Artificial Sequence; identical to SEQ ID NO: 594
  Synthetic sequence.

SEQ ID NO: 599 - protein, 228 aa, Artificial Sequence
  Synthetic sequence.
SDKEEIKRRVEKTARDLETEHDKIKKRLEDTVRDIKRELDELLEKYERVLRKIEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILELLMSCAQESLEALEEVLRRNKELI

SEQ ID NO: 600 - protein, 229 aa, Artificial Sequence
  Synthetic sequence.
SDKEEIKRRVEKTARDLETEHDKIKKRLEDTVRDIKRELDELLEKYERVLRKIEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALKMSCAQESEALEEVLRRNKELIR

SEQ ID NO: 601 - protein, 232 aa, Artificial Sequence
  Synthetic sequence.
SDKEEIKRRVEKTARDLETEHDKIKKRLEDTVRDIKRELDELLEKYERVLRKIEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALAKLVMSCAQESEEVLRRNKELIRELL

SEQ ID NO: 602 - protein, 235 aa, Artificial Sequence
  Synthetic sequence.
SDKEEIKRRVEKTARDLETEHDKIKKRLEDTVRDIKRELDELLEKYERVLRKIEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALAKLIKLLMSCAQESLRRNKELIRELLRVL

SEQ ID NO: 603 - protein, 236 aa, Artificial Sequence
  Synthetic sequence.
SDKEEIKRRVEKTARDLETEHDKIKKRLEDTVRDIKRELDELLEKYERVLRKIEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALAKLIKELLMSCAQESRRNKELIRELLRVLD

SEQ ID NO: 604 - protein, 239 aa, Artificial Sequence
  Synthetic sequence.
SDKEEIKRRVEKTARDLETEHDKIKKRLEDTVRDIKRELDELLEKYERVLRKIEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALAKLIKELLELCMSCAQESKELIRELLRVLDEAL

SEQ ID NO: 605 - protein, 240 aa, Artificial Sequence
  Synthetic sequence.
SDKEEIKRRVEKTARDLETEHDKIKKRLEDTVRDIKRELDELLEKYERVLRKIEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALAKLIKELLEALKMSCAQESELIRELLRVLDEALK

SEQ ID NO: 606 - protein, 228 aa, Artificial Sequence; identical to SEQ ID NO: 599
  Synthetic sequence.

SEQ ID NO: 607 - protein, 232 aa, Artificial Sequence
  Synthetic sequence.
SDKEEIKRRVEKTARDLETEHDKIKKRLEDTVRDIKRELDELLEKYERVLRKIEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALAKLIMSCAQESEEVLRRNKELIRELL

SEQ ID NO: 608 - protein, 235 aa, Artificial Sequence; identical to SEQ ID NO: 602
  Synthetic sequence.

SEQ ID NO: 609 - protein, 236 aa, Artificial Sequence; identical to SEQ ID NO: 603
  Synthetic sequence.

SEQ ID NO: 610 - protein, 239 aa, Artificial Sequence
  Synthetic sequence.
SDKEEIKRRVEKTARDLETEHDKIKKRLEDTVRDIKRELDELLEKYERVLRKIEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALAKLIKELLELLMSCAQESKELIRELLRVLDEAL

SEQ ID NO: 611 - protein, 240 aa, Artificial Sequence; identical to SEQ ID NO: 605
  Synthetic sequence.

SEQ ID NO: 612 - protein, 237 aa, Artificial Sequence
  Synthetic sequence.
DEEERVKKLLTDLRRLLRKLHEESKKLLDELRKKLRELRRRSEEKLREVERRLREAEKKLPGTRVLKLVADVVKKVLDAIRDLNRKLEEIIDEALKLLEELDDILRRVVEEALRLLKEIKDTKGDREEVKKRVEDILKRLEELVKEYEDRVREIKKRLRRALEELRDEYRKIREDIERVLDELRKGGVPEELLRVLEELVRTLKKLLDENLKMLEMSCAQESKVLDDHERKVRRLIE

SEQ ID NO: 613 - protein, 240 aa, Artificial Sequence
  Synthetic sequence.
DEEERVKKLLTDLRRLLRKLHEESKKLLDELRKKLRELRRRSEEKLREVERRLREAEKKLPGTRVLKLVADVVKKVLDAIRDLNRKLEEIIDEALKLLEELDDILRRVVEEALRLLKEIKDTKGDREEVKKRVEDILKRLEELVKEYEDRVREIKKRLRRALEELRDEYRKIREDIERVLDELRKGGVPEELLRVLEELVRTLKKLLDENLKMVERLIMSCAQESDDHERKVRRLIEELL

SEQ ID NO: 614 - protein, 233 aa, Artificial Sequence
  Synthetic sequence.
DEEERVKKLLTDLRRLLRKLHEESKKLLDELRKKLRELRRRSEEKLREVERRLREAEKKLPGTRVLKLVADVVKKVLDAIRDLNRKLEEIIDEALKLLEELDDILRRVVEEALRLLKEIKDTKGDREEVKKRVEDILKRLEELVKEYEDRVREIKKRLRRALEELRDEYRKIREDIERVLDELRKGGVPEELLRVLEELVRTLKKLLDELEMSCAQESRELEKVLDDHERKVR

SEQ ID NO: 615 - protein, 237 aa, Artificial Sequence
  Synthetic sequence.
DEEERVKKLLTDLRRLLRKLHEESKKLLDELRKKLRELRRRSEEKLREVERRLREAEKKLPGTRVLKLVADVVKKVLDAIRDLNRKLEEIIDEALKLLEELDDILRRVVEEALRLLKEIKDTKGDREEVKKRVEDILKRLEELVKEYEDRVREIKKRLRRALEELRDEYRKIREDIERVLDELRKGGVPEELLRVLEELVRTLKKLLDENLKMLAMSCAQESKVLDDHERKVRRLIE

SEQ ID NO: 616 - protein, 240 aa, Artificial Sequence; identical to SEQ ID NO: 613
  Synthetic sequence.

SEQ ID NO: 617 - protein, 244 aa, Artificial Sequence
  Synthetic sequence.
DEEERVKKLLTDLRRLLRKLHEESKKLLDELRKKLRELRRRSEEKLREVERRLREAEKKLPGTRVLKLVADVVKKVLDAIRDLNRKLEEIIDEALKLLEELDDILRRVVEEALRLLKEIKDTKGDREEVKKRVEDILKRLEELVKEYEDRVREIKKRLRRALEELRDEYRKIREDIERVLDELRKGGVPEELLRVLEELVRTLKKLLDENLKMVERLIRELEMSCAQESRKVRRLIEELLEVLD

SEQ ID NO: 618 - protein, 248 aa, Artificial Sequence
  Synthetic sequence.
DEEERVKKLLTDLRRLLRKLHEESKKLLDELRKKLRELRRRSEEKLREVERRLREAEKKLPGTRVLKLVADVVKKVLDAIRDLNRKLEEIIDEALKLLEELDDILRRVVEEALRLLKEIKDTKGDREEVKKRVEDILKRLEELVKEYEDRVREIKKRLRRALEELRDEYRKIREDIERVLDELRKGGVPEELLRVLEELVRTLKKLLDENLKMVERLIRELEKVLDMSCAQESRLIEELLEVLDRDAK

SEQ ID NO: 619 - protein, 244 aa, Artificial Sequence
  Synthetic sequence.
DEDRIIEEIARLLEELLRELLELIKKLIETNRRLNEEHERAVRELARLLEELLDRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIAEEIERELEELRRMIKRLHEDLERKLKELLMSCAQESARLEEKIRRLEEKLE

SEQ ID NO: 620 - protein, 244 aa, Artificial Sequence
  Synthetic sequence.
DEDRIIEEIARLLEELLRELLELIKKLIETNRRLNEEHERAVRELARLLEELLDRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIAEEIERELEELRRMIKRLHEDLERKLKELEMSCAQESARLEEKIRRLEEKLE

SEQ ID NO: 621 - protein, 236 aa, Artificial Sequence
  Synthetic sequence.
DEEEKIRTTLDLLRKLLKVLREILEELIRSNKELNERLLRLVEDSDRLLEELLKKLADDGGVDEEALRRIKKRLEDLIRTNREIEERIDRESERLAEELRRILRELEKELRRLIEDLKEVLKRGLPREELLRRLKKVVEDVLRILEEVLRVVDELDKENVRLLREWLERNKEIVEEVIRILEDLIRKGGSESEEKVRDTEKKLRDLREKHAELAMSCAQESRENRRRLEELAREAK

SEQ ID NO: 622 - protein, 239 aa, Artificial Sequence
  Synthetic sequence.
DEEEKIRTTLDLLRKLLKVLREILEELIRSNKELNERLLRLVEDSDRLLEELLKKLADDGGVDEEALRRIKKRLEDLIRTNREIEERIDRESERLAEELRRILRELEKELRRLIEDLKEVLKRGLPREELLRRLKKVVEDVLRILEEVLRVVDELDKENVRLLREWLERNKEIVEEVIRILEDLIRKGGSESEEKVRDTEKKLRDLREKHAEIAKLVMSCAQESRRRLEELAREAKKVL

SEQ ID NO: 623 - protein, 243 aa, Artificial Sequence
  Synthetic sequence.
DEEEKIRTTLDLLRKLLKVLREILEELIRSNKELNERLLRLVEDSDRLLEELLKKLADDGGVDEEALRRIKKRLEDLIRTNREIEERIDRESERLAEELRRILRELEKELRRLIEDLKEVLKRGLPREELLRRLKKVVEDVLRILEEVLRVVDELDKENVRLLREWLERNKEIVEEVIRILEDLIRKGGSESEEKVRDTEKKLRDLREKHAEIAKELERLLMSCAQESEELAREAKKVLDELR

SEQ ID NO: 624 - protein, 247 aa, Artificial Sequence
  Synthetic sequence.
DEEEKIRTTLDLLRKLLKVLREILEELIRSNKELNERLLRLVEDSDRLLEELLKKLADDGGVDEEALRRIKKRLEDLIRTNREIEERIDRESERLAEELRRILRELEKELRRLIEDLKEVLKRGLPREELLRRLKKVVEDVLRILEEVLRVVDELDKENVRLLREWLERNKEIVEEVIRILEDLIRKGGSESEEKVRDTEKKLRDLREKHAEIAKELERLLRELLMSCAQESREAKKVLDELRKRLE

SEQ ID NO: 625 - protein, 236 aa, Artificial Sequence; identical to SEQ ID NO: 621
  Synthetic sequence.

SEQ ID NO: 626 - protein, 240 aa, Artificial Sequence
  Synthetic sequence.
DEEEKIRTTLDLLRKLLKVLREILEELIRSNKELNERLLRLVEDSDRLLEELLKKLADDGGVDEEALRRIKKRLEDLIRTNREIEERIDRESERLAEELRRILRELEKELRRLIEDLKEVLKRGLPREELLRRLKKVVEDVLRILEEVLRVVDELDKENVRLLREWLERNKEIVEEVIRILEDLIRKGGSESEEKVRDTEKKLRDLREKHAEIAKELEMSCAQESRRLEELAREAKKVLD

SEQ ID NO: 627 - protein, 243 aa, Artificial Sequence
  Synthetic sequence.
DEEEKIRTTLDLLRKLLKVLREILEELIRSNKELNERLLRLVEDSDRLLEELLKKLADDGGVDEEALRRIKKRLEDLIRTNREIEERIDRESERLAEELRRILRELEKELRRLIEDLKEVLKRGLPREELLRRLKKVVEDVLRILEEVLRVVDELDKENVRLLREWLERNKEIVEEVIRILEDLIRKGGSESEEKVRDTEKKLRDLREKHAEIAKELERLIMSCAQESEELAREAKKVLDELR

SEQ ID NO: 628 - protein, 247 aa, Artificial Sequence; identical to SEQ ID NO: 624
  Synthetic sequence.

SEQ ID NO: 629 - protein, 230 aa, Artificial Sequence
  Synthetic sequence.
SEKEKLLKESEEEVRRLRRTLEELLRKYREVLERLRKELREIEERVRDVVRRLKEVLDRKGLDIDTIIKEVEDLLKTVLDRLRELLDKIRRLTKEAIEVVREIIERIVRHAERVKDELRKEGGDKEKLDRVDRLIKENTRHLKEILDRIEDLVRRSEKKLRDIIREVRRLIEELRKKAEEIKKGPDERLVKTLIEDVEAVIKRILELAMSCAQESERVLERIIRELTDNL

SEQ ID NO: 630 - protein, 231 aa, Artificial Sequence
  Synthetic sequence.
SEKEKLLKESEEEVRRLRRTLEELLRKYREVLERLRKELREIEERVRDVVRRLKEVLDRKGLDIDTIIKEVEDLLKTVLDRLRELLDKIRRLTKEAIEVVREIIERIVRHAERVKDELRKEGGDKEKLDRVDRLIKENTRHLKEILDRIEDLVRRSEKKLRDIIREVRRLIEELRKKAEEIKKGPDERLVKTLIEDVEAVIKRILELLEMSCAQESRVLERIIRELTDNLE

SEQ ID NO: 631 - protein, 234 aa, Artificial Sequence
  Synthetic sequence.
SEKEKLLKESEEEVRRLRRTLEELLRKYREVLERLRKELREIEERVRDVVRRLKEVLDRKGLDIDTIIKEVEDLLKTVLDRLRELLDKIRRLTKEAIEVVREIIERIVRHAERVKDELRKEGGDKEKLDRVDRLIKENTRHLKEILDRIEDLVRRSEKKLRDIIREVRRLIEELRKKAEEIKKGPDERLVKTLIEDVEAVIKRILELITRLAMSCAQESERIIRELTDNLERHL

SEQ ID NO: 632 - protein, 237 aa, Artificial Sequence
  Synthetic sequence.
SEKEKLLKESEEEVRRLRRTLEELLRKYREVLERLRKELREIEERVRDVVRRLKEVLDRKGLDIDTIIKEVEDLLKTVLDRLRELLDKIRRLTKEAIEVVREIIERIVRHAERVKDELRKEGGDKEKLDRVDRLIKENTRHLKEILDRIEDLVRRSEKKLRDIIREVRRLIEELRKKAEEIKKGPDERLVKTLIEDVEAVIKRILELITRVAELAMSCAQESIRELTDNLERHLKIV

SEQ ID NO: 633 - protein, 238 aa, Artificial Sequence
  Synthetic sequence.
SEKEKLLKESEEEVRRLRRTLEELLRKYREVLERLRKELREIEERVRDVVRRLKEVLDRKGLDIDTIIKEVEDLLKTVLDRLRELLDKIRRLTKEAIEVVREIIERIVRHAERVKDELRKEGGDKEKLDRVDRLIKENTRHLKEILDRIEDLVRRSEKKLRDIIREVRRLIEELRKKAEEIKKGPDERLVKTLIEDVEAVIKRILELITRVAEDLWMSCAQESRELTDNLERHLKIVR

SEQ ID NO: 634 - protein, 242 aa, Artificial Sequence
  Synthetic sequence.
SEKEKLLKESEEEVRRLRRTLEELLRKYREVLERLRKELREIEERVRDVVRRLKEVLDRKGLDIDTIIKEVEDLLKTVLDRLRELLDKIRRLTKEAIEVVREIIERIVRHAERVKDELRKEGGDKEKLDRVDRLIKENTRHLKEILDRIEDLVRRSEKKLRDIIREVRRLIEELRKKAEEIKKGPDERLVKTLIEDVEAVIKRILELITRVAEDNERVLKMSCAQESDNLERHLKIVREIVK

SEQ ID NO: 635 - protein, 230 aa, Artificial Sequence; identical to SEQ ID NO: 629
  Synthetic sequence.

SEQ ID NO: 636 - protein, 231 aa, Artificial Sequence; identical to SEQ ID NO: 630
  Synthetic sequence.

SEQ ID NO: 637 - protein, 234 aa, Artificial Sequence; identical to SEQ ID NO: 631
  Synthetic sequence.

SEQ ID NO: 638 - protein, 237 aa, Artificial Sequence
  Synthetic sequence.
SEKEKLLKESEEEVRRLRRTLEELLRKYREVLERLRKELREIEERVRDVVRRLKEVLDRKGLDIDTIIKEVEDLLKTVLDRLRELLDKIRRLTKEAIEVVREIIERIVRHAERVKDELRKEGGDKEKLDRVDRLIKENTRHLKEILDRIEDLVRRSEKKLRDIIREVRRLIEELRKKAEEIKKGPDERLVKTLIEDVEAVIKRILELITRVAELVMSCAQESIRELTDNLERHLKIV

SEQ ID NO: 639 - protein, 238 aa, Artificial Sequence
  Synthetic sequence.
SEKEKLLKESEEEVRRLRRTLEELLRKYREVLERLRKELREIEERVRDVVRRLKEVLDRKGLDIDTIIKEVEDLLKTVLDRLRELLDKIRRLTKEAIEVVREIIERIVRHAERVKDELRKEGGDKEKLDRVDRLIKENTRHLKEILDRIEDLVRRSEKKLRDIIREVRRLIEELRKKAEEIKKGPDERLVKTLIEDVEAVIKRILELITRVAEDLYMSCAQESRELTDNLERHLKIVR

SEQ ID NO: 640 - protein, 242 aa, Artificial Sequence; identical to SEQ ID NO: 634
  Synthetic sequence.

SEQ ID NO: 641 - protein, 229 aa, Artificial Sequence
  Synthetic sequence.
SELERAEELIKKLLKLHEDVLRRLTEVDDELLEIHDRVLKRLKEVDDELLKLIRDMLRRGNISEDLVREVEERLKTLEKRSRDKKAENEKALRELKKKSEKLRRESRKLLEELRKKVEELRGVDKKDVEKLIKEIVEVHRAMLEKWLRLNEEIAKVHEDSVRDWLKANEEIARTIEEILRRVLRGDEEAKDIREKLERLLRKSEELVMSCAQESKELLDKSKKLLEDSK

SEQ ID NO: 642 - protein, 233 aa, Artificial Sequence
  Synthetic sequence.
SELERAEELIKKLLKLHEDVLRRLTEVDDELLEIHDRVLKRLKEVDDELLKLIRDMLRRGNISEDLVREVEERLKTLEKRSRDKKAENEKALRELKKKSEKLRRESRKLLEELRKKVEELRGVDKKDVEKLIKEIVEVHRAMLEKWLRLNEEIAKVHEDSVRDWLKANEEIARTIEEILRRVLRGDEEAKDIREKLERLLRKSEELVRKLLMSCAQESDKSKKLLEDSKRRLE

SEQ ID NO: 643 - protein, 237 aa, Artificial Sequence
  Synthetic sequence.
SELERAEELIKKLLKLHEDVLRRLTEVDDELLEIHDRVLKRLKEVDDELLKLIRDMLRRGNISEDLVREVEERLKTLEKRSRDKKAENEKALRELKKKSEKLRRESRKLLEELRKKVEELRGVDKKDVEKLIKEIVEVHRAMLEKWLRLNEEIAKVHEDSVRDWLKANEEIARTIEEILRRVLRGDEEAKDIREKLERLLRKSEELVRKSLKELKMSCAQESKLLEDSKRRLEEILK

SEQ ID NO: 644 - protein, 240 aa, Artificial Sequence
  Synthetic sequence.
SELERAEELIKKLLKLHEDVLRRLTEVDDELLEIHDRVLKRLKEVDDELLKLIRDMLRRGNISEDLVREVEERLKTLEKRSRDKKAENEKALRELKKKSEKLRRESRKLLEELRKKVEELRGVDKKDVEKLIKEIVEVHRAMLEKWLRLNEEIAKVHEDSVRDWLKANEEIARTIEEILRRVLRGDEEAKDIREKLERLLRKSEELVRKSLKELKELLMSCAQESEDSKRRLEEILKEIK

SEQ ID NO: 645 - protein, 243 aa, Artificial Sequence
  Synthetic sequence.
SELERAEELIKKLLKLHEDVLRRLTEVDDELLEIHDRVLKRLKEVDDELLKLIRDMLRRGNISEDLVREVEERLKTLEKRSRDKKAENEKALRELKKKSEKLRRESRKLLEELRKKVEELRGVDKKDVEKLIKEIVEVHRAMLEKWLRLNEEIAKVHEDSVRDWLKANEEIARTIEEILRRVLRGDEEAKDIREKLERLLRKSEELVRKSLKELKELLDLAMSCAQESKRRLEEILKEIKDDS

SEQ ID NO: 646 - protein, 233 aa, Artificial Sequence; identical to SEQ ID NO: 642
  Synthetic sequence.

SEQ ID NO: 647 - protein, 236 aa, Artificial Sequence
  Synthetic sequence.
SELERAEELIKKLLKLHEDVLRRLTEVDDELLEIHDRVLKRLKEVDDELLKLIRDMLRRGNISEDLVREVEERLKTLEKRSRDKKAENEKALRELKKKSEKLRRESRKLLEELRKKVEELRGVDKKDVEKLIKEIVEVHRAMLEKWLRLNEEIAKVHEDSVRDWLKANEEIARTIEEILRRVLRGDEEAKDIREKLERLLRKSEELVRKSLKLTMSCAQESKKLLEDSKRRLEEIL

SEQ ID NO: 648 - protein, 237 aa, Artificial Sequence; identical to SEQ ID NO: 643
  Synthetic sequence.

SEQ ID NO: 649 - protein, 240 aa, Artificial Sequence; identical to SEQ ID NO: 644
  Synthetic sequence.

SEQ ID NO: 650 - protein, 233 aa, Artificial Sequence
  Synthetic sequence.
SLKEIVKEIIDRASELLKRLLERSEDSLRTASELLRKILEDSRRSLRTIARLLEELLRTSGPEEELERAARRVKEELERLHKEIRDVIEEIKKTLAKLNEDLREAIERVKRELERLLKELEDSGVPEELLELVKRVVELMAELLDRLLALNEKILRDIMSILDEILDLNREILRLVKEIIELIRRDGPDREIEKEIRRILEELKAKHDELAMSCAQESREIKRAHEELEDRIR

SEQ ID NO: 651 - protein, 240 aa, Artificial Sequence
  Synthetic sequence.
SLKEIVKEIIDRASELLKRLLERSEDSLRTASELLRKILEDSRRSLRTIARLLEELLRTSGPEEELERAARRVKEELERLHKEIRDVIEEIKKTLAKLNEDLREAIERVKRELERLLKELEDSGVPEELLELVKRVVELMAELLDRLLALNEKILRDIMSILDEILDLNREILRLVKEIIELIRRDGPDREIEKEIRRILEELKAKHDEIEKKIRELEMSCAQESEELEDRIRKIERDLD

SEQ ID NO: 652 - protein, 244 aa, Artificial Sequence
  Synthetic sequence.
SLKEIVKEIIDRASELLKRLLERSEDSLRTASELLRKILEDSRRSLRTIARLLEELLRTSGPEEELERAARRVKEELERLHKEIRDVIEEIKKTLAKLNEDLREAIERVKRELERLLKELEDSGVPEELLELVKRVVELMAELLDRLLALNEKILRDIMSILDEILDLNREILRLVKEIIELIRRDGPDREIEKEIRRILEELKAKHDEIEKKIRELERELKMSCAQESDRIRKIERDLDRRTK

SEQ ID NO: 653 - protein, 233 aa, Artificial Sequence; identical to SEQ ID NO: 650
  Synthetic sequence.

SEQ ID NO: 654 - protein, 240 aa, Artificial Sequence; identical to SEQ ID NO: 651
  Synthetic sequence.

SEQ ID NO: 655 - protein, 244 aa, Artificial Sequence; identical to SEQ ID NO: 652
  Synthetic sequence.

SEQ ID NO: 656 - protein, 231 aa, Artificial Sequence
  Synthetic sequence.
SSEELLKRIVDEDERVLEEWARVLEEIKDLSKAVVDLLDKVLKEIEAIVDEVTRRLERDGTDDKKKIRDLVEEIKDIIRRAREKLRRIVKENEEILEEAKRRLDKIAEDNRRTLEKVRKELEETKSEREVKRILERVLREAEDSHRRAVELLEELLDRSRRTIEEAIRLIKELLDRILELLKRLGLPKDLLETIKKRVEEIRRTLEKLKMSCAQESEEIRAKLERKLEEYK

SEQ ID NO: 657 - protein, 231 aa, Artificial Sequence
  Synthetic sequence.
SSEELLKRIVDEDERVLEEWARVLEEIKDLSKAVVDLLDKVLKEIEAIVDEVTRRLERDGTDDKKKIRDLVEEIKDIIRRAREKLRRIVKENEEILEEAKRRLDKIAEDNRRTLEKVRKELEETKSEREVKRILERVLREAEDSHRRAVELLEELLDRSRRTIEEAIRLIKELLDRILELLKRLGLPKDLLETIKKRVEEIRRTLEKLHMSCAQESEEIRAKLERKLEEYK

SEQ ID NO: 658 - protein, 242 aa, Artificial Sequence
  Synthetic sequence.
SSEELLKRIVDEDERVLEEWARVLEEIKDLSKAVVDLLDKVLKEIEAIVDEVTRRLERDGTDDKKKIRDLVEEIKDIIRRAREKLRRIVKENEEILEEAKRRLDKIAEDNRRTLEKVRKELEETKSEREVKRILERVLREAEDSHRRAVELLEELLDRSRRTIEEAIRLIKELLDRILELLKRLGLPKDLLETIKKRVEEIRRTLEKIKRDYDKAIEELLMSCAQESEEYKEVIDDLRRKTK

SEQ ID NO: 659 - protein, 230 aa, Artificial Sequence
  Synthetic sequence.
DADELLRRLAEEVERVIREAEDLLRRWKETIKKVLDDLKRLLDELKKRNEDVIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKDDLEDILRKNLDRLRKLLERLRELLMSCAQESKKTLKRLEDVVREIL

SEQ ID NO: 660 - protein, 234 aa, Artificial Sequence
  Synthetic sequence.
DADELLRRLAEEVERVIREAEDLLRRWKETIKKVLDDLKRLLDELKKRNEDVIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKDDLEDILRKNLDRLRKLLERLREILRELMMSCAQESKRLEDVVREILEDLK

SEQ ID NO: 661 - protein, 223 aa, Artificial Sequence
  Synthetic sequence.
DADELLRRLAEEVERVIREAEDLLRRWKETIKKVLDDLKRLLDELKKRNEDVIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKDDLEDILRKNLDRLRKLIMSCAQESRENLEALKKTLKRLE

SEQ ID NO: 662 - protein, 226 aa, Artificial Sequence
  Synthetic sequence.
DADELLRRLAEEVERVIREAEDLLRRWKETIKKVLDDLKRLLDELKKRNEDVIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKDDLEDILRKNLDRLRKLLELVMSCAQESLEALKKTLKRLEDVV

SEQ ID NO: 663 - protein, 234 aa, Artificial Sequence
  Synthetic sequence.
DADELLRRLAEEVERVIREAEDLLRRWKETIKKVLDDLKRLLDELKKRNEDVIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKDDLEDILRKNLDRLRKLLERLREILRELLMSCAQESKRLEDVVREILEDLK

SEQ ID NO: 664 - protein, 216 aa, Artificial Sequence
  Synthetic sequence.
DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVPEEIDRELKRVVEELRRLHMSCAQESDDVARRSEEELRRII

SEQ ID NO: 665 - protein, 220 aa, Artificial Sequence
  Synthetic sequence.
DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVPEEIDRELKRVVEELRRLHEELMMSCAQESRRSEEELRRIIKKLK

SEQ ID NO: 666 - protein, 223 aa, Artificial Sequence
  Synthetic sequence.
DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVPEEIDRELKRVVEELRRLHEEIKELLMSCAQESEEELRRIIKKLKEVV

SEQ ID NO: 667 - protein, 227 aa, Artificial Sequence
  Synthetic sequence.
DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVPEEIDRELKRVVEELRRLHEEIKERLDDLGMSCAQESRRIIKKLKEVVKEIR

SEQ ID NO: 668 - protein, 231 aa, Artificial Sequence
  Synthetic sequence.
DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVPEEIDRELKRVVEELRRLHEEIKERLDDVARRLLMSCAQESKKLKEVVKEIRKKLK

SEQ ID NO: 669 - protein, 216 aa, Artificial Sequence; identical to SEQ ID NO: 664
  Synthetic sequence.

SEQ ID NO: 670 - protein, 220 aa, Artificial Sequence
  Synthetic sequence.
DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVPEEIDRELKRVVEELRRLHEELKMSCAQESRRSEEELRRIIKKLK

SEQ ID NO: 671 - protein, 223 aa, Artificial Sequence; identical to SEQ ID NO: 666
  Synthetic sequence.

SEQ ID NO: 672 - protein, 227 aa, Artificial Sequence
  Synthetic sequence.
DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVPEEIDRELKRVVEELRRLHEEIKERLDDLAMSCAQESRRIIKKLKEVVKEIR

SEQ ID NO: 673 - protein, 231 aa, Artificial Sequence; identical to SEQ ID NO: 668
  Synthetic sequence.

SEQ ID NO: 674 - protein, 224 aa, Artificial Sequence
  Synthetic sequence.
STREKAKKVLDTLRADNEDMKRVVEKILRALKRTNERAEKLAREITEEIKRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDLLRKLEEELRRIKEKLRKLLMSCAQESRELEKELDKLHDESR

SEQ ID NO: 675 - protein, 228 aa, Artificial Sequence
  Synthetic sequence.
STREKAKKVLDTLRADNEDMKRVVEKILRALKRTNERAEKLAREITEEIKRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDLLRKLEEELRRIKEKLRKALEELVMSCAQESKELDKLHDESRKEHE

SEQ ID NO: 676 - protein, 231 aa, Artificial Sequence
  Synthetic sequence.
STREKAKKVLDTLRADNEDMKRVVEKILRALKRTNERAEKLAREITEEIKRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDLLRKLEEELRRIKEKLRKALEELERLHMSCAQESDKLHDESRKEHERIE

SEQ ID NO: 677 - protein, 235 aa, Artificial Sequence
  Synthetic sequence.
STREKAKKVLDTLRADNEDMKRVVEKILRALKRTNERAEKLAREITEEIKRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDLLRKLEEELRRIKEKLRKALEELEREHRELKMSCAQESDESRKEHERIEEELR

SEQ ID NO: 678 - protein, 224 aa, Artificial Sequence; identical to SEQ ID NO: 674
  Synthetic sequence.

SEQ ID NO: 679 - protein, 228 aa, Artificial Sequence; identical to SEQ ID NO: 675
  Synthetic sequence.

SEQ ID NO: 680 - protein, 231 aa, Artificial Sequence; identical to SEQ ID NO: 676
  Synthetic sequence.

SEQ ID NO: 681 - protein, 235 aa, Artificial Sequence; identical to SEQ ID NO: 677
  Synthetic sequence.

SEQ ID NO: 682 - protein, 232 aa, Artificial Sequence
  Synthetic sequence.
SKAEKLLKDLREALEKVKRRYEELERRLDEVLKEHEEIVKRLLEELEKVLKRIEEGGLPEEELEKLKKLAEKVKELLRELLRLSKELVDRVRELLKRDLDLVRRLVEIALKVLREAREQPNDEKRVEKIKRDLEKKARRVREENERIKRDLKRTADESRKRLEKLLEDLKRELDRLREDLDRGRKDIDERVEELIERLIRIIERLLRELCMSCAQESRTIERLIEESIRVNE

SEQ ID NO: 683 - protein, 235 aa, Artificial Sequence
  Synthetic sequence.
SKAEKLLKDLREALEKVKRRYEELERRLDEVLKEHEEIVKRLLEELEKVLKRIEEGGLPEEELEKLKKLAEKVKELLRELLRLSKELVDRVRELLKRDLDLVRRLVEIALKVLREAREQPNDEKRVEKIKRDLEKKARRVREENERIKRDLKRTADESRKRLEKLLEDLKRELDRLREDLDRGRKDIDERVEELIERLIRIIERLLREVIKLHMSCAQESERLIEESIRVNEELL

SEQ ID NO: 684 - protein, 242 aa, Artificial Sequence
  Synthetic sequence.
SKAEKLLKDLREALEKVKRRYEELERRLDEVLKEHEEIVKRLLEELEKVLKRIEEGGLPEEELEKLKKLAEKVKELLRELLRLSKELVDRVRELLKRDLDLVRRLVEIALKVLREAREQPNDEKRVEKIKRDLEKKARRVREENERIKRDLKRTADESRKRLEKLLEDLKRELDRLREDLDRGRKDIDERVEELIERLIRIIERLLREVIKSHEKLVRLCMSCAQESIRVNEELLEVIERLL

SEQ ID NO: 685 - protein, 243 aa, Artificial Sequence
  Synthetic sequence.
SKAEKLLKDLREALEKVKRRYEELERRLDEVLKEHEEIVKRLLEELEKVLKRIEEGGLPEEELEKLKKLAEKVKELLRELLRLSKELVDRVRELLKRDLDLVRRLVEIALKVLREAREQPNDEKRVEKIKRDLEKKARRVREENERIKRDLKRTADESRKRLEKLLEDLKRELDRLREDLDRGRKDIDERVEELIERLIRIIERLLREVIKSHEKLVRTLEMSCAQESRVNEELLEVIERLLD

SEQ ID NO: 686 - protein, 246 aa, Artificial Sequence
  Synthetic sequence.
SKAEKLLKDLREALEKVKRRYEELERRLDEVLKEHEEIVKRLLEELEKVLKRIEEGGLPEEELEKLKKLAEKVKELLRELLRLSKELVDRVRELLKRDLDLVRRLVEIALKVLREAREQPNDEKRVEKIKRDLEKKARRVREENERIKRDLKRTADESRKRLEKLLEDLKRELDRLREDLDRGRKDIDERVEELIERLIRIIERLLREVIKSHEKLVRTIERLIMSCAQESEELLEVIERLLDRAR

SEQ ID NO: 687 - protein, 235 aa, Artificial Sequence; identical to SEQ ID NO: 683
  Synthetic sequence.

SEQ ID NO: 688 - protein, 242 aa, Artificial Sequence
  Synthetic sequence.
SKAEKLLKDLREALEKVKRRYEELERRLDEVLKEHEEIVKRLLEELEKVLKRIEEGGLPEEELEKLKKLAEKVKELLRELLRLSKELVDRVRELLKRDLDLVRRLVEIALKVLREAREQPNDEKRVEKIKRDLEKKARRVREENERIKRDLKRTADESRKRLEKLLEDLKRELDRLREDLDRGRKDIDERVEELIERLIRIIERLLREVIKSHEKLVRLIMSCAQESIRVNEELLEVIERLL

SEQ ID NO: 689 - protein, 246 aa, Artificial Sequence; identical to SEQ ID NO: 686
  Synthetic sequence.

SEQ ID NO: 690 - protein, 228 aa, Artificial Sequence
  Synthetic sequence.
DLERVVEDIVDKAKRLLDKNLEVLKRIVDEVLRLLERLLRESRKVVKRVKEIIEELVRDEKELRRVKRALEEVLRRHEEIAKELKERLRKVAKEAEEKHKKLVEDLKRVVDEVRKKLSGPLDREKVLEVLDELVTIIAKLLDENIKVLEEVIRVIAELLERLLDSHRRLIDIIAKLLEGLRPGDEDLLTELEKKLRKLKRDSEKLVMSCAQESERIKREVKRLIEENA

SEQ ID NO: 691 - protein, 232 aa, Artificial Sequence
  Synthetic sequence.
DLERVVEDIVDKAKRLLDKNLEVLKRIVDEVLRLLERLLRESRKVVKRVKEIIEELVRDEKELRRVKRALEEVLRRHEEIAKELKERLRKVAKEAEEKHKKLVEDLKRVVDEVRKKLSGPLDREKVLEVLDELVTIIAKLLDENIKVLEEVIRVIAELLERLLDSHRRLIDIIAKLLEGLRPGDEDLLTELEKKLRKLKRDSEKVVDDLKMSCAQESREVKRLIEENARTLA

SEQ ID NO: 692 - protein, 239 aa, Artificial Sequence
  Synthetic sequence.
DLERVVEDIVDKAKRLLDKNLEVLKRIVDEVLRLLERLLRESRKVVKRVKEIIEELVRDEKELRRVKRALEEVLRRHEEIAKELKERLRKVAKEAEEKHKKLVEDLKRVVDEVRKKLSGPLDREKVLEVLDELVTIIAKLLDENIKVLEEVIRVIAELLERLLDSHRRLIDIIAKLLEGLRPGDEDLLTELEKKLRKLKRDSEKVVDDLKKELERLKMSCAQESEENARTLADIKRAVD

SEQ ID NO: 693 - protein, 228 aa, Artificial Sequence; identical to SEQ ID NO: 690
  Synthetic sequence.

SEQ ID NO: 694 - protein, 232 aa, Artificial Sequence
  Synthetic sequence.
DLERVVEDIVDKAKRLLDKNLEVLKRIVDEVLRLLERLLRESRKVVKRVKEIIEELVRDEKELRRVKRALEEVLRRHEEIAKELKERLRKVAKEAEEKHKKLVEDLKRVVDEVRKKLSGPLDREKVLEVLDELVTIIAKLLDENIKVLEEVIRVIAELLERLLDSHRRLIDIIAKLLEGLRPGDEDLLTELEKKLRKLKRDSEKVVDDLRMSCAQESREVKRLIEENARTLA

SEQ ID NO: 695 - protein, 234 aa, Artificial Sequence
  Synthetic sequence.
SERELIERWLELHKEILRLIRELVERLLKLHREILDTIKKLIRELLELLEDIARKLGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERTDDERRTLTELLKRMEDILEKVERTLKKLLDLAMSCAQESKKTLKELLERSEKVA

SEQ ID NO: 696 - protein, 235 aa, Artificial Sequence
  Synthetic sequence.
SERELIERWLELHKEILRLIRELVERLLKLHREILDTIKKLIRELLELLEDIARKLGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERTDDERRTLTELLKRMEDILEKVERTLKKLLDDLLMSCAQESKTLKELLERSEKVAE

SEQ ID NO: 697 - protein, 238 aa, Artificial Sequence
  Synthetic sequence.
SERELIERWLELHKEILRLIRELVERLLKLHREILDTIKKLIRELLELLEDIARKLGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERTDDERRTLTELLKRMEDILEKVERTLKKLLDDSARLAMSCAQESKELLERSEKVAEDVR

SEQ ID NO: 698 - protein, 224 aa, Artificial Sequence
  Synthetic sequence.
SERELIERWLELHKEILRLIRELVERLLKLHREILDTIKKLIRELLELLEDIARKLGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERTDDERRTLTELLKRMEDILEKLEMSCAQESDDSARMAEEVKKTLK

SEQ ID NO: 699 - protein, 227 aa, Artificial Sequence
  Synthetic sequence.
SERELIERWLELHKEILRLIRELVERLLKLHREILDTIKKLIRELLELLEDIARKLGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERTDDERRTLTELLKRMEDILEKVERLLMSCAQESARMAEEVKKTLKELL

SEQ ID NO: 700 - protein, 231 aa, Artificial Sequence
  Synthetic sequence.
SERELIERWLELHKEILRLIRELVERLLKLHREILDTIKKLIRELLELLEDIARKLGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERTDDERRTLTELLKRMEDILEKVERTLKKLLMSCAQESEEVKKTLKELLERSE

SEQ ID NO: 701 - protein, 234 aa, Artificial Sequence; identical to SEQ ID NO: 695
  Synthetic sequence.

SEQ ID NO: 702 - protein, 235 aa, Artificial Sequence
  Synthetic sequence.
SERELIERWLELHKEILRLIRELVERLLKLHREILDTIKKLIRELLELLEDIARKLGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERTDDERRTLTELLKRMEDILEKVERTLKKLLDDLKMSCAQESKTLKELLERSEKVAE

SEQ ID NO: 703 - protein, 238 aa, Artificial Sequence; identical to SEQ ID NO: 697
  Synthetic sequence.

SEQ ID NO: 704 - protein, 229 aa, Artificial Sequence
  Synthetic sequence.
KKEEDLRREVEEVKEEIRELIERSRESVRRILKEIKDLIRKSKESIDKILEDLKRKNLDETLIRAVEKLLRENLELLKKLLETVKELLERNEELLKRLVEEAERILEELLEVARRSGDEKALERVVREVEKELKRLDDELKKALKDSEEELKRLEDELRRAKEENEKTLKKLRDDLRREGRDEEVLRVVEELLKLLKEHLEENVRLAMSCAQESRRHHDTNRKIVKRIL

SEQ ID NO: 705 - protein, 230 aa, Artificial Sequence
  Synthetic sequence.
KKEEDLRREVEEVKEEIRELIERSRESVRRILKEIKDLIRKSKESIDKILEDLKRKNLDETLIRAVEKLLRENLELLKKLLETVKELLERNEELLKRLVEEAERILEELLEVARRSGDEKALERVVREVEKELKRLDDELKKALKDSEEELKRLEDELRRAKEENEKTLKKLRDDLRREGRDEEVLRVVEELLKLLKEHLEENVRILRMSCAQESRHHDTNRKIVKRILE

SEQ ID NO: 706 - protein, 237 aa, Artificial Sequence
  Synthetic sequence.
KKEEDLRREVEEVKEEIRELIERSRESVRRILKEIKDLIRKSKESIDKILEDLKRKNLDETLIRAVEKLLRENLELLKKLLETVKELLERNEELLKRLVEEAERILEELLEVARRSGDEKALERVVREVEKELKRLDDELKKALKDSEEELKRLEDELRRAKEENEKTLKKLRDDLRREGRDEEVLRVVEELLKLLKEHLEENVRILRRILELLRMSCAQESKIVKRILELLRRVLE

SEQ ID NO: 707 - protein, 239 aa, Artificial Sequence
  Synthetic sequence.
KKEEDLRREVEEVKEEIRELIERSRESVRRILKEIKDLIRKSKESIDKILEDLKRKNLDETLIRAVEKLLRENLELLKKLLETVKELLERNEELLKRLVEEAERILEELLEVARRSGDEKALERVVREVEKELKRLDDELKKALKDSEEELKRLEDELRRAKEENEKTLKKLRDDLRREGRDEEVLRVVEELLKLLKEHLEENVRILRRILELLRLHMSCAQESVKRILELLRRVLESI

SEQ ID NO: 708 - protein, 240 aa, Artificial Sequence
  Synthetic sequence.
KKEEDLRREVEEVKEEIRELIERSRESVRRILKEIKDLIRKSKESIDKILEDLKRKNLDETLIRAVEKLLRENLELLKKLLETVKELLERNEELLKRLVEEAERILEELLEVARRSGDEKALERVVREVEKELKRLDDELKKALKDSEEELKRLEDELRRAKEENEKTLKKLRDDLRREGRDEEVLRVVEELLKLLKEHLEENVRILRRILELLRRLGMSCAQESKRILELLRRVLESIR

SEQ ID NO: 709 - protein, 229 aa, Artificial Sequence
  Synthetic sequence.
KKEEDLRREVEEVKEEIRELIERSRESVRRILKEIKDLIRKSKESIDKILEDLKRKNLDETLIRAVEKLLRENLELLKKLLETVKELLERNEELLKRLVEEAERILEELLEVARRSGDEKALERVVREVEKELKRLDDELKKALKDSEEELKRLEDELRRAKEENEKTLKKLRDDLRREGRDEEVLRVVEELLKLLKEHLEENVRLVMSCAQESRRHHDTNRKIVKRIL

SEQ ID NO: 710 - protein, 237 aa, Artificial Sequence; identical to SEQ ID NO: 706
  Synthetic sequence.

SEQ ID NO: 711 - protein, 239 aa, Artificial Sequence; identical to SEQ ID NO: 707
  Synthetic sequence.

SEQ ID NO: 712 - protein, 240 aa, Artificial Sequence
  Synthetic sequence.
KKEEDLRREVEEVKEEIRELIERSRESVRRILKEIKDLIRKSKESIDKILEDLKRKNLDETLIRAVEKLLRENLELLKKLLETVKELLERNEELLKRLVEEAERILEELLEVARRSGDEKALERVVREVEKELKRLDDELKKALKDSEEELKRLEDELRRAKEENEKTLKKLRDDLRREGRDEEVLRVVEELLKLLKEHLEENVRILRRILELLRRLHMSCAQESKRILELLRRVLESIR

SEQ ID NO: 713 - protein, 226 aa, Artificial Sequence
  Synthetic sequence.
SKKELLEEVVRRAIELLKRHLEKLKRILEEIVRLLEEHLEKVERVLEAILSLLDDLLRRGGDERAIRTLEDVKRRLREILERLADENAKAIKRLADLLDKLEKRNKEAIERLEEILEELKRVRRDEELLRVLETLLKIIEDILRENTKVLEDLLRLVEEILEANLRVVEELLRLAREILTEIVGDEDKLKEIEDELRRLLEELQMSCAQESDRLRELKKDLDEANR

SEQ ID NO: 714 - protein, 229 aa, Artificial Sequence
  Synthetic sequence.
SKKELLEEVVRRAIELLKRHLEKLKRILEEIVRLLEEHLEKVERVLEAILSLLDDLLRRGGDERAIRTLEDVKRRLREILERLADENAKAIKRLADLLDKLEKRNKEAIERLEEILEELKRVRRDEELLRVLETLLKIIEDILRENTKVLEDLLRLVEEILEANLRVVEELLRLAREILTEIVGDEDKLKEIEDELRRLLEELRRLVMSCAQESRELKKDLDEANRRIK

SEQ ID NO: 715 - protein, 233 aa, Artificial Sequence
  Synthetic sequence.
SKKELLEEVVRRAIELLKRHLEKLKRILEEIVRLLEEHLEKVERVLEAILSLLDDLLRRGGDERAIRTLEDVKRRLREILERLADENAKAIKRLADLLDKLEKRNKEAIERLEEILEELKRVRRDEELLRVLETLLKIIEDILRENTKVLEDLLRLVEEILEANLRVVEELLRLAREILTEIVGDEDKLKEIEDELRRLLEELRRLDKALKMSCAQESKDLDEANRRIKETLK

SEQ ID NO: 716 - protein, 240 aa, Artificial Sequence
  Synthetic sequence.
SKKELLEEVVRRAIELLKRHLEKLKRILEEIVRLLEEHLEKVERVLEAILSLLDDLLRRGGDERAIRTLEDVKRRLREILERLADENAKAIKRLADLLDKLEKRNKEAIERLEEILEELKRVRRDEELLRVLETLLKIIEDILRENTKVLEDLLRLVEEILEANLRVVEELLRLAREILTEIVGDEDKLKEIEDELRRLLEELRRLDKAIKDRLRELYMSCAQESRRIKETLKKLLREVE

SEQ ID NO: 717 - protein, 233 aa, Artificial Sequence; identical to SEQ ID NO: 715
  Synthetic sequence.

SEQ ID NO: 718 - protein, 240 aa, Artificial Sequence
  Synthetic sequence.
SKKELLEEVVRRAIELLKRHLEKLKRILEEIVRLLEEHLEKVERVLEAILSLLDDLLRRGGDERAIRTLEDVKRRLREILERLADENAKAIKRLADLLDKLEKRNKEAIERLEEILEELKRVRRDEELLRVLETLLKIIEDILRENTKVLEDLLRLVEEILEANLRVVEELLRLAREILTEIVGDEDKLKEIEDELRRLLEELRRLDKAIKDRLRELKMSCAQESRRIKETLKKLLREVE

SEQ ID NO: 719 - protein, 226 aa, Artificial Sequence
  Synthetic sequence.
SKEELVKEIDELNKRVNDLLEELLRKSEKLHKEILELLERLLREIISLLRRILEIVERRLEDETLKRVLEKLEETLRRLKKKVDEELKRLEDENRRLKEEMDRLLRKSAEELERLREKVVRDGGSGDEVLARLLELHTEDLKHAREVLDEVLRLNKKALDLIRAILTEVLKLIKELLKLIEAGADEDELRRLLEDIERKIEALLMSCAQESEEIRKRIRELLEDNR

SEQ ID NO: 720 - protein, 237 aa, Artificial Sequence
  Synthetic sequence.
SKEELVKEIDELNKRVNDLLEELLRKSEKLHKEILELLERLLREIISLLRRILEIVERRLEDETLKRVLEKLEETLRRLKKKVDEELKRLEDENRRLKEEMDRLLRKSAEELERLREKVVRDGGSGDEVLARLLELHTEDLKHAREVLDEVLRLNKKALDLIRAILTEVLKLIKELLKLIEAGADEDELRRLLEDIERKIEALLRELKKESEELLMSCAQESEDNRDKSRKIKKAIE

SEQ ID NO: 721 - protein, 241 aa, Artificial Sequence
  Synthetic sequence.
SKEELVKEIDELNKRVNDLLEELLRKSEKLHKEILELLERLLREIISLLRRILEIVERRLEDETLKRVLEKLEETLRRLKKKVDEELKRLEDENRRLKEEMDRLLRKSAEELERLREKVVRDGGSGDEVLARLLELHTEDLKHAREVLDEVLRLNKKALDLIRAILTEVLKLIKELLKLIEAGADEDELRRLLEDIERKIEALLRELKKESEEIRKRLKMSCAQESDKSRKIKKAIEELKK

SEQ ID NO: 722 - protein, 233 aa, Artificial Sequence
  Synthetic sequence.
SKEELVKEIDELNKRVNDLLEELLRKSEKLHKEILELLERLLREIISLLRRILEIVERRLEDETLKRVLEKLEETLRRLKKKVDEELKRLEDENRRLKEEMDRLLRKSAEELERLREKVVRDGGSGDEVLARLLELHTEDLKHAREVLDEVLRLNKKALDLIRAILTEVLKLIKELLKLIEAGADEDELRRLLEDIERKIEALLRELKKLAMSCAQESRELLEDNRDKSRKIK

SEQ ID NO: 723 - protein, 237 aa, Artificial Sequence; identical to SEQ ID NO: 720
  Synthetic sequence.

SEQ ID NO: 724 - protein, 241 aa, Artificial Sequence; identical to SEQ ID NO: 721
  Synthetic sequence.

SEQ ID NO: 725 - protein, 231 aa, Artificial Sequence
  Synthetic sequence.
KEIEETLKELEDLNREMVETNRRVLEETRRLNKETVDRVKATLDELAKMLKKLVDDVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTTGGDKAVEELEKALEEIKRRLTMSCAQESDELRKLRKEYKEKID

SEQ ID NO: 726 - protein, 231 aa, Artificial Sequence
  Synthetic sequence.
KEIEETLKELEDLNREMVETNRRVLEETRRLNKETVDRVKATLDELAKMLKKLVDDVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTTGGDKAVEELEKALEEIKRRLEMSCAQESDELRKLRKEYKEKID

SEQ ID NO: 727 - protein, 245 aa, Artificial Sequence
  Synthetic sequence.
KEIEETLKELEDLNREMVETNRRVLEETRRLNKETVDRVKATLDELAKMLKKLVDDVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTTGGDKAVEELEKALEEIKRRLKEVIDRYEDELRKLMMSCAQESDKYERKLEEIERRER

SEQ ID NO: 728 - protein, 216 aa, Artificial Sequence
  Synthetic sequence.
SKEEEVEKVLRKWEEILRRLIEENKRANDKIRREYEELVKEIRRVLEEIKEVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDVVRALIEVIERLLRVLAMSCAQESKVNTELMRVDERSIR

SEQ ID NO: 729 - protein, 220 aa, Artificial Sequence
  Synthetic sequence.
SKEEEVEKVLRKWEEILRRLIEENKRANDKIRREYEELVKEIRRVLEEIKEVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDVVRALIEVIERLLRVAEEVLRMSCAQESELMRVDERSIRESLK

SEQ ID NO: 730 - protein, 223 aa, Artificial Sequence
  Synthetic sequence.
SKEEEVEKVLRKWEEILRRLIEENKRANDKIRREYEELVKEIRRVLEEIKEVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDVVRALIEVIERLLRVAEEVIRRLIMSCAQESRVDERSIRESLKAIS

SEQ ID NO: 731 - protein, 226 aa, Artificial Sequence
  Synthetic sequence.
SKEEEVEKVLRKWEEILRRLIEENKRANDKIRREYEELVKEIRRVLEEIKEVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDVVRALIEVIERLLRVAEEVIRRILKLVMSCAQESERSIRESLKAISEVL

SEQ ID NO: 732 - protein, 229 aa, Artificial Sequence
  Synthetic sequence.
SKEEEVEKVLRKWEEILRRLIEENKRANDKIRREYEELVKEIRRVLEEIKEVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDVVRALIEVIERLLRVAEEVIRRILKVNTLAMSCAQESIRESLKAISEVLKVL

SEQ ID NO: 733 - protein, 216 aa, Artificial Sequence
  Synthetic sequence.
SKEEEVEKVLRKWEEILRRLIEENKRANDKIRREYEELVKEIRRVLEEIKEVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDVVRALIEVIERLLRVLIMSCAQESKVNTELMRVDERSIR

SEQ ID NO: 734 - protein, 220 aa, Artificial Sequence; identical to SEQ ID NO: 729
  Synthetic sequence.

SEQ ID NO: 735 - protein, 223 aa, Artificial Sequence; identical to SEQ ID NO: 730
  Synthetic sequence.

SEQ ID NO: 736 - protein, 226 aa, Artificial Sequence; identical to SEQ ID NO: 731
  Synthetic sequence.

SEQ ID NO: 737 - protein, 229 aa, Artificial Sequence; identical to SEQ ID NO: 732
  Synthetic sequence.

SEQ ID NO: 738 - protein, 230 aa, Artificial Sequence
  Synthetic sequence.
DEDELIRKLLEDLKDIVRKILELIERDLRDIERVVRRIVKVIRDDLKKIKEVVDDIARGVPRTEELERVIKRIEELLRTSEEELDRILKEIEELLRESRRRLEEVVSAVEELLRRVEEIVDKGRESKEDVIKLLREVVDDILRLVEEVVRTNLEIIKRILELIERVIRLNLSIIRDILRLLEGTVDSELADRIRKLIEDLERHTAKLLMSCAQESTELRKNSKDILEEVR

SEQ ID NO: 739 - protein, 237 aa, Artificial Sequence
  Synthetic sequence.
DEDELIRKLLEDLKDIVRKILELIERDLRDIERVVRRIVKVIRDDLKKIKEVVDDIARGVPRTEELERVIKRIEELLRTSEEELDRILKEIEELLRESRRRLEEVVSAVEELLRRVEEIVDKGRESKEDVIKLLREVVDDILRLVEEVVRTNLEIIKRILELIERVIRLNLSIIRDILRLLEGTVDSELADRIRKLIEDLERHTAKVLEDVKRLMMSCAQESKDILEEVRKLIDELR

SEQ ID NO: 740 - protein, 238 aa, Artificial Sequence
  Synthetic sequence.
DEDELIRKLLEDLKDIVRKILELIERDLRDIERVVRRIVKVIRDDLKKIKEVVDDIARGVPRTEELERVIKRIEELLRTSEEELDRILKEIEELLRESRRRLEEVVSAVEELLRRVEEIVDKGRESKEDVIKLLREVVDDILRLVEEVVRTNLEIIKRILELIERVIRLNLSIIRDILRLLEGTVDSELADRIRKLIEDLERHTAKVLEDVKRALSMSCAQESDILEEVRKLIDELRK

SEQ ID NO: 741 - protein, 241 aa, Artificial Sequence
  Synthetic sequence.
DEDELIRKLLEDLKDIVRKILELIERDLRDIERVVRRIVKVIRDDLKKIKEVVDDIARGVPRTEELERVIKRIEELLRTSEEELDRILKEIEELLRESRRRLEEVVSAVEELLRRVEEIVDKGRESKEDVIKLLREVVDDILRLVEEVVRTNLEIIKRILELIERVIRLNLSIIRDILRLLEGTVDSELADRIRKLIEDLERHTAKVLEDVKRAITELAMSCAQESEEVRKLIDELRKRIK

SEQ ID NO: 742 - protein, 244 aa, Artificial Sequence
  Synthetic sequence.
DEDELIRKLLEDLKDIVRKILELIERDLRDIERVVRRIVKVIRDDLKKIKEVVDDIARGVPRTEELERVIKRIEELLRTSEEELDRILKEIEELLRESRRRLEEVVSAVEELLRRVEEIVDKGRESKEDVIKLLREVVDDILRLVEEVVRTNLEIIKRILELIERVIRLNLSIIRDILRLLEGTVDSELADRIRKLIEDLERHTAKVLEDVKRAITELRKLAMSCAQESRKLIDELRKRIKEVE

SEQ ID NO: 743 - protein, 230 aa, Artificial Sequence; identical to SEQ ID NO: 738
  Synthetic sequence.

SEQ ID NO: 744 - protein, 237 aa, Artificial Sequence
  Synthetic sequence.
DEDELIRKLLEDLKDIVRKILELIERDLRDIERVVRRIVKVIRDDLKKIKEVVDDIARGVPRTEELERVIKRIEELLRTSEEELDRILKEIEELLRESRRRLEEVVSAVEELLRRVEEIVDKGRESKEDVIKLLREVVDDILRLVEEVVRTNLEIIKRILELIERVIRLNLSIIRDILRLLEGTVDSELADRIRKLIEDLERHTAKVLEDVKRLIMSCAQESKDILEEVRKLIDELR

SEQ ID NO: 745 - protein, 241 aa, Artificial Sequence
  Synthetic sequence.
DEDELIRKLLEDLKDIVRKILELIERDLRDIERVVRRIVKVIRDDLKKIKEVVDDIARGVPRTEELERVIKRIEELLRTSEEELDRILKEIEELLRESRRRLEEVVSAVEELLRRVEEIVDKGRESKEDVIKLLREVVDDILRLVEEVVRTNLEIIKRILELIERVIRLNLSIIRDILRLLEGTVDSELADRIRKLIEDLERHTAKVLEDVKRAITELLMSCAQESEEVRKLIDELRKRIK

SEQ ID NO: 746 - protein, 232 aa, Artificial Sequence
  Synthetic sequence.
RDRDVLRKVKAEIEELVARIEKVSRDALSEVKRLLDENRKIAEDVLRLIESLLRKIRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSEEVVEELLRMLKRVAEEMKRLHMSCAQESEKVVRDVVRVDKELL

SEQ ID NO: 747 - protein, 233 aa, Artificial Sequence
  Synthetic sequence.
RDRDVLRKVKAEIEELVARIEKVSRDALSEVKRLLDENRKIAEDVLRLIESLLRKIRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSEEVVEELLRMLKRVAEEMKRVLDMSCAQESKVVRDVVRVDKELLD

SEQ ID NO: 748 - protein, 243 aa, Artificial Sequence
  Synthetic sequence.
RDRDVLRKVKAEIEELVARIEKVSRDALSEVKRLLDENRKIAEDVLRLIESLLRKIRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSEEVVEELLRMLKRVAEEMKRVHDDLSRAVEKLAMSCAQESKELLDELARILRRLE

SEQ ID NO: 749 - protein, 244 aa, Artificial Sequence
  Synthetic sequence.
RDRDVLRKVKAEIEELVARIEKVSRDALSEVKRLLDENRKIAEDVLRLIESLLRKIRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSEEVVEELLRMLKRVAEEMKRVHDDLSRAVEKVLRMSCAQESELLDELARILRRLEE

SEQ ID NO: 750 - protein, 247 aa, Artificial Sequence
  Synthetic sequence.
RDRDVLRKVKAEIEELVARIEKVSRDALSEVKRLLDENRKIAEDVLRLIESLLRKIRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSEEVVEELLRMLKRVAEEMKRVHDDLSRAVEKVVRDLVMSCAQESDELARILRRLEEVIT

SEQ ID NO: 751 - protein, 232 aa, Artificial Sequence; identical to SEQ ID NO: 746
  Synthetic sequence.

SEQ ID NO: 752 - protein, 233 aa, Artificial Sequence; identical to SEQ ID NO: 747
  Synthetic sequence.

SEQ ID NO: 753 - protein, 243 aa, Artificial Sequence
  Synthetic sequence.
RDRDVLRKVKAEIEELVARIEKVSRDALSEVKRLLDENRKIAEDVLRLIESLLRKIRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSEEVVEELLRMLKRVAEEMKRVHDDLSRAVEKLVMSCAQESKELLDELARILRRLE

SEQ ID NO: 754 - protein, 244 aa, Artificial Sequence; identical to SEQ ID NO: 749
  Synthetic sequence.

SEQ ID NO: 755 - protein, 246 aa, Artificial Sequence
  Synthetic sequence.
RDRDVLRKVKAEIEELVARIEKVSRDALSEVKRLLDENRKIAEDVLRLIESLLRKIRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSEEVVEELLRMLKRVAEEMKRVHDDLSRAVEKVVRLGMSCAQESLDELARILRRLEEVI

SEQ ID NO: 756 - protein, 247 aa, Artificial Sequence; identical to SEQ ID NO: 750
  Synthetic sequence.

SEQ ID NO: 757 - protein, 216 aa, Artificial Sequence
  Synthetic sequence.
SKDEELARLLEELVERWRKIVEDLERDHRRLVKEIRELVERIRKKLEELVDRIRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRRILEELKRIVDDVLRLAMSCAQESRDLTRRLAEVAKAVH

SEQ ID NO: 758 - protein, 224 aa, Artificial Sequence
  Synthetic sequence.
SKDEELARLLEELVERWRKIVEDLERDHRRLVKEIRELVERIRKKLEELVDRIRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRRILEELKRIVDDVLRIIARILKLLRMSCAQESEVAKAVHKLLEELLR

SEQ ID NO: 759 - protein, 216 aa, Artificial Sequence; identical to SEQ ID NO: 757
  Synthetic sequence.

SEQ ID NO: 760 - protein, 217 aa, Artificial Sequence
  Synthetic sequence.
SKDEELARLLEELVERWRKIVEDLERDHRRLVKEIRELVERIRKKLEELVDRIRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRRILEELKRIVDDVLRILAMSCAQESDLTRRLAEVAKAVHK

SEQ ID NO: 761 - protein, 220 aa, Artificial Sequence
  Synthetic sequence.
SKDEELARLLEELVERWRKIVEDLERDHRRLVKEIRELVERIRKKLEELVDRIRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRRILEELKRIVDDVLRIIARLLMSCAQESRRLAEVAKAVHKLLE

SEQ ID NO: 762 - protein, 220 aa, Artificial Sequence
  Synthetic sequence.
SAAETVKRLAEESSERIRKIVEDDKRVADDSSRKIKELIEEIKRRVKELLDRIKGLGSTEDLEKLLDELLKEVKRLLEELLDAHAKWSDDSRRLLEAVLRTHKELIDRLIKLLRDGGKPEEAVRRLEKVLRESLRRVKEVIKELIDLNKETLDRLKKIVEDLERVLREVLTELRRGSDSKEAVIRLIEELVKLLEDLLMSCAQESETLVELNKRVWDRLV

SEQ ID NO: 763 - protein, 223 aa, Artificial Sequence
  Synthetic sequence.
SAAETVKRLAEESSERIRKIVEDDKRVADDSSRKIKELIEEIKRRVKELLDRIKGLGSTEDLEKLLDELLKEVKRLLEELLDAHAKWSDDSRRLLEAVLRTHKELIDRLIKLLRDGGKPEEAVRRLEKVLRESLRRVKEVIKELIDLNKETLDRLKKIVEDLERVLREVLTELRRGSDSKEAVIRLIEELVKLLEDVLRLAMSCAQESVELNKRVWDRLVRIN

SEQ ID NO: 764 - protein, 224 aa, Artificial Sequence
  Synthetic sequence.
SAAETVKRLAEESSERIRKIVEDDKRVADDSSRKIKELIEEIKRRVKELLDRIKGLGSTEDLEKLLDELLKEVKRLLEELLDAHAKWSDDSRRLLEAVLRTHKELIDRLIKLLRDGGKPEEAVRRLEKVLRESLRRVKEVIKELIDLNKETLDRLKKIVEDLERVLREVLTELRRGSDSKEAVIRLIEELVKLLEDVLRRLLMSCAQESELNKRVWDRLVRINE

SEQ ID NO: 765 - protein, 231 aa, Artificial Sequence
  Synthetic sequence.
SAAETVKRLAEESSERIRKIVEDDKRVADDSSRKIKELIEEIKRRVKELLDRIKGLGSTEDLEKLLDELLKEVKRLLEELLDAHAKWSDDSRRLLEAVLRTHKELIDRLIKLLRDGGKPEEAVRRLEKVLRESLRRVKEVIKELIDLNKETLDRLKKIVEDLERVLREVLTELRRGSDSKEAVIRLIEELVKLLEDVLRRLLEVNETLVMSCAQESDRLVRINEELAEVAL

SEQ ID NO: 766 - protein, 220 aa, Artificial Sequence
  Synthetic sequence.
SAAETVKRLAEESSERIRKIVEDDKRVADDSSRKIKELIEEIKRRVKELLDRIKGLGSTEDLEKLLDELLKEVKRLLEELLDAHAKWSDDSRRLLEAVLRTHKELIDRLIKLLRDGGKPEEAVRRLEKVLRESLRRVKEVIKELIDLNKETLDRLKKIVEDLERVLREVLTELRRGSDSKEAVIRLIEELVKLLEDLAMSCAQESETLVELNKRVWDRLV

SEQ ID NO: 767 - protein, 221 aa, Artificial Sequence
  Synthetic sequence.
SAAETVKRLAEESSERIRKIVEDDKRVADDSSRKIKELIEEIKRRVKELLDRIKGLGSTEDLEKLLDELLKEVKRLLEELLDAHAKWSDDSRRLLEAVLRTHKELIDRLIKLLRDGGKPEEAVRRLEKVLRESLRRVKEVIKELIDLNKETLDRLKKIVEDLERVLREVLTELRRGSDSKEAVIRLIEELVKLLEDVLAMSCAQESTLVELNKRVWDRLVR

SEQ ID NO: 768 - protein, 223 aa, Artificial Sequence
  Synthetic sequence.
SAAETVKRLAEESSERIRKIVEDDKRVADDSSRKIKELIEEIKRRVKELLDRIKGLGSTEDLEKLLDELLKEVKRLLEELLDAHAKWSDDSRRLLEAVLRTHKELIDRLIKLLRDGGKPEEAVRRLEKVLRESLRRVKEVIKELIDLNKETLDRLKKIVEDLERVLREVLTELRRGSDSKEAVIRLIEELVKLLEDVLRLLMSCAQESVELNKRVWDRLVRIN

SEQ ID NO: 769 - protein, 224 aa, Artificial Sequence; identical to SEQ ID NO: 764
  Synthetic sequence.

SEQ ID NO: 770 - protein, 225 aa, Artificial Sequence
  Synthetic sequence.
SAAETVKRLAEESSERIRKIVEDDKRVADDSSRKIKELIEEIKRRVKELLDRIKGLGSTEDLEKLLDELLKEVKRLLEELLDAHAKWSDDSRRLLEAVLRTHKELIDRLIKLLRDGGKPEEAVRRLEKVLRESLRRVKEVIKELIDLNKETLDRLKKIVEDLERVLREVLTELRRGSDSKEAVIRLIEELVKLLEDVLRRLLEMSCAQESLNKRVWDRLVRINEE

SEQ ID NO: 771 - protein, 220 aa, Artificial Sequence
  Synthetic sequence.
SALETVKKLLEDSSEKIERIVEEDERVAKESSDRIRRLVEEDKRVADEILDLIEKIGDTDTLLKLVEEWSRTSKKLLDDVLKLHKDWSDDSRRLLEEILRVHEELIRRVKEILDREGKPEEVVRELEKVLKESLDTLEEIIRRLDEANAATVKRVADVIRELEDINRKVLEEIKRGSDDAEAVIKVIEKLIRANKRLWMSCAQESEDLVRVNKTVWKELL

SEQ ID NO: 772 - protein, 223 aa, Artificial Sequence
  Synthetic sequence.
SALETVKKLLEDSSEKIERIVEEDERVAKESSDRIRRLVEEDKRVADEILDLIEKIGDTDTLLKLVEEWSRTSKKLLDDVLKLHKDWSDDSRRLLEEILRVHEELIRRVKEILDREGKPEEVVRELEKVLKESLDTLEEIIRRLDEANAATVKRVADVIRELEDINRKVLEEIKRGSDDAEAVIKVIEKLIRANKRVWDLLMSCAQESVRVNKTVWKELLRVN

SEQ ID NO: 773 - protein, 224 aa, Artificial Sequence
  Synthetic sequence.
SALETVKKLLEDSSEKIERIVEEDERVAKESSDRIRRLVEEDKRVADEILDLIEKIGDTDTLLKLVEEWSRTSKKLLDDVLKLHKDWSDDSRRLLEEILRVHEELIRRVKEILDREGKPEEVVRELEKVLKESLDTLEEIIRRLDEANAATVKRVADVIRELEDINRKVLEEIKRGSDDAEAVIKVIEKLIRANKRVWDALLMSCAQESRVNKTVWKELLRVNE

SEQ ID NO: 774 - protein, 220 aa, Artificial Sequence; identical to SEQ ID NO: 771
  Synthetic sequence.

SEQ ID NO: 775 - protein, 221 aa, Artificial Sequence
  Synthetic sequence.
SALETVKKLLEDSSEKIERIVEEDERVAKESSDRIRRLVEEDKRVADEILDLIEKIGDTDTLLKLVEEWSRTSKKLLDDVLKLHKDWSDDSRRLLEEILRVHEELIRRVKEILDREGKPEEVVRELEKVLKESLDTLEEIIRRLDEANAATVKRVADVIRELEDINRKVLEEIKRGSDDAEAVIKVIEKLIRANKRVLDMSCAQESDLVRVNKTVWKELLR

SEQ ID NO: 776 - protein, 223 aa, Artificial Sequence; identical to SEQ ID NO: 772
  Synthetic sequence.

SEQ ID NO: 777 - protein, 224 aa, Artificial Sequence; identical to SEQ ID NO: 773
  Synthetic sequence.

SEQ ID NO: 778 - protein, 227 aa, Artificial Sequence
  Synthetic sequence.
DEIETVLKRLAELIKESLDLLRETLDELRKIIEESKKSLEDVLRRLKELIDRLRRLAKEGGSEELLRLLIEVIERLLKVVEDLLRESNRVVERLIRVNREALRLSNRVVADLLKVLKDAGPDSEELRKLAEDVLRENAELSRESVKIAEKMLEENRDLTRRLKELAKKVLEEIRDLVRGVRDADELLRRVEEILKRLLELIRRLIMSCAQESERLLETHEDLIRKHE

SEQ ID NO: 779 - protein, 230 aa, Artificial Sequence
  Synthetic sequence.
DEIETVLKRLAELIKESLDLLRETLDELRKIIEESKKSLEDVLRRLKELIDRLRRLAKEGGSEELLRLLIEVIERLLKVVEDLLRESNRVVERLIRVNREALRLSNRVVADLLKVLKDAGPDSEELRKLAEDVLRENAELSRESVKIAEKMLEENRDLTRRLKELAKKVLEEIRDLVRGVRDADELLRRVEEILKRLLELIRRIIELHMSCAQESLETHEDLIRKHEEIL

SEQ ID NO: 780 - protein, 234 aa, Artificial Sequence
  Synthetic sequence.
DEIETVLKRLAELIKESLDLLRETLDELRKIIEESKKSLEDVLRRLKELIDRLRRLAKEGGSEELLRLLIEVIERLLKVVEDLLRESNRVVERLIRVNREALRLSNRVVADLLKVLKDAGPDSEELRKLAEDVLRENAELSRESVKIAEKMLEENRDLTRRLKELAKKVLEEIRDLVRGVRDADELLRRVEEILKRLLELIRRIIEEHRKLNMSCAQESEDLIRKHEEILRRLL

SEQ ID NO: 781 - protein, 237 aa, Artificial Sequence
  Synthetic sequence.
DEIETVLKRLAELIKESLDLLRETLDELRKIIEESKKSLEDVLRRLKELIDRLRRLAKEGGSEELLRLLIEVIERLLKVVEDLLRESNRVVERLIRVNREALRLSNRVVADLLKVLKDAGPDSEELRKLAEDVLRENAELSRESVKIAEKMLEENRDLTRRLKELAKKVLEEIRDLVRGVRDADELLRRVEEILKRLLELIRRIIEEHRKILELLMSCAQESIRKHEEILRRLLKAA

SEQ ID NO: 782 - protein, 238 aa, Artificial Sequence
  Synthetic sequence.
DEIETVLKRLAELIKESLDLLRETLDELRKIIEESKKSLEDVLRRLKELIDRLRRLAKEGGSEELLRLLIEVIERLLKVVEDLLRESNRVVERLIRVNREALRLSNRVVADLLKVLKDAGPDSEELRKLAEDVLRENAELSRESVKIAEKMLEENRDLTRRLKELAKKVLEEIRDLVRGVRDADELLRRVEEILKRLLELIRRIIEEHRKILERLLMSCAQESRKHEEILRRLLKAAD

SEQ ID NO: 783 - protein, 241 aa, Artificial Sequence
  Synthetic sequence.
DEIETVLKRLAELIKESLDLLRETLDELRKIIEESKKSLEDVLRRLKELIDRLRRLAKEGGSEELLRLLIEVIERLLKVVEDLLRESNRVVERLIRVNREALRLSNRVVADLLKVLKDAGPDSEELRKLAEDVLRENAELSRESVKIAEKMLEENRDLTRRLKELAKKVLEEIRDLVRGVRDADELLRRVEEILKRLLELIRRIIEEHRKILERLLELAMSCAQESEEILRRLLKAADEER

SEQ ID NO: 784 - protein, 227 aa, Artificial Sequence; identical to SEQ ID NO: 778
  Synthetic sequence.

SEQ ID NO: 785 - protein, 230 aa, Artificial Sequence; identical to SEQ ID NO: 779
  Synthetic sequence.

SEQ ID NO: 786 - protein, 234 aa, Artificial Sequence; identical to SEQ ID NO: 780
  Synthetic sequence.

SEQ ID NO: 787 - protein, 237 aa, Artificial Sequence; identical to SEQ ID NO: 781
  Synthetic sequence.

SEQ ID NO: 788 - protein, 238 aa, Artificial Sequence; identical to SEQ ID NO: 782
  Synthetic sequence.

SEQ ID NO: 789 - protein, 218 aa, Artificial Sequence
  Synthetic sequence.
SKEEKLKDDVRAVLEDLDRVLKELEKLSEDNLRELKRVLDRITDLHRRILDELRKGIGSEELLRRVEKVLKDNLDLLRKLVEEHKESSERDLKRVEDLVREIKEVLRKLLELEDRGTDIRKIEEEIERLLRKIRKAVEESKDLNRRNSERIEEVARRSEELARRLLKEIRERGDSKAAEDILRVLEKLVKVSRELHMSCAQESEHHVRVSTRIARLLL

SEQ ID NO: 790 - protein, 221 aa, Artificial Sequence
  Synthetic sequence.
SKEEKLKDDVRAVLEDLDRVLKELEKLSEDNLRELKRVLDRITDLHRRILDELRKGIGSEELLRRVEKVLKDNLDLLRKLVEEHKESSERDLKRVEDLVREIKEVLRKLLELEDRGTDIRKIEEEIERLLRKIRKAVEESKDLNRRNSERIEEVARRSEELARRLLKEIRERGDSKAAEDILRVLEKLVKVSREAIKLIMSCAQESVRVSTRIARLLLDVA

SEQ ID NO: 791 - protein, 222 aa, Artificial Sequence
  Synthetic sequence.
SKEEKLKDDVRAVLEDLDRVLKELEKLSEDNLRELKRVLDRITDLHRRILDELRKGIGSEELLRRVEKVLKDNLDLLRKLVEEHKESSERDLKRVEDLVREIKEVLRKLLELEDRGTDIRKIEEEIERLLRKIRKAVEESKDLNRRNSERIEEVARRSEELARRLLKEIRERGDSKAAEDILRVLEKLVKVSREAIKLLLMSCAQESRVSTRIARLLLDVAR

SEQ ID NO: 792 - protein, 225 aa, Artificial Sequence
  Synthetic sequence.
SKEEKLKDDVRAVLEDLDRVLKELEKLSEDNLRELKRVLDRITDLHRRILDELRKGIGSEELLRRVEKVLKDNLDLLRKLVEEHKESSERDLKRVEDLVREIKEVLRKLLELEDRGTDIRKIEEEIERLLRKIRKAVEESKDLNRRNSERIEEVARRSEELARRLLKEIRERGDSKAAEDILRVLEKLVKVSREAIKLILELAMSCAQESTRIARLLLDVARKLA

SEQ ID NO: 793 - protein, 226 aa, Artificial Sequence
  Synthetic sequence.
SKEEKLKDDVRAVLEDLDRVLKELEKLSEDNLRELKRVLDRITDLHRRILDELRKGIGSEELLRRVEKVLKDNLDLLRKLVEEHKESSERDLKRVEDLVREIKEVLRKLLELEDRGTDIRKIEEEIERLLRKIRKAVEESKDLNRRNSERIEEVARRSEELARRLLKEIRERGDSKAAEDILRVLEKLVKVSREAIKLILELLKMSCAQESRIARLLLDVARKLAE

SEQ ID NO: 794 - protein, 229 aa, Artificial Sequence
  Synthetic sequence.
SKEEKLKDDVRAVLEDLDRVLKELEKLSEDNLRELKRVLDRITDLHRRILDELRKGIGSEELLRRVEKVLKDNLDLLRKLVEEHKESSERDLKRVEDLVREIKEVLRKLLELEDRGTDIRKIEEEIERLLRKIRKAVEESKDLNRRNSERIEEVARRSEELARRLLKEIRERGDSKAAEDILRVLEKLVKVSREAIKLILELSEHLKMSCAQESRLLLDVARKLAEVIK

SEQ ID NO: 795 - protein, 232 aa, Artificial Sequence
  Synthetic sequence.
SKEEKLKDDVRAVLEDLDRVLKELEKLSEDNLRELKRVLDRITDLHRRILDELRKGIGSEELLRRVEKVLKDNLDLLRKLVEEHKESSERDLKRVEDLVREIKEVLRKLLELEDRGTDIRKIEEEIERLLRKIRKAVEESKDLNRRNSERIEEVARRSEELARRLLKEIRERGDSKAAEDILRVLEKLVKVSREAIKLILELSEHHVRLAMSCAQESLDVARKLAEVIKEAE

SEQ ID NO: 796 - protein, 233 aa, Artificial Sequence
  Synthetic sequence.
SKEEKLKDDVRAVLEDLDRVLKELEKLSEDNLRELKRVLDRITDLHRRILDELRKGIGSEELLRRVEKVLKDNLDLLRKLVEEHKESSERDLKRVEDLVREIKEVLRKLLELEDRGTDIRKIEEEIERLLRKIRKAVEESKDLNRRNSERIEEVARRSEELARRLLKEIRERGDSKAAEDILRVLEKLVKVSREAIKLILELSEHHVRVLTMSCAQESDVARKLAEVIKEAER

SEQ ID NO: 797 - protein, 218 aa, Artificial Sequence
  Synthetic sequence.
SKEEKLKDDVRAVLEDLDRVLKELEKLSEDNLRELKRVLDRITDLHRRILDELRKGIGSEELLRRVEKVLKDNLDLLRKLVEEHKESSERDLKRVEDLVREIKEVLRKLLELEDRGTDIRKIEEEIERLLRKIRKAVEESKDLNRRNSERIEEVARRSEELARRLLKEIRERGDSKAAEDILRVLEKLVKVSRELCMSCAQESEHHVRVSTRIARLLL

SEQ ID NO: 798 - protein, 221 aa, Artificial Sequence; identical to SEQ ID NO: 790
  Synthetic sequence.

SEQ ID NO: 799 - protein, 222 aa, Artificial Sequence; identical to SEQ ID NO: 791
  Synthetic sequence.

SEQ ID NO: 800 - protein, 225 aa, Artificial Sequence; identical to SEQ ID NO: 792
  Synthetic sequence.

SEQ ID NO: 801 - protein, 229 aa, Artificial Sequence
  Synthetic sequence.
SKEEKLKDDVRAVLEDLDRVLKELEKLSEDNLRELKRVLDRITDLHRRILDELRKGIGSEELLRRVEKVLKDNLDLLRKLVEEHKESSERDLKRVEDLVREIKEVLRKLLELEDRGTDIRKIEEEIERLLRKIRKAVEESKDLNRRNSERIEEVARRSEELARRLLKEIRERGDSKAAEDILRVLEKLVKVSREAIKLILELSEHLIMSCAQESRLLLDVARKLAEVIK

SEQ ID NO: 802 - protein, 232 aa, Artificial Sequence
  Synthetic sequence.
SKEEKLKDDVRAVLEDLDRVLKELEKLSEDNLRELKRVLDRITDLHRRILDELRKGIGSEELLRRVEKVLKDNLDLLRKLVEEHKESSERDLKRVEDLVREIKEVLRKLLELEDRGTDIRKIEEEIERLLRKIRKAVEESKDLNRRNSERIEEVARRSEELARRLLKEIRERGDSKAAEDILRVLEKLVKVSREAIKLILELSEHHVRLSMSCAQESLDVARKLAEVIKEAE

SEQ ID NO: 803 - protein, 233 aa, Artificial Sequence; identical to SEQ ID NO: 796
  Synthetic sequence.

SEQ ID NO: 804 - protein, 223 aa, Artificial Sequence
  Synthetic sequence.
SEIEDVIRRLRKILEDLERVSEKLLREIKKILDEARRLNEEVIKEIKRVLEDAVRVFRDGSGSKEELAKLVEELIRELAKLAKEVDEIHKRIVERLKALVEDAERIHRKIVETLEEIVRGVPSEELKRVVEAIVEVIKEHLKVLADVIRRIIKAIEENAETIKRVLEDIVRVLELVLRGEGSIEDLVREVERLIKRIEDLLMSCAQESRELLKRIKEASDKVR

SEQ ID NO: 805 - protein, 227 aa, Artificial Sequence
  Synthetic sequence.
SEIEDVIRRLRKILEDLERVSEKLLREIKKILDEARRLNEEVIKEIKRVLEDAVRVFRDGSGSKEELAKLVEELIRELAKLAKEVDEIHKRIVERLKALVEDAERIHRKIVETLEEIVRGVPSEELKRVVEAIVEVIKEHLKVLADVIRRIIKAIEENAETIKRVLEDIVRVLELVLRGEGSIEDLVREVERLIKRIEDSLRELIMSCAQESKRIKEASDKVREDVD

SEQ ID NO: 806 - protein, 230 aa, Artificial Sequence
  Synthetic sequence.
SEIEDVIRRLRKILEDLERVSEKLLREIKKILDEARRLNEEVIKEIKRVLEDAVRVFRDGSGSKEELAKLVEELIRELAKLAKEVDEIHKRIVERLKALVEDAERIHRKIVETLEEIVRGVPSEELKRVVEAIVEVIKEHLKVLADVIRRIIKAIEENAETIKRVLEDIVRVLELVLRGEGSIEDLVREVERLIKRIEDSLRELEKLVMSCAQESKEASDKVREDVDRLI

SEQ ID NO: 807 - protein, 234 aa, Artificial Sequence
  Synthetic sequence.
SEIEDVIRRLRKILEDLERVSEKLLREIKKILDEARRLNEEVIKEIKRVLEDAVRVFRDGSGSKEELAKLVEELIRELAKLAKEVDEIHKRIVERLKALVEDAERIHRKIVETLEEIVRGVPSEELKRVVEAIVEVIKEHLKVLADVIRRIIKAIEENAETIKRVLEDIVRVLELVLRGEGSIEDLVREVERLIKRIEDSLRELEKTVRELMMSCAQESDKVREDVDRLIKELK

SEQ ID NO: 808 - protein, 237 aa, Artificial Sequence
  Synthetic sequence.
SEIEDVIRRLRKILEDLERVSEKLLREIKKILDEARRLNEEVIKEIKRVLEDAVRVFRDGSGSKEELAKLVEELIRELAKLAKEVDEIHKRIVERLKALVEDAERIHRKIVETLEEIVRGVPSEELKRVVEAIVEVIKEHLKVLADVIRRIIKAIEENAETIKRVLEDIVRVLELVLRGEGSIEDLVREVERLIKRIEDSLRELEKTVRELLKLMMSCAQESREDVDRLIKELKEAA

SEQ ID NO: 809 - protein, 238 aa, Artificial Sequence
  Synthetic sequence.
SEIEDVIRRLRKILEDLERVSEKLLREIKKILDEARRLNEEVIKEIKRVLEDAVRVFRDGSGSKEELAKLVEELIRELAKLAKEVDEIHKRIVERLKALVEDAERIHRKIVETLEEIVRGVPSEELKRVVEAIVEVIKEHLKVLADVIRRIIKAIEENAETIKRVLEDIVRVLELVLRGEGSIEDLVREVERLIKRIEDSLRELEKTVRELLKRLQMSCAQESEDVDRLIKELKEAAD

SEQ ID NO: 810 - protein, 223 aa, Artificial Sequence
  Synthetic sequence.
SEIEDVIRRLRKILEDLERVSEKLLREIKKILDEARRLNEEVIKEIKRVLEDAVRVFRDGSGSKEELAKLVEELIRELAKLAKEVDEIHKRIVERLKALVEDAERIHRKIVETLEEIVRGVPSEELKRVVEAIVEVIKEHLKVLADVIRRIIKAIEENAETIKRVLEDIVRVLELVLRGEGSIEDLVREVERLIKRIEDLVMSCAQESRELLKRIKEASDKVR

SEQ ID NO: 811 - protein, 230 aa, Artificial Sequence; identical to SEQ ID NO: 806
  Synthetic sequence.

SEQ ID NO: 812 - protein, 234 aa, Artificial Sequence
  Synthetic sequence.
SEIEDVIRRLRKILEDLERVSEKLLREIKKILDEARRLNEEVIKEIKRVLEDAVRVFRDGSGSKEELAKLVEELIRELAKLAKEVDEIHKRIVERLKALVEDAERIHRKIVETLEEIVRGVPSEELKRVVEAIVEVIKEHLKVLADVIRRIIKAIEENAETIKRVLEDIVRVLELVLRGEGSIEDLVREVERLIKRIEDSLRELEKTVRELLMSCAQESDKVREDVDRLIKELK

SEQ ID NO: 813 - protein, 237 aa, Artificial Sequence
  Synthetic sequence.
SEIEDVIRRLRKILEDLERVSEKLLREIKKILDEARRLNEEVIKEIKRVLEDAVRVFRDGSGSKEELAKLVEELIRELAKLAKEVDEIHKRIVERLKALVEDAERIHRKIVETLEEIVRGVPSEELKRVVEAIVEVIKEHLKVLADVIRRIIKAIEENAETIKRVLEDIVRVLELVLRGEGSIEDLVREVERLIKRIEDSLRELEKTVRELLKLAMSCAQESREDVDRLIKELKEAA

SEQ ID NO: 814 - protein, 238 aa, Artificial Sequence
  Synthetic sequence.
SEIEDVIRRLRKILEDLERVSEKLLREIKKILDEARRLNEEVIKEIKRVLEDAVRVFRDGSGSKEELAKLVEELIRELAKLAKEVDEIHKRIVERLKALVEDAERIHRKIVETLEEIVRGVPSEELKRVVEAIVEVIKEHLKVLADVIRRIIKAIEENAETIKRVLEDIVRVLELVLRGEGSIEDLVREVERLIKRIEDSLRELEKTVRELLKRLAMSCAQESEDVDRLIKELKEAAD

SEQ ID NO: 815 - protein, 231 aa, Artificial Sequence
  Synthetic sequence.
SREEIVATLEDLARKILEVVKKLAKEIEDAWREIERAVREILKRLEELWREIEDVVRKKVDSRVAEILETVVKRVVDITRRLIEEAERVVRELVDITRKLITILEEVVRRLVEIVREASKIDDRRELEDMLRKIREVVREVIERLKKLDEDVRRVVEEVIRRLEELNKRLEDVIREVKKRLKELGLSEEAVKELVELLEEILERNTRLVMSCAQESRTVIRIHEKIVEDLI

SEQ ID NO: 816 - protein, 234 aa, Artificial Sequence
  Synthetic sequence.
SREEIVATLEDLARKILEVVKKLAKEIEDAWREIERAVREILKRLEELWREIEDVVRKKVDSRVAEILETVVKRVVDITRRLIEEAERVVRELVDITRKLITILEEVVRRLVEIVREASKIDDRRELEDMLRKIREVVREVIERLKKLDEDVRRVVEEVIRRLEELNKRLEDVIREVKKRLKELGLSEEAVKELVELLEEILERNTRVIKLIMSCAQESIRIHEKIVEDLIKLL

SEQ ID NO: 817 - protein, 238 aa, Artificial Sequence
  Synthetic sequence.
SREEIVATLEDLARKILEVVKKLAKEIEDAWREIERAVREILKRLEELWREIEDVVRKKVDSRVAEILETVVKRVVDITRRLIEEAERVVRELVDITRKLITILEEVVRRLVEIVREASKIDDRRELEDMLRKIREVVREVIERLKKLDEDVRRVVEEVIRRLEELNKRLEDVIREVKKRLKELGLSEEAVKELVELLEEILERNTRVIKEIIDLLMSCAQESEKIVEDLIKLLEELL

SEQ ID NO: 818 - protein, 242 aa, Artificial Sequence
  Synthetic sequence.
SREEIVATLEDLARKILEVVKKLAKEIEDAWREIERAVREILKRLEELWREIEDVVRKKVDSRVAEILETVVKRVVDITRRLIEEAERVVRELVDITRKLITILEEVVRRLVEIVREASKIDDRRELEDMLRKIREVVREVIERLKKLDEDVRRVVEEVIRRLEELNKRLEDVIREVKKRLKELGLSEEAVKELVELLEEILERNTRVIKEIIDLLRTLTMSCAQESEDLIKLLEELLRRLE

SEQ ID NO: 819 - protein, 246 aa, Artificial Sequence
  Synthetic sequence.
SREEIVATLEDLARKILEVVKKLAKEIEDAWREIERAVREILKRLEELWREIEDVVRKKVDSRVAEILETVVKRVVDITRRLIEEAERVVRELVDITRKLITILEEVVRRLVEIVREASKIDDRRELEDMLRKIREVVREVIERLKKLDEDVRRVVEEVIRRLEELNKRLEDVIREVKKRLKELGLSEEAVKELVELLEEILERNTRVIKEIIDLLRTVIRILEMSCAQESKLLEELLRRLEEATR

SEQ ID NO: 820 - protein, 231 aa, Artificial Sequence
  Synthetic sequence.
SREEIVATLEDLARKILEVVKKLAKEIEDAWREIERAVREILKRLEELWREIEDVVRKKVDSRVAEILETVVKRVVDITRRLIEEAERVVRELVDITRKLITILEEVVRRLVEIVREASKIDDRRELEDMLRKIREVVREVIERLKKLDEDVRRVVEEVIRRLEELNKRLEDVIREVKKRLKELGLSEEAVKELVELLEEILERNTRLNMSCAQESRTVIRIHEKIVEDLI

SEQ ID NO: 821 - protein, 232 aa, Artificial Sequence
  Synthetic sequence.
SREEIVATLEDLARKILEVVKKLAKEIEDAWREIERAVREILKRLEELWREIEDVVRKKVDSRVAEILETVVKRVVDITRRLIEEAERVVRELVDITRKLITILEEVVRRLVEIVREASKIDDRRELEDMLRKIREVVREVIERLKKLDEDVRRVVEEVIRRLEELNKRLEDVIREVKKRLKELGLSEEAVKELVELLEEILERNTRVLKMSCAQESTVIRIHEKIVEDLIK

SEQ ID NO: 822 - protein, 234 aa, Artificial Sequence; identical to SEQ ID NO: 816
  Synthetic sequence.

SEQ ID NO: 823 - protein, 238 aa, Artificial Sequence; identical to SEQ ID NO: 817
  Synthetic sequence.

SEQ ID NO: 824 - protein, 246 aa, Artificial Sequence
  Synthetic sequence.
SREEIVATLEDLARKILEVVKKLAKEIEDAWREIERAVREILKRLEELWREIEDVVRKKVDSRVAEILETVVKRVVDITRRLIEEAERVVRELVDITRKLITILEEVVRRLVEIVREASKIDDRRELEDMLRKIREVVREVIERLKKLDEDVRRVVEEVIRRLEELNKRLEDVIREVKKRLKELGLSEEAVKELVELLEEILERNTRVIKEIIDLLRTVIRILHMSCAQESKLLEELLRRLEEATR

SEQ ID NO: 825 - protein, 225 aa, Artificial Sequence
  Synthetic sequence.
KEKEDALKKLEDLARKSREDLERVLRKHKKILDKIEELLKRVLDEHKKIVDDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELAREVERVIKELLDKSKEILELIMSCAQESLKVSEEILKLSEDAS

SEQ ID NO: 826 - protein, 226 aa, Artificial Sequence
  Synthetic sequence.
KEKEDALKKLEDLARKSREDLERVLRKHKKILDKIEELLKRVLDEHKKIVDDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELAREVERVIKELLDKSKEILERLLMSCAQESKVSEEILKLSEDASE

SEQ ID NO: 827 - protein, 230 aa, Artificial Sequence
  Synthetic sequence.
KEKEDALKKLEDLARKSREDLERVLRKHKKILDKIEELLKRVLDEHKKIVDDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELAREVERVIKELLDKSKEILERIERALKMSCAQESEILKLSEDASEELLK

SEQ ID NO: 828 - protein, 232 aa, Artificial Sequence
  Synthetic sequence.
KEKEDALKKLEDLARKSREDLERVLRKHKKILDKIEELLKRVLDEHKKIVDDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELAREVERVIKELLDKSKEILERIERAIDLLMSCAQESLKLSEDASEELLKIL

SEQ ID NO: 829 - protein, 233 aa, Artificial Sequence
  Synthetic sequence.
KEKEDALKKLEDLARKSREDLERVLRKHKKILDKIEELLKRVLDEHKKIVDDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELAREVERVIKELLDKSKEILERIERAIDELRMSCAQESKLSEDASEELLKILR

SEQ ID NO: 830 - protein, 237 aa, Artificial Sequence
  Synthetic sequence.
KEKEDALKKLEDLARKSREDLERVLRKHKKILDKIEELLKRVLDEHKKIVDDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELAREVERVIKELLDKSKEILERIERAIDELLKVLEMSCAQESDASEELLKILREFAK

SEQ ID NO: 831 - protein, 226 aa, Artificial Sequence; identical to SEQ ID NO: 826
  Synthetic sequence.

SEQ ID NO: 832 - protein, 230 aa, Artificial Sequence; identical to SEQ ID NO: 827
  Synthetic sequence.

SEQ ID NO: 833 - protein, 232 aa, Artificial Sequence; identical to SEQ ID NO: 828
  Synthetic sequence.

SEQ ID NO: 834 - protein, 233 aa, Artificial Sequence; identical to SEQ ID NO: 829
  Synthetic sequence.

SEQ ID NO: 835 - protein, 237 aa, Artificial Sequence; identical to SEQ ID NO: 830
  Synthetic sequence.

SEQ ID NO: 836 - protein, 214 aa, Artificial Sequence
  Synthetic sequence.
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLDILERAVEVVRRLIMSCAQESERHVDATREVIERVK

SEQ ID NO: 837 - protein, 215 aa, Artificial Sequence
  Synthetic sequence.
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLDILERAVEVVRRVLKMSCAQESRHVDATREVIERVKR

SEQ ID NO: 838 - protein, 217 aa, Artificial Sequence
  Synthetic sequence.
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLDILERAVEVVRRVIKLLMSCAQESVDATREVIERVKRVN

SEQ ID NO: 839 - protein, 218 aa, Artificial Sequence
  Synthetic sequence.
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLDILERAVEVVRRVIKALAMSCAQESDATREVIERVKRVNK

SEQ ID NO: 840 - protein, 221 aa, Artificial Sequence
  Synthetic sequence.
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLDILERAVEVVRRVIKALKELGMSCAQESREVIERVKRVNKRLL

SEQ ID NO: 841 - protein, 222 aa, Artificial Sequence
  Synthetic sequence.
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLDILERAVEVVRRVIKALKEVLEMSCAQESEVIERVKRVNKRLLE

SEQ ID NO: 842 - protein, 225 aa, Artificial Sequence
  Synthetic sequence.
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLDILERAVEVVRRVIKALKEVLERLGMSCAQESERVKRVNKRLLEAVR

SEQ ID NO: 843 - protein, 228 aa, Artificial Sequence
  Synthetic sequence.
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLDILERAVEVVRRVIKALKEVLERHVDLTMSCAQESKRVNKRLLEAVREVV

SEQ ID NO: 844 - protein, 229 aa, Artificial Sequence
  Synthetic sequence.
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLDILERAVEVVRRVIKALKEVLERHVDALRMSCAQESRVNKRLLEAVREVVT

SEQ ID NO: 845 - protein, 215 aa, Artificial Sequence; identical to SEQ ID NO: 837
  Synthetic sequence.

SEQ ID NO: 846 - protein, 217 aa, Artificial Sequence; identical to SEQ ID NO: 838
  Synthetic sequence.

SEQ ID NO: 847 - protein, 218 aa, Artificial Sequence
  Synthetic sequence.
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLDILERAVEVVRRVIKALKMSCAQESDATREVIERVKRVNK

SEQ ID NO: 848 - protein, 221 aa, Artificial Sequence; identical to SEQ ID NO: 840
  Synthetic sequence.

SEQ ID NO: 849 - protein, 222 aa, Artificial Sequence; identical to SEQ ID NO: 841
  Synthetic sequence.

SEQ ID NO: 850 - protein, 225 aa, Artificial Sequence
  Synthetic sequence.
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLDILERAVEVVRRVIKALKEVLERLYMSCAQESERVKRVNKRLLEAVR

SEQ ID NO: 851 - protein, 228 aa, Artificial Sequence; identical to SEQ ID NO: 843
  Synthetic sequence.

SEQ ID NO: 852 - protein, 229 aa, Artificial Sequence; identical to SEQ ID NO: 844
  Synthetic sequence.

SEQ ID NO: 853 - protein, 226 aa, Artificial Sequence
  Synthetic sequence.
SEKELLKEILDRIRELLEDDNRLLKRIVDEIRKLLEEWLRVHKEILERIKELLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKIAKIIEELKRLLEDLARLTMSCAQESKRLLKEWRDRNKEVA

SEQ ID NO: 854 - protein, 230 aa, Artificial Sequence
  Synthetic sequence.
SEKELLKEILDRIRELLEDDNRLLKRIVDEIRKLLEEWLRVHKEILERIKELLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKIAKIIEELKRLLEDLARDTRRLIMSCAQESKEWRDRNKEVADTLK

SEQ ID NO: 855 - protein, 233 aa, Artificial Sequence
  Synthetic sequence.
SEKELLKEILDRIRELLEDDNRLLKRIVDEIRKLLEEWLRVHKEILERIKELLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKIAKIIEELKRLLEDLARDTRRVIELAMSCAQESRDRNKEVADTLKKLL

SEQ ID NO: 856 - protein, 237 aa, Artificial Sequence
  Synthetic sequence.
SEKELLKEILDRIRELLEDDNRLLKRIVDEIRKLLEEWLRVHKEILERIKELLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKIAKIIEELKRLLEDLARDTRRVIEEAKRLLMSCAQESKEVADTLKKLLEDLI

SEQ ID NO: 857 - protein, 241 aa, Artificial Sequence
  Synthetic sequence.
SEKELLKEILDRIRELLEDDNRLLKRIVDEIRKLLEEWLRVHKEILERIKELLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKIAKIIEELKRLLEDLARDTRRVIEEAKRLLKELRMSCAQESDTLKKLLEDLIRKIR

SEQ ID NO: 858 - protein, 226 aa, Artificial Sequence; identical to SEQ ID NO: 853
  Synthetic sequence.

SEQ ID NO: 859 - protein, 230 aa, Artificial Sequence; identical to SEQ ID NO: 854
  Synthetic sequence.

SEQ ID NO: 860 - protein, 233 aa, Artificial Sequence; identical to SEQ ID NO: 855
  Synthetic sequence.

SEQ ID NO: 861 - protein, 241 aa, Artificial Sequence; identical to SEQ ID NO: 857
  Synthetic sequence.

SEQ ID NO: 862 - protein, 234 aa, Artificial Sequence
  Synthetic sequence.
SEDELLEKIVRKLAEAVKRIEEELRKSKREIERLVKEIKEKLEDSLARVKETLDRIRETRKGPSDEEVLERLVRTLEELLARHLKLIEDIARELKKLLKEHLDRIETIVRDLKRLLKEILDELERTGLPREALEAVRELVKTVARLLDEVLKNNKKLLDDLKKELDDVLANNKRIVDELARLLERVRRGKEDLEELLRLLKEVIERSIESLLMSCAQESRVLEYSVASLEELLR

SEQ ID NO: 863 - protein, 238 aa, Artificial Sequence
  Synthetic sequence.
SEDELLEKIVRKLAEAVKRIEEELRKSKREIERLVKEIKEKLEDSLARVKETLDRIRETRKGPSDEEVLERLVRTLEELLARHLKLIEDIARELKKLLKEHLDRIETIVRDLKRLLKEILDELERTGLPREALEAVRELVKTVARLLDEVLKNNKKLLDDLKKELDDVLANNKRIVDELARLLERVRRGKEDLEELLRLLKEVIERSIESLERLLKMSCAQESYSVASLEELLRRLLE

SEQ ID NO: 864 - protein, 241 aa, Artificial Sequence
  Synthetic sequence.
SEDELLEKIVRKLAEAVKRIEEELRKSKREIERLVKEIKEKLEDSLARVKETLDRIRETRKGPSDEEVLERLVRTLEELLARHLKLIEDIARELKKLLKEHLDRIETIVRDLKRLLKEILDELERTGLPREALEAVRELVKTVARLLDEVLKNNKKLLDDLKKELDDVLANNKRIVDELARLLERVRRGKEDLEELLRLLKEVIERSIESLERLLELLLMSCAQESASLEELLRRLLEVIK

SEQ ID NO: 865 - protein, 244 aa, Artificial Sequence
  Synthetic sequence.
SEDELLEKIVRKLAEAVKRIEEELRKSKREIERLVKEIKEKLEDSLARVKETLDRIRETRKGPSDEEVLERLVRTLEELLARHLKLIEDIARELKKLLKEHLDRIETIVRDLKRLLKEILDELERTGLPREALEAVRELVKTVARLLDEVLKNNKKLLDDLKKELDDVLANNKRIVDELARLLERVRRGKEDLEELLRLLKEVIERSIESLERLLELILRLIMSCAQESEELLRRLLEVIKRIV

SEQ ID NO: 866 - protein, 247 aa, Artificial Sequence
  Synthetic sequence.
SEDELLEKIVRKLAEAVKRIEEELRKSKREIERLVKEIKEKLEDSLARVKETLDRIRETRKGPSDEEVLERLVRTLEELLARHLKLIEDIARELKKLLKEHLDRIETIVRDLKRLLKEILDELERTGLPREALEAVRELVKTVARLLDEVLKNNKKLLDDLKKELDDVLANNKRIVDELARLLERVRRGKEDLEELLRLLKEVIERSIESLERLLELILRVLELAMSCAQESLRRLLEVIKRIVDTT

SEQ ID NO: 867 - protein, 244 aa, Artificial Sequence
  Synthetic sequence.
SEDELLEKIVRKLAEAVKRIEEELRKSKREIERLVKEIKEKLEDSLARVKETLDRIRETRKGPSDEEVLERLVRTLEELLARHLKLIEDIARELKKLLKEHLDRIETIVRDLKRLLKEILDELERTGLPREALEAVRELVKTVARLLDEVLKNNKKLLDDLKKELDDVLANNKRIVDELARLLERVRRGKEDLEELLRLLKEVIERSIESLERLLELILRLMMSCAQESEELLRRLLEVIKRIV

SEQ ID NO: 868 - protein, 247 aa, Artificial Sequence; identical to SEQ ID NO: 866
  Synthetic sequence.

SEQ ID NO: 869 - protein, 222 aa, Artificial Sequence
  Synthetic sequence.
DEDEIAEELKRLLREVEEASKEIVRRMRELAREANKASEDILRTLEKLLEELRRRVEESGGSSKAVLDKIREVLETLKELLDRHHETVRDLVRRLKELLDRHNETVAKLVEDIKALLDKSGGREEIKKRLEDALREHNRIIAEIKKLLDKVLKDHKDILDDIKKKLDDVLREVTEILKRGRIDEVVRRIERVIREVIKLLMSCAQESHDVVEEIIRLLEEVT

SEQ ID NO: 870 - protein, 227 aa, Artificial Sequence
  Synthetic sequence.
DEDEIAEELKRLLREVEEASKEIVRRMRELAREANKASEDILRTLEKLLEELRRRVEESGGSSKAVLDKIREVLETLKELLDRHHETVRDLVRRLKELLDRHNETVAKLVEDIKALLDKSGGREEIKKRLEDALREHNRIIAEIKKLLDKVLKDHKDILDDIKKKLDDVLREVTEILKRGRIDEVVRRIERVIREVIKILARALEMSCAQESEIIRLLEEVTDELRR

SEQ ID NO: 871 - protein, 230 aa, Artificial Sequence
  Synthetic sequence.
DEDEIAEELKRLLREVEEASKEIVRRMRELAREANKASEDILRTLEKLLEELRRRVEESGGSSKAVLDKIREVLETLKELLDRHHETVRDLVRRLKELLDRHNETVAKLVEDIKALLDKSGGREEIKKRLEDALREHNRIIAEIKKLLDKVLKDHKDILDDIKKKLDDVLREVTEILKRGRIDEVVRRIERVIREVIKILARANKRLHMSCAQESRLLEEVTDELRRVVE

SEQ ID NO: 872 - protein, 233 aa, Artificial Sequence
  Synthetic sequence.
DEDEIAEELKRLLREVEEASKEIVRRMRELAREANKASEDILRTLEKLLEELRRRVEESGGSSKAVLDKIREVLETLKELLDRHHETVRDLVRRLKELLDRHNETVAKLVEDIKALLDKSGGREEIKKRLEDALREHNRIIAEIKKLLDKVLKDHKDILDDIKKKLDDVLREVTEILKRGRIDEVVRRIERVIREVIKILARANKRLHDLVMSCAQESEEVTDELRRVVEEVI

SEQ ID NO: 873 - protein, 234 aa, Artificial Sequence
  Synthetic sequence.
DEDEIAEELKRLLREVEEASKEIVRRMRELAREANKASEDILRTLEKLLEELRRRVEESGGSSKAVLDKIREVLETLKELLDRHHETVRDLVRRLKELLDRHNETVAKLVEDIKALLDKSGGREEIKKRLEDALREHNRIIAEIKKLLDKVLKDHKDILDDIKKKLDDVLREVTEILKRGRIDEVVRRIERVIREVIKILARANKRLHDVLEMSCAQESEVTDELRRVVEEVIR

SEQ ID NO: 874 - protein, 222 aa, Artificial Sequence; identical to SEQ ID NO: 869
  Synthetic sequence.

SEQ ID NO: 875 - protein, 233 aa, Artificial Sequence; identical to SEQ ID NO: 872
  Synthetic sequence.

SEQ ID NO: 876 - protein, 234 aa, Artificial Sequence; identical to SEQ ID NO: 873
  Synthetic sequence.

SEQ ID NO: 877 - protein, 234 aa, Artificial Sequence
  Synthetic sequence.
DAEEKAKKIEDVARRYAEEVKRVLDDLERLLRESEEEVERIVRKLEKLARDLEERVREGTKSEAVERLVRELLKAIKELIDVLRDVVRLSAEVIKELLDVLRELVELNLRAIKEIIEVLSKGKSEEVKKALDEILEKIEKVNTDVNRRLAEIIRKLREIHEEVLRELDKILRDIESVVRDVERGIDDKEVIDALKELLKVLEDLLREIKELTMSCAQESDELLKLLHELSRRVI

SEQ ID NO: 878 - protein, 241 aa, Artificial Sequence
  Synthetic sequence.
DAEEKAKKIEDVARRYAEEVKRVLDDLERLLRESEEEVERIVRKLEKLARDLEERVREGTKSEAVERLVRELLKAIKELIDVLRDVVRLSAEVIKELLDVLRELVELNLRAIKEIIEVLSKGKSEEVKKALDEILEKIEKVNTDVNRRLAEIIRKLREIHEEVLRELDKILRDIESVVRDVERGIDDKEVIDALKELLKVLEDLLREIKEALTRNLELAMSCAQESHELSRRVIEELRKLL

SEQ ID NO: 879 - protein, 234 aa, Artificial Sequence
  Synthetic sequence.
DAEEKAKKIEDVARRYAEEVKRVLDDLERLLRESEEEVERIVRKLEKLARDLEERVREGTKSEAVERLVRELLKAIKELIDVLRDVVRLSAEVIKELLDVLRELVELNLRAIKEIIEVLSKGKSEEVKKALDEILEKIEKVNTDVNRRLAEIIRKLREIHEEVLRELDKILRDIESVVRDVERGIDDKEVIDALKELLKVLEDLLREIKELMMSCAQESDELLKLLHELSRRVI

SEQ ID NO: 880 - protein, 237 aa, Artificial Sequence
  Synthetic sequence.
DAEEKAKKIEDVARRYAEEVKRVLDDLERLLRESEEEVERIVRKLEKLARDLEERVREGTKSEAVERLVRELLKAIKELIDVLRDVVRLSAEVIKELLDVLRELVELNLRAIKEIIEVLSKGKSEEVKKALDEILEKIEKVNTDVNRRLAEIIRKLREIHEEVLRELDKILRDIESVVRDVERGIDDKEVIDALKELLKVLEDLLREIKEALTLFMSCAQESLKLLHELSRRVIEEL

SEQ ID NO: 881 - protein, 238 aa, Artificial Sequence
  Synthetic sequence.
DAEEKAKKIEDVARRYAEEVKRVLDDLERLLRESEEEVERIVRKLEKLARDLEERVREGTKSEAVERLVRELLKAIKELIDVLRDVVRLSAEVIKELLDVLRELVELNLRAIKEIIEVLSKGKSEEVKKALDEILEKIEKVNTDVNRRLAEIIRKLREIHEEVLRELDKILRDIESVVRDVERGIDDKEVIDALKELLKVLEDLLREIKEALTRLGMSCAQESKLLHELSRRVIEELR

SEQ ID NO: 882 - protein, 242 aa, Artificial Sequence
  Synthetic sequence.
DAEEKAKKIEDVARRYAEEVKRVLDDLERLLRESEEEVERIVRKLEKLARDLEERVREGTKSEAVERLVRELLKAIKELIDVLRDVVRLSAEVIKELLDVLRELVELNLRAIKEIIEVLSKGKSEEVKKALDEILEKIEKVNTDVNRRLAEIIRKLREIHEEVLRELDKILRDIESVVRDVERGIDDKEVIDALKELLKVLEDLLREIKEALTRNLEKLDMSCAQESELSRRVIEELRKLLE

SEQ ID NO: 883 - protein, 229 aa, Artificial Sequence
  Synthetic sequence.
DEEELLREIKTILDESLKALEELIRKIMRILDKSLKDLEEIVREIKKTIDELLEKVRRSGLPEEVLKKVASVAEKVKEDIDRLLEDVERSHREVKKKLDELLKEVKRSHEEVKKELDSLRGDSDRDTVAREILRVLKKNLDVLAEVVEKIVKVLEDNLKSLKAVLETLVDLLRKLIKVLREGGLSEEALDDLRRLVKELADKLRKLLMSCAQESKELKDEAKKLLDDYA

SEQ ID NO: 884 - protein, 240 aa, Artificial Sequence
  Synthetic sequence.
DEEELLREIKTILDESLKALEELIRKIMRILDKSLKDLEEIVREIKKTIDELLEKVRRSGLPEEVLKKVASVAEKVKEDIDRLLEDVERSHREVKKKLDELLKEVKRSHEEVKKELDSLRGDSDRDTVAREILRVLKKNLDVLAEVVEKIVKVLEDNLKSLKAVLETLVDLLRKLIKVLREGGLSEEALDDLRRLVKELADKLRKLLKDYKDLLKELKMSCAQESDDYARLIEELEKKAR

SEQ ID NO: 885 - protein, 226 aa, Artificial Sequence
  Synthetic sequence.
DEEELLREIKTILDESLKALEELIRKIMRILDKSLKDLEEIVREIKKTIDELLEKVRRSGLPEEVLKKVASVAEKVKEDIDRLLEDVERSHREVKKKLDELLKEVKRSHEEVKKELDSLRGDSDRDTVAREILRVLKKNLDVLAEVVEKIVKVLEDNLKSLKAVLETLVDLLRKLIKVLREGGLSEEALDDLRRLVKELADKLKMSCAQESDLLKELKDEAKKLLD

SEQ ID NO: 886 - protein, 240 aa, Artificial Sequence; identical to SEQ ID NO: 884
  Synthetic sequence.

SEQ ID NO: 887 - protein, 222 aa, Artificial Sequence
  Synthetic sequence.
SREELLDRILEAIAKILEDLKRLIDENLARLEEVVRELERIIDRNLKLIREILDELKKGSGSEEILEKIKKVDKELEDLIRRLLKKLEDLIRETERRLREILKRIRDLLKEVKDRDKDLERLLEVLEEVLRVIAELAKELLDSLRKVLKVVEEVLRLLNEVNKEVLDVIRELAKDGGSDEIIRKLDELLKEVEKVHKELKMSCAQESEDHKRSLDEVKKKLE

SEQ ID NO: 888 - protein, 229 aa, Artificial Sequence
  Synthetic sequence.
SREELLDRILEAIAKILEDLKRLIDENLARLEEVVRELERIIDRNLKLIREILDELKKGSGSEEILEKIKKVDKELEDLIRRLLKKLEDLIRETERRLREILKRIRDLLKEVKDRDKDLERLLEVLEEVLRVIAELAKELLDSLRKVLKVVEEVLRLLNEVNKEVLDVIRELAKDGGSDEIIRKLDELLKEVEKVHKEVKDRIRKLLMSCAQESDEVKKKLERLLERAK

SEQ ID NO: 889 - protein, 233 aa, Artificial Sequence
  Synthetic sequence.
SREELLDRILEAIAKILEDLKRLIDENLARLEEVVRELERIIDRNLKLIREILDELKKGSGSEEILEKIKKVDKELEDLIRRLLKKLEDLIRETERRLREILKRIRDLLKEVKDRDKDLERLLEVLEEVLRVIAELAKELLDSLRKVLKVVEEVLRLLNEVNKEVLDVIRELAKDGGSDEIIRKLDELLKEVEKVHKEVKDRIRKLLEDLKMSCAQESKKLERLLERAKEVVE

SEQ ID NO: 890 - protein, 236 aa, Artificial Sequence
  Synthetic sequence.
SREELLDRILEAIAKILEDLKRLIDENLARLEEVVRELERIIDRNLKLIREILDELKKGSGSEEILEKIKKVDKELEDLIRRLLKKLEDLIRETERRLREILKRIRDLLKEVKDRDKDLERLLEVLEEVLRVIAELAKELLDSLRKVLKVVEEVLRLLNEVNKEVLDVIRELAKDGGSDEIIRKLDELLKEVEKVHKEVKDRIRKLLEDHKRLLMSCAQESERLLERAKEVVEREK

SEQ ID NO: 891 - protein, 237 aa, Artificial Sequence
  Synthetic sequence.
SREELLDRILEAIAKILEDLKRLIDENLARLEEVVRELERIIDRNLKLIREILDELKKGSGSEEILEKIKKVDKELEDLIRRLLKKLEDLIRETERRLREILKRIRDLLKEVKDRDKDLERLLEVLEEVLRVIAELAKELLDSLRKVLKVVEEVLRLLNEVNKEVLDVIRELAKDGGSDEIIRKLDELLKEVEKVHKEVKDRIRKLLEDHKRSLDMSCAQESRLLERAKEVVEREKK

SEQ ID NO: 892 - protein, 222 aa, Artificial Sequence; identical to SEQ ID NO: 887
  Synthetic sequence.

SEQ ID NO: 893 - protein, 229 aa, Artificial Sequence; identical to SEQ ID NO: 888
  Synthetic sequence.

SEQ ID NO: 894 - protein, 230 aa, Artificial Sequence
  Synthetic sequence.
SREELLDRILEAIAKILEDLKRLIDENLARLEEVVRELERIIDRNLKLIREILDELKKGSGSEEILEKIKKVDKELEDLIRRLLKKLEDLIRETERRLREILKRIRDLLKEVKDRDKDLERLLEVLEEVLRVIAELAKELLDSLRKVLKVVEEVLRLLNEVNKEVLDVIRELAKDGGSDEIIRKLDELLKEVEKVHKEVKDRIRKLLEMSCAQESEVKKKLERLLERAKE

SEQ ID NO: 895 - protein, 233 aa, Artificial Sequence
  Synthetic sequence.
SREELLDRILEAIAKILEDLKRLIDENLARLEEVVRELERIIDRNLKLIREILDELKKGSGSEEILEKIKKVDKELEDLIRRLLKKLEDLIRETERRLREILKRIRDLLKEVKDRDKDLERLLEVLEEVLRVIAELAKELLDSLRKVLKVVEEVLRLLNEVNKEVLDVIRELAKDGGSDEIIRKLDELLKEVEKVHKEVKDRIRKLLEDLAMSCAQESKKLERLLERAKEVVE

SEQ ID NO: 896 - protein, 236 aa, Artificial Sequence
  Synthetic sequence.
SREELLDRILEAIAKILEDLKRLIDENLARLEEVVRELERIIDRNLKLIREILDELKKGSGSEEILEKIKKVDKELEDLIRRLLKKLEDLIRETERRLREILKRIRDLLKEVKDRDKDLERLLEVLEEVLRVIAELAKELLDSLRKVLKVVEEVLRLLNEVNKEVLDVIRELAKDGGSDEIIRKLDELLKEVEKVHKEVKDRIRKLLEDHKRLCMSCAQESERLLERAKEVVEREK

SEQ ID NO: 897 - protein, 237 aa, Artificial Sequence; identical to SEQ ID NO: 891
  Synthetic sequence.

SEQ ID NO: 898 - protein, 234 aa, Artificial Sequence
  Synthetic sequence.
SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETAVRAIIRVLEKHLEAVRRVLELAMSCAQESLETVRELIERLKRVL

SEQ ID NO: 899 - protein, 235 aa, Artificial Sequence
  Synthetic sequence.
SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETAVRAIIRVLEKHLEAVRRVLEELLMSCAQESETVRELIERLKRVLE

SEQ ID NO: 900 - protein, 238 aa, Artificial Sequence
  Synthetic sequence.
SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETAVRAIIRVLEKHLEAVRRVLEELLKLTMSCAQESRELIERLKRVLEEAI

SEQ ID NO: 901 - protein, 245 aa, Artificial Sequence
  Synthetic sequence.
SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETAVRAIIRVLEKHLEAVRRVLEELLKVLAEHLELAMSCAQESKRVLEEAIEVVERVA

SEQ ID NO: 902 - protein, 235 aa, Artificial Sequence; identical to SEQ ID NO: 899
  Synthetic sequence.

SEQ ID NO: 903 - protein, 238 aa, Artificial Sequence
  Synthetic sequence.
SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETAVRAIIRVLEKHLEAVRRVLEELLKLQMSCAQESRELIERLKRVLEEAI

SEQ ID NO: 904 - protein, 239 aa, Artificial Sequence
  Synthetic sequence.
SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETAVRAIIRVLEKHLEAVRRVLEELLKVLAMSCAQESELIERLKRVLEEAIE

SEQ ID NO: 905 - protein, 242 aa, Artificial Sequence
  Synthetic sequence.
SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETAVRAIIRVLEKHLEAVRRVLEELLKVLAELLMSCAQESERLKRVLEEAIEVVE

SEQ ID NO: 906 - protein, 245 aa, Artificial Sequence
  Synthetic sequence.
SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETAVRAIIRVLEKHLEAVRRVLEELLKVLAEHLELVMSCAQESKRVLEEAIEVVERVA

SEQ ID NO: 907 - protein, 246 aa, Artificial Sequence
  Synthetic sequence.
SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETAVRAIIRVLEKHLEAVRRVLEELLKVLAEHLETLKMSCAQESRVLEEAIEVVERVAR

SEQ ID NO: 908 - protein, 225 aa, Artificial Sequence
  Synthetic sequence.
DREKSVRDIEEDLKRVLDKLRRRVETSKEELKKVLKADKENADELEKTLRDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVAKELDEVIKRLLDNLLMSCAQESEVIDRNLADLRDLAE

SEQ ID NO: 909 - protein, 228 aa, Artificial Sequence
  Synthetic sequence.
DREKSVRDIEEDLKRVLDKLRRRVETSKEELKKVLKADKENADELEKTLRDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVAKELDEVIKRLLDNLKELSMSCAQESDRNLADLRDLAEELR

SEQ ID NO: 910 - protein, 229 aa, Artificial Sequence
  Synthetic sequence.
DREKSVRDIEEDLKRVLDKLRRRVETSKEELKKVLKADKENADELEKTLRDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVAKELDEVIKRLLDNLKENLKMSCAQESRNLADLRDLAEELRA

SEQ ID NO: 911 - protein, 232 aa, Artificial Sequence
  Synthetic sequence.
DREKSVRDIEEDLKRVLDKLRRRVETSKEELKKVLKADKENADELEKTLRDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVAKELDEVIKRLLDNLKENTDRLKMSCAQESADLRDLAEELRAVIE

SEQ ID NO: 912 - protein, 239 aa, Artificial Sequence
  Synthetic sequence.
DREKSVRDIEEDLKRVLDKLRRRVETSKEELKKVLKADKENADELEKTLRDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVAKELDEVIKRLLDNLKENTDRLKEVIDRLGMSCAQESEELRAVIERLLEDAR

SEQ ID NO: 913 - protein, 225 aa, Artificial Sequence; identical to SEQ ID NO: 908
  Synthetic sequence.

SEQ ID NO: 914 - protein, 232 aa, Artificial Sequence
  Synthetic sequence.
DREKSVRDIEEDLKRVLDKLRRRVETSKEELKKVLKADKENADELEKTLRDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVAKELDEVIKRLLDNLKENTDRLWMSCAQESADLRDLAEELRAVIE

SEQ ID NO: 915 - protein, 235 aa, Artificial Sequence
  Synthetic sequence.
DREKSVRDIEEDLKRVLDKLRRRVETSKEELKKVLKADKENADELEKTLRDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVAKELDEVIKRLLDNLKENTDRLKELIMSCAQESRDLAEELRAVIERLL

SEQ ID NO: 916 - protein, 251 aa, Artificial Sequence
  Synthetic sequence.
SLEEITKRLLELVEENLARHEEILRELLELAKRLAKEDRDILEEVLKLIEELLKLLEDNGSSEEDLKRLLKEVIEELRAVVKRVKDKWDEVVKRIEDLVKKLKELHDDTLRKLRELVRKIVTDISESGGEAEKVKRVVEKILELVERLAKVVKESVEKLLEILRELAEVSKRVAEALLRLLEELVRVIRIKDERTLREVVRKVLEEAKRLLDELEEVHKRVKKELEDLIMSCAQESKRVRDELREIKRELD

SEQ ID NO: 917 - protein, 251 aa, Artificial Sequence
  Synthetic sequence.
SLEEITKRLLELVEENLARHEEILRELLELAKRLAKEDRDILEEVLKLIEELLKLLEDNGSSEEDLKRLLKEVIEELRAVVKRVKDKWDEVVKRIEDLVKKLKELHDDTLRKLRELVRKIVTDISESGGEAEKVKRVVEKILELVERLAKVVKESVEKLLEILRELAEVSKRVAEALLRLLEELVRVIRIKDERTLREVVRKVLEEAKRLLDELEEVHKRVKKELEDLEMSCAQESKRVRDELREIKRELD

SEQ ID NO: 918 - protein, 226 aa, Artificial Sequence
  Synthetic sequence.
SAEEAVEKLVRIARAIVKINEDLSREVVRILREIVRLNEETTRLLVEIAREVVKVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVSEELLRRLEELRKRLEKVLDDLRMSCAQESRELERLLEESRRKLE

SEQ ID NO: 919 - protein, 229 aa, Artificial Sequence
  Synthetic sequence.
SAEEAVEKLVRIARAIVKINEDLSREVVRILREIVRLNEETTRLLVEIAREVVKVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVSEELLRRLEELRKRLEKVLDDSAKLLMSCAQESERLLEESRRKLEKLK

SEQ ID NO: 920 - protein, 230 aa, Artificial Sequence
  Synthetic sequence.
SAEEAVEKLVRIARAIVKINEDLSREVVRILREIVRLNEETTRLLVEIAREVVKVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVSEELLRRLEELRKRLEKVLDDSAKELKMSCAQESRLLEESRRKLEKLKR

SEQ ID NO: 921 - protein, 233 aa, Artificial Sequence
  Synthetic sequence.
SAEEAVEKLVRIARAIVKINEDLSREVVRILREIVRLNEETTRLLVEIAREVVKVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVSEELLRRLEELRKRLEKVLDDSAKELEKLAMSCAQESEESRRKLEKLKRDLE

SEQ ID NO: 922 - protein, 236 aa, Artificial Sequence
  Synthetic sequence.
SAEEAVEKLVRIARAIVKINEDLSREVVRILREIVRLNEETTRLLVEIAREVVKVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVSEELLRRLEELRKRLEKVLDDSAKELEKLKRLLMSCAQESRRKLEKLKRDLERVL

SEQ ID NO: 923 - protein, 226 aa, Artificial Sequence
  Synthetic sequence.
SAEEAVEKLVRIARAIVKINEDLSREVVRILREIVRLNEETTRLLVEIAREVVKVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVSEELLRRLEELRKRLEKVLDDLAMSCAQESRELERLLEESRRKLE

SEQ ID NO: 924 - protein, 229 aa, Artificial Sequence
  Synthetic sequence.
SAEEAVEKLVRIARAIVKINEDLSREVVRILREIVRLNEETTRLLVEIAREVVKVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVSEELLRRLEELRKRLEKVLDDSAKLAMSCAQESERLLEESRRKLEKLK

SEQ ID NO: 925 - protein, 230 aa, Artificial Sequence; identical to SEQ ID NO: 920
  Synthetic sequence.

SEQ ID NO: 926 - protein, 233 aa, Artificial Sequence
  Synthetic sequence.
SAEEAVEKLVRIARAIVKINEDLSREVVRILREIVRLNEETTRLLVEIAREVVKVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVSEELLRRLEELRKRLEKVLDDSAKELEKLVMSCAQESEESRRKLEKLKRDLE

SEQ ID NO: 927 - protein, 236 aa, Artificial Sequence; identical to SEQ ID NO: 922
  Synthetic sequence.

SEQ ID NO: 928 - protein, 228 aa, Artificial Sequence
  Synthetic sequence.
REDEVLRDIERLLREIEEKIRRILEESTAELRKVEEEVKRIIERTKRELKAIKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLLEKIKRVIREHIKALEKLARLLMSCAQESIEALKELARDLAEVI

SEQ ID NO: 929 - protein, 229 aa, Artificial Sequence
  Synthetic sequence.
REDEVLRDIERLLREIEEKIRRILEESTAELRKVEEEVKRIIERTKRELKAIKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLLEKIKRVIREHIKALEKLARDLKMSCAQESEALKELARDLAEVIR

SEQ ID NO: 930 - protein, 233 aa, Artificial Sequence
  Synthetic sequence.
REDEVLRDIERLLREIEEKIRRILEESTAELRKVEEEVKRIIERTKRELKAIKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLLEKIKRVIREHIKALEKLARDLKEILRMSCAQESELARDLAEVIRKLLE

SEQ ID NO: 931 - protein, 236 aa, Artificial Sequence
  Synthetic sequence.
REDEVLRDIERLLREIEEKIRRILEESTAELRKVEEEVKRIIERTKRELKAIKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLLEKIKRVIREHIKALEKLARDLKEILRRLIMSCAQESRDLAEVIRKLLEDVK

SEQ ID NO: 932 - protein, 225 aa, Artificial Sequence
  Synthetic sequence.
REDEVLRDIERLLREIEEKIRRILEESTAELRKVEEEVKRIIERTKRELKAIKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLLEKIKRVIREHIKALEKLAMSCAQESRRHIEALKELARDLA

SEQ ID NO: 933 - protein, 229 aa, Artificial Sequence; identical to SEQ ID NO: 929
  Synthetic sequence.

SEQ ID NO: 934 - protein, 233 aa, Artificial Sequence; identical to SEQ ID NO: 930
  Synthetic sequence.

SEQ ID NO: 935 - protein, 236 aa, Artificial Sequence; identical to SEQ ID NO: 931
  Synthetic sequence.

SEQ ID NO: 936 - protein, 222 aa, Artificial Sequence
  Synthetic sequence.
SREDLLRSLAELIETILRKSSELLDRLLKLVREHSETSERLIRELKKILEDILKLIKGGISEDDVRRIVKEAKDELRRSVEEVKKSVDDLKEELKRSLREVRELVKSIADALEEIVRRSSGLGEVIKKLLELLRRLLEVHERTIRLLAELLERHLEVHEESIRLLLRLLEELLELVERKGDEKELRRIAEAVERVLRDLLMSCAQESRDVEEVLRRHLEELA

SEQ ID NO: 937 - protein, 225 aa, Artificial Sequence
  Synthetic sequence.
SREDLLRSLAELIETILRKSSELLDRLLKLVREHSETSERLIRELKKILEDILKLIKGGISEDDVRRIVKEAKDELRRSVEEVKKSVDDLKEELKRSLREVRELVKSIADALEEIVRRSSGLGEVIKKLLELLRRLLEVHERTIRLLAELLERHLEVHEESIRLLLRLLEELLELVERKGDEKELRRIAEAVERVLRDHKALDMSCAQESEEVLRRHLEELARIL

SEQ ID NO: 938 - protein, 229 aa, Artificial Sequence
  Synthetic sequence.
SREDLLRSLAELIETILRKSSELLDRLLKLVREHSETSERLIRELKKILEDILKLIKGGISEDDVRRIVKEAKDELRRSVEEVKKSVDDLKEELKRSLREVRELVKSIADALEEIVRRSSGLGEVIKKLLELLRRLLEVHERTIRLLAELLERHLEVHEESIRLLLRLLEELLELVERKGDEKELRRIAEAVERVLRDHKAKNDKLLMSCAQESRRHLEELARILKDVK

SEQ ID NO: 939 - protein, 232 aa, Artificial Sequence
  Synthetic sequence.
SREDLLRSLAELIETILRKSSELLDRLLKLVREHSETSERLIRELKKILEDILKLIKGGISEDDVRRIVKEAKDELRRSVEEVKKSVDDLKEELKRSLREVRELVKSIADALEEIVRRSSGLGEVIKKLLELLRRLLEVHERTIRLLAELLERHLEVHEESIRLLLRLLEELLELVERKGDEKELRRIAEAVERVLRDHKAKNDKILRLVMSCAQESLEELARILKDVKKVL

SEQ ID NO: 940 - protein, 229 aa, Artificial Sequence; identical to SEQ ID NO: 938
  Synthetic sequence.

SEQ ID NO: 941 - protein, 232 aa, Artificial Sequence
  Synthetic sequence.
SREDLLRSLAELIETILRKSSELLDRLLKLVREHSETSERLIRELKKILEDILKLIKGGISEDDVRRIVKEAKDELRRSVEEVKKSVDDLKEELKRSLREVRELVKSIADALEEIVRRSSGLGEVIKKLLELLRRLLEVHERTIRLLAELLERHLEVHEESIRLLLRLLEELLELVERKGDEKELRRIAEAVERVLRDHKAKNDKILRLCMSCAQESLEELARILKDVKKVL

SEQ ID NO: 942 - protein, 234 aa, Artificial Sequence
  Synthetic sequence.
SEEDEVLKTLDRKHKEAKKELDKVLRELEEEHKKVKRELDEVLKRLEDIHRRITELLRRGGISLEDVLRMVKEANRELVEVIKRIVKTVEDLNARAVEVVKRLAEELERLNAEMVKVLRKSGRSEEIEKDLRRSSADIRRLVEEIERRLRDSLRKLRKLADDLAKKLKESLDKLEELVRRGVDEEAVERVLKENKELIEEIVRLIRKILDLNMSCAQESVRLLERLLRENLRLI

SEQ ID NO: 943 - protein, 235 aa, Artificial Sequence
  Synthetic sequence.
SEEDEVLKTLDRKHKEAKKELDKVLRELEEEHKKVKRELDEVLKRLEDIHRRITELLRRGGISLEDVLRMVKEANRELVEVIKRIVKTVEDLNARAVEVVKRLAEELERLNAEMVKVLRKSGRSEEIEKDLRRSSADIRRLVEEIERRLRDSLRKLRKLADDLAKKLKESLDKLEELVRRGVDEEAVERVLKENKELIEEIVRLIRKILDELLMSCAQESRLLERLLRENLRLIE

SEQ ID NO: 944 - protein, 239 aa, Artificial Sequence
  Synthetic sequence.
SEEDEVLKTLDRKHKEAKKELDKVLRELEEEHKKVKRELDEVLKRLEDIHRRITELLRRGGISLEDVLRMVKEANRELVEVIKRIVKTVEDLNARAVEVVKRLAEELERLNAEMVKVLRKSGRSEEIEKDLRRSSADIRRLVEEIERRLRDSLRKLRKLADDLAKKLKESLDKLEELVRRGVDEEAVERVLKENKELIEEIVRLIRKILDENIELLRMSCAQESRLLRENLRLIEEARK

SEQ ID NO: 945 - protein, 228 aa, Artificial Sequence
  Synthetic sequence.
SEEDEVLKTLDRKHKEAKKELDKVLRELEEEHKKVKRELDEVLKRLEDIHRRITELLRRGGISLEDVLRMVKEANRELVEVIKRIVKTVEDLNARAVEVVKRLAEELERLNAEMVKVLRKSGRSEEIEKDLRRSSADIRRLVEEIERRLRDSLRKLRKLADDLAKKLKESLDKLEELVRRGVDEEAVERVLKENKELIEEIVRLLQMSCAQESELIRRIVRLLERLLR

SEQ ID NO: 946 - protein, 231 aa, Artificial Sequence
  Synthetic sequence.
SEEDEVLKTLDRKHKEAKKELDKVLRELEEEHKKVKRELDEVLKRLEDIHRRITELLRRGGISLEDVLRMVKEANRELVEVIKRIVKTVEDLNARAVEVVKRLAEELERLNAEMVKVLRKSGRSEEIEKDLRRSSADIRRLVEEIERRLRDSLRKLRKLADDLAKKLKESLDKLEELVRRGVDEEAVERVLKENKELIEEIVRLIRKLLMSCAQESRRIVRLLERLLRENL

SEQ ID NO: 947 - protein, 238 aa, Artificial Sequence
  Synthetic sequence.
SEEDEVLKTLDRKHKEAKKELDKVLRELEEEHKKVKRELDEVLKRLEDIHRRITELLRRGGISLEDVLRMVKEANRELVEVIKRIVKTVEDLNARAVEVVKRLAEELERLNAEMVKVLRKSGRSEEIEKDLRRSSADIRRLVEEIERRLRDSLRKLRKLADDLAKKLKESLDKLEELVRRGVDEEAVERVLKENKELIEEIVRLIRKILDENIELIMSCAQESERLLRENLRLIEEAR

SEQ ID NO: 948 - protein, 239 aa, Artificial Sequence
  Synthetic sequence.
SEEDEVLKTLDRKHKEAKKELDKVLRELEEEHKKVKRELDEVLKRLEDIHRRITELLRRGGISLEDVLRMVKEANRELVEVIKRIVKTVEDLNARAVEVVKRLAEELERLNAEMVKVLRKSGRSEEIEKDLRRSSADIRRLVEEIERRLRDSLRKLRKLADDLAKKLKESLDKLEELVRRGVDEEAVERVLKENKELIEEIVRLIRKILDENIELLKMSCAQESRLLRENLRLIEEARK

SEQ ID NO: 949 - protein, 236 aa, Artificial Sequence
  Synthetic sequence.
SKEEDVRRLIEELVRELRRILEENRRMLKELVEKLEEVLRRSEEVWRRLAKELDELLKEGNSDAVREAVETIRRVLEDLVELDRRVVKVIKEVLERHAKSSTELVRELEDVLRAAVEAIEKGKSEEDLKRELRKLKERLKSVLKRHDDTNKELFRELEDVLRKHEEELRRLADELRRLLEDLKRSGDIPEEVIKKIEDLVRKTERELREVHKLLMSCAQESKEVVDRSVEILRDLV

SEQ ID NO: 950 - protein, 240 aa, Artificial Sequence
  Synthetic sequence.
SKEEDVRRLIEELVRELRRILEENRRMLKELVEKLEEVLRRSEEVWRRLAKELDELLKEGNSDAVREAVETIRRVLEDLVELDRRVVKVIKEVLERHAKSSTELVRELEDVLRAAVEAIEKGKSEEDLKRELRKLKERLKSVLKRHDDTNKELFRELEDVLRKHEEELRRLADELRRLLEDLKRSGDIPEEVIKKIEDLVRKTERELREVHKELRRLVMSCAQESDRSVEILRDLVRKIV

SEQ ID NO: 951 - protein, 241 aa, Artificial Sequence
  Synthetic sequence.
SKEEDVRRLIEELVRELRRILEENRRMLKELVEKLEEVLRRSEEVWRRLAKELDELLKEGNSDAVREAVETIRRVLEDLVELDRRVVKVIKEVLERHAKSSTELVRELEDVLRAAVEAIEKGKSEEDLKRELRKLKERLKSVLKRHDDTNKELFRELEDVLRKHEEELRRLADELRRLLEDLKRSGDIPEEVIKKIEDLVRKTERELREVHKELRRLLEMSCAQESRSVEILRDLVRKIVR

SEQ ID NO: 952 - protein, 244 aa, Artificial Sequence
  Synthetic sequence.
SKEEDVRRLIEELVRELRRILEENRRMLKELVEKLEEVLRRSEEVWRRLAKELDELLKEGNSDAVREAVETIRRVLEDLVELDRRVVKVIKEVLERHAKSSTELVRELEDVLRAAVEAIEKGKSEEDLKRELRKLKERLKSVLKRHDDTNKELFRELEDVLRKHEEELRRLADELRRLLEDLKRSGDIPEEVIKKIEDLVRKTERELREVHKELRRLVEELYMSCAQESEILRDLVRKIVRILE

SEQ ID NO: 953 - protein, 247 aa, Artificial Sequence
  Synthetic sequence.
SKEEDVRRLIEELVRELRRILEENRRMLKELVEKLEEVLRRSEEVWRRLAKELDELLKEGNSDAVREAVETIRRVLEDLVELDRRVVKVIKEVLERHAKSSTELVRELEDVLRAAVEAIEKGKSEEDLKRELRKLKERLKSVLKRHDDTNKELFRELEDVLRKHEEELRRLADELRRLLEDLKRSGDIPEEVIKKIEDLVRKTERELREVHKELRRLVEEAKELMMSCAQESRDLVRKIVRILEESA

SEQ ID NO: 954 - protein, 248 aa, Artificial Sequence
  Synthetic sequence.
SKEEDVRRLIEELVRELRRILEENRRMLKELVEKLEEVLRRSEEVWRRLAKELDELLKEGNSDAVREAVETIRRVLEDLVELDRRVVKVIKEVLERHAKSSTELVRELEDVLRAAVEAIEKGKSEEDLKRELRKLKERLKSVLKRHDDTNKELFRELEDVLRKHEEELRRLADELRRLLEDLKRSGDIPEEVIKKIEDLVRKTERELREVHKELRRLVEEAKEVLDMSCAQESDLVRKIVRILEESAR

SEQ ID NO: 955 - protein, 221 aa, Artificial Sequence
  Synthetic sequence.
SEKEAIKEVAELLKALIDDLLRLLKEDVDTARRVLDEIKKLLEENESIAREVLRRLREGKGAERAEELVREWIERTREILKRIEELLRRWTRKTREILKRIEELVRRVIEVVRRGGVPKELVDKLEEVLRKLLKLVEDHVRKVEKIISELLKLIKEHVEKVERIARKLLELLRRGGDETDLDRIVKEMEKVLEDSIRLLMSCAQESEDILRESEKALRDLL

SEQ ID NO: 956 - protein, 225 aa, Artificial Sequence
  Synthetic sequence.
SEKEAIKEVAELLKALIDDLLRLLKEDVDTARRVLDEIKKLLEENESIAREVLRRLREGKGAERAEELVREWIERTREILKRIEELLRRWTRKTREILKRIEELVRRVIEVVRRGGVPKELVDKLEEVLRKLLKLVEDHVRKVEKIISELLKLIKEHVEKVERIARKLLELLRRGGDETDLDRIVKEMEKVLEDSIRELEKLLMSCAQESRESEKALRDLLSELA

SEQ ID NO: 957 - protein, 228 aa, Artificial Sequence
  Synthetic sequence.
SEKEAIKEVAELLKALIDDLLRLLKEDVDTARRVLDEIKKLLEENESIAREVLRRLREGKGAERAEELVREWIERTREILKRIEELLRRWTRKTREILKRIEELVRRVIEVVRRGGVPKELVDKLEEVLRKLLKLVEDHVRKVEKIISELLKLIKEHVEKVERIARKLLELLRRGGDETDLDRIVKEMEKVLEDSIRELEKLVKLLMSCAQESEKALRDLLSELAKVL

SEQ ID NO: 958 - protein, 232 aa, Artificial Sequence
  Synthetic sequence.
SEKEAIKEVAELLKALIDDLLRLLKEDVDTARRVLDEIKKLLEENESIAREVLRRLREGKGAERAEELVREWIERTREILKRIEELLRRWTRKTREILKRIEELVRRVIEVVRRGGVPKELVDKLEEVLRKLLKLVEDHVRKVEKIISELLKLIKEHVEKVERIARKLLELLRRGGDETDLDRIVKEMEKVLEDSIRELEKLVKRLEDLFMSCAQESRDLLSELAKVLEEVR

SEQ ID NO: 959 - protein, 221 aa, Artificial Sequence; identical to SEQ ID NO: 955
  Synthetic sequence.

SEQ ID NO: 960 - protein, 228 aa, Artificial Sequence; identical to SEQ ID NO: 957
  Synthetic sequence.

SEQ ID NO: 961 - protein, 229 aa, Artificial Sequence
  Synthetic sequence.
SEKEAIKEVAELLKALIDDLLRLLKEDVDTARRVLDEIKKLLEENESIAREVLRRLREGKGAERAEELVREWIERTREILKRIEELLRRWTRKTREILKRIEELVRRVIEVVRRGGVPKELVDKLEEVLRKLLKLVEDHVRKVEKIISELLKLIKEHVEKVERIARKLLELLRRGGDETDLDRIVKEMEKVLEDSIRELEKLVKRLEMSCAQESKALRDLLSELAKVLE

SEQ ID NO: 962 - protein, 232 aa, Artificial Sequence; identical to SEQ ID NO: 958
  Synthetic sequence.

SEQ ID NO: 963 - protein, 233 aa, Artificial Sequence
  Synthetic sequence.
SEKEAIKEVAELLKALIDDLLRLLKEDVDTARRVLDEIKKLLEENESIAREVLRRLREGKGAERAEELVREWIERTREILKRIEELLRRWTRKTREILKRIEELVRRVIEVVRRGGVPKELVDKLEEVLRKLLKLVEDHVRKVEKIISELLKLIKEHVEKVERIARKLLELLRRGGDETDLDRIVKEMEKVLEDSIRELEKLVKRLEDILKMSCAQESDLLSELAKVLEEVRT

SEQ ID NO: 964 - protein, 222 aa, Artificial Sequence
  Synthetic sequence.
SREELLKELRKLVEEIKRRSEELLRRLEKLLEDNERRTRELLERLKELLREIEERIRGGGPSEEVIRLLEELVRAIERVLEEHLESNRRLVEAAESVLREHVELVKSLVRAIEDVVEKGLSEDKIRTIKKLLDEWARRLEKLVRDVRRKLEEWIKRTEEMIDEVARLLEELKETIRRKGGDEDTVRELTELVRRLLKRLGMSCAQESEILRELIKAIADAIK

SEQ ID NO: 965 - protein, 232 aa, Artificial Sequence
  Synthetic sequence.
SREELLKELRKLVEEIKRRSEELLRRLEKLLEDNERRTRELLERLKELLREIEERIRGGGPSEEVIRLLEELVRAIERVLEEHLESNRRLVEAAESVLREHVELVKSLVRAIEDVVEKGLSEDKIRTIKKLLDEWARRLEKLVRDVRRKLEEWIKRTEEMIDEVARLLEELKETIRRKGGDEDTVRELTELVRRLLKRVEELLKRSLELAMSCAQESADAIKESLDILDRLL

SEQ ID NO: 966 - protein, 233 aa, Artificial Sequence
  Synthetic sequence.
SREELLKELRKLVEEIKRRSEELLRRLEKLLEDNERRTRELLERLKELLREIEERIRGGGPSEEVIRLLEELVRAIERVLEEHLESNRRLVEAAESVLREHVELVKSLVRAIEDVVEKGLSEDKIRTIKKLLDEWARRLEKLVRDVRRKLEEWIKRTEEMIDEVARLLEELKETIRRKGGDEDTVRELTELVRRLLKRVEELLKRSLEILIMSCAQESDAIKESLDILDRLLR

SEQ ID NO: 967 - protein, 222 aa, Artificial Sequence
  Synthetic sequence.
SREELLKELRKLVEEIKRRSEELLRRLEKLLEDNERRTRELLERLKELLREIEERIRGGGPSEEVIRLLEELVRAIERVLEEHLESNRRLVEAAESVLREHVELVKSLVRAIEDVVEKGLSEDKIRTIKKLLDEWARRLEKLVRDVRRKLEEWIKRTEEMIDEVARLLEELKETIRRKGGDEDTVRELTELVRRLLKRLAMSCAQESEILRELIKAIADAIK

SEQ ID NO: 968 - protein, 232 aa, Artificial Sequence
  Synthetic sequence.
SREELLKELRKLVEEIKRRSEELLRRLEKLLEDNERRTRELLERLKELLREIEERIRGGGPSEEVIRLLEELVRAIERVLEEHLESNRRLVEAAESVLREHVELVKSLVRAIEDVVEKGLSEDKIRTIKKLLDEWARRLEKLVRDVRRKLEEWIKRTEEMIDEVARLLEELKETIRRKGGDEDTVRELTELVRRLLKRVEELLKRSLELLMSCAQESADAIKESLDILDRLL

SEQ ID NO: 969 - protein, 233 aa, Artificial Sequence
  Synthetic sequence.
SREELLKELRKLVEEIKRRSEELLRRLEKLLEDNERRTRELLERLKELLREIEERIRGGGPSEEVIRLLEELVRAIERVLEEHLESNRRLVEAAESVLREHVELVKSLVRAIEDVVEKGLSEDKIRTIKKLLDEWARRLEKLVRDVRRKLEEWIKRTEEMIDEVARLLEELKETIRRKGGDEDTVRELTELVRRLLKRVEELLKRSLEILKMSCAQESDAIKESLDILDRLLR

SEQ ID NO: 970 - protein, 236 aa, Artificial Sequence
  Synthetic sequence.
SREELLKELRKLVEEIKRRSEELLRRLEKLLEDNERRTRELLERLKELLREIEERIRGGGPSEEVIRLLEELVRAIERVLEEHLESNRRLVEAAESVLREHVELVKSLVRAIEDVVEKGLSEDKIRTIKKLLDEWARRLEKLVRDVRRKLEEWIKRTEEMIDEVARLLEELKETIRRKGGDEDTVRELTELVRRLLKRVEELLKRSLEILRELIMSCAQESKESLDILDRLLREVA

SEQ ID NO: 971 - protein, 229 aa, Artificial Sequence
  Synthetic sequence.
SEAERLADEVRKAVKKSEEDNETLVREVEKAVRELKKNNKTWVDEVRKLMKRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELLRMSCAQESRLLKIVRELHKDNIK

SEQ ID NO: 972 - protein, 231 aa, Artificial Sequence
  Synthetic sequence.
SEAERLADEVRKAVKKSEEDNETLVREVEKAVRELKKNNKTWVDEVRKLMKRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLAMSCAQESLKIVRELHKDNIKIL

SEQ ID NO: 973 - protein, 232 aa, Artificial Sequence
  Synthetic sequence.
SEAERLADEVRKAVKKSEEDNETLVREVEKAVRELKKNNKTWVDEVRKLMKRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLLNMSCAQESKIVRELHKDNIKILE

SEQ ID NO: 974 - protein, 235 aa, Artificial Sequence
  Synthetic sequence.
SEAERLADEVRKAVKKSEEDNETLVREVEKAVRELKKNNKTWVDEVRKLMKRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLNNELLMSCAQESRELHKDNIKILEDLL

SEQ ID NO: 975 - protein, 236 aa, Artificial Sequence
  Synthetic sequence.
SEAERLADEVRKAVKKSEEDNETLVREVEKAVRELKKNNKTWVDEVRKLMKRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLNNEILEMSCAQESELHKDNIKILEDLLR

SEQ ID NO: 976 - protein, 238 aa, Artificial Sequence
  Synthetic sequence.
SEAERLADEVRKAVKKSEEDNETLVREVEKAVRELKKNNKTWVDEVRKLMKRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLNNEILELQMSCAQESHKDNIKILEDLLRII

SEQ ID NO: 977 - protein, 243 aa, Artificial Sequence
  Synthetic sequence.
SEAERLADEVRKAVKKSEEDNETLVREVEKAVRELKKNNKTWVDEVRKLMKRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLNNEILERLLKILRMSCAQESKILEDLLRIIEEVLR

SEQ ID NO: 978 - protein, 229 aa, Artificial Sequence; identical to SEQ ID NO: 971
  Synthetic sequence.

SEQ ID NO: 979 - protein, 231 aa, Artificial Sequence; identical to SEQ ID NO: 972
  Synthetic sequence.

SEQ ID NO: 980 - protein, 232 aa, Artificial Sequence; identical to SEQ ID NO: 973
  Synthetic sequence.

SEQ ID NO: 981 - protein, 235 aa, Artificial Sequence; identical to SEQ ID NO: 974
  Synthetic sequence.

SEQ ID NO: 982 - protein, 236 aa, Artificial Sequence; identical to SEQ ID NO: 975
  Synthetic sequence.

SEQ ID NO: 983 - protein, 238 aa, Artificial Sequence
  Synthetic sequence.
SEAERLADEVRKAVKKSEEDNETLVREVEKAVRELKKNNKTWVDEVRKLMKRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLNNEILELCMSCAQESHKDNIKILEDLLRII

SEQ ID NO: 984 - protein, 243 aa, Artificial Sequence
  Synthetic sequence.
SEAERLADEVRKAVKKSEEDNETLVREVEKAVRELKKNNKTWVDEVRKLMKRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLNNEILERLLKILIMSCAQESKILEDLLRIIEEVLR

SEQ ID NO: 985 - protein, 240 aa, Artificial Sequence
  Synthetic sequence.
SEKDEVTRRIRELLKEAEETNREAIERIKRLLDRVREAVEEVAKRSEELLRRLKKVLDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSGSKEDLLREIARILAESLRLIRELLKEIEKLTMSCAQESERLNDELRKIIEAIL

SEQ ID NO: 986 - protein, 236 aa, Artificial Sequence
  Synthetic sequence.
SEKDEVTRRIRELLKEAEETNREAIERIKRLLDRVREAVEEVAKRSEELLRRLKKVLDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSGSKEDLLREIARILAESLRLIRELLKLIMSCAQESIELLERLNDELRKII

SEQ ID NO: 987 - protein, 240 aa, Artificial Sequence
  Synthetic sequence.
SEKDEVTRRIRELLKEAEETNREAIERIKRLLDRVREAVEEVAKRSEELLRRLKKVLDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSGSKEDLLREIARILAESLRLIRELLKEIEKLVMSCAQESERLNDELRKIIEAIL

SEQ ID NO: 988 - protein, 227 aa, Artificial Sequence
  Synthetic sequence.
SAEDLVRRVKDLVDKLEDKLRKVVRTNERLWEEIRKRLEELVRRNKELWDALVEKLKAGDKDKDELIEEAKSLEDESNALVEKLVRDIERVLAESNKLLDTLAKEIEEVLEEIVELVERGSGSDKEAREKLEDIKARLKEVLKKLREESKRIIDELRRLLEEYKRLVKEIRDRIEEVRKRNSEIRVLVELVRRHNKVLKELVELLMSCAQESNRVVEEVVRELVELL

SEQ ID NO: 989 - protein, 235 aa, Artificial Sequence
  Synthetic sequence.
SAEDLVRRVKDLVDKLEDKLRKVVRTNERLWEEIRKRLEELVRRNKELWDALVEKLKAGDKDKDELIEEAKSLEDESNALVEKLVRDIERVLAESNKLLDTLAKEIEEVLEEIVELVERGSGSDKEAREKLEDIKARLKEVLKKLREESKRIIDELRRLLEEYKRLVKEIRDRIEEVRKRNSEIRVLVELVRRHNKVLKELVEELEKLVRDLVMSCAQESRELVELLSRAVEVIK

SEQ ID NO: 990 - protein, 239 aa, Artificial Sequence
  Synthetic sequence.
SAEDLVRRVKDLVDKLEDKLRKVVRTNERLWEEIRKRLEELVRRNKELWDALVEKLKAGDKDKDELIEEAKSLEDESNALVEKLVRDIERVLAESNKLLDTLAKEIEEVLEEIVELVERGSGSDKEAREKLEDIKARLKEVLKKLREESKRIIDELRRLLEEYKRLVKEIRDRIEEVRKRNSEIRVLVELVRRHNKVLKELVEELEKLVRDHNRVLAMSCAQESELLSRAVEVIKEVVK

SEQ ID NO: 991 - protein, 227 aa, Artificial Sequence; identical to SEQ ID NO: 988
  Synthetic sequence.

SEQ ID NO: 992 - protein, 231 aa, Artificial Sequence
  Synthetic sequence.
SAEDLVRRVKDLVDKLEDKLRKVVRTNERLWEEIRKRLEELVRRNKELWDALVEKLKAGDKDKDELIEEAKSLEDESNALVEKLVRDIERVLAESNKLLDTLAKEIEEVLEEIVELVERGSGSDKEAREKLEDIKARLKEVLKKLREESKRIIDELRRLLEEYKRLVKEIRDRIEEVRKRNSEIRVLVELVRRHNKVLKELVEELEKLAMSCAQESEEVVRELVELLSRAV

SEQ ID NO: 993 - protein, 232 aa, Artificial Sequence
  Synthetic sequence.
SAEDLVRRVKDLVDKLEDKLRKVVRTNERLWEEIRKRLEELVRRNKELWDALVEKLKAGDKDKDELIEEAKSLEDESNALVEKLVRDIERVLAESNKLLDTLAKEIEEVLEEIVELVERGSGSDKEAREKLEDIKARLKEVLKKLREESKRIIDELRRLLEEYKRLVKEIRDRIEEVRKRNSEIRVLVELVRRHNKVLKELVEELEKLLRMSCAQESEVVRELVELLSRAVE

SEQ ID NO: 994 - protein, 235 aa, Artificial Sequence
  Synthetic sequence.
SAEDLVRRVKDLVDKLEDKLRKVVRTNERLWEEIRKRLEELVRRNKELWDALVEKLKAGDKDKDELIEEAKSLEDESNALVEKLVRDIERVLAESNKLLDTLAKEIEEVLEEIVELVERGSGSDKEAREKLEDIKARLKEVLKKLREESKRIIDELRRLLEEYKRLVKEIRDRIEEVRKRNSEIRVLVELVRRHNKVLKELVEELEKLVRDLAMSCAQESRELVELLSRAVEVIK

SEQ ID NO: 995 - protein, 239 aa, Artificial Sequence
  Synthetic sequence.
SAEDLVRRVKDLVDKLEDKLRKVVRTNERLWEEIRKRLEELVRRNKELWDALVEKLKAGDKDKDELIEEAKSLEDESNALVEKLVRDIERVLAESNKLLDTLAKEIEEVLEEIVELVERGSGSDKEAREKLEDIKARLKEVLKKLREESKRIIDELRRLLEEYKRLVKEIRDRIEEVRKRNSEIRVLVELVRRHNKVLKELVEELEKLVRDHNRVLKMSCAQESELLSRAVEVIKEVVK

SEQ ID NO: 996 - protein, 217 aa, Artificial Sequence
  Synthetic sequence.
SEKELVDDIRRILEEILRLLRSLLEEVIRLLEENEKLVRRHLKTVIDILRRVAKLLDENGIRTDEADRVLERLEKAHRELLEDYKRALEKIKETLERVLREAEEVVKKIDDALRKLGGSKEVLKRLLEELLRLVEKIAEEIKRLLSELVRVTEELVRTNKELLEEAVRVIRKEVGDDSLVREVEELIKRLEKHLDMSCAQESDLVKRVLDLVDEVVK

SEQ ID NO: 997 - protein, 220 aa, Artificial Sequence
  Synthetic sequence.
SEKELVDDIRRILEEILRLLRSLLEEVIRLLEENEKLVRRHLKTVIDILRRVAKLLDENGIRTDEADRVLERLEKAHRELLEDYKRALEKIKETLERVLREAEEVVKKIDDALRKLGGSKEVLKRLLEELLRLVEKIAEEIKRLLSELVRVTEELVRTNKELLEEAVRVIRKEVGDDSLVREVEELIKRLEKHIDDLLMSCAQESKRVLDLVDEVVKRVE

SEQ ID NO: 998 - protein, 224 aa, Artificial Sequence
  Synthetic sequence.
SEKELVDDIRRILEEILRLLRSLLEEVIRLLEENEKLVRRHLKTVIDILRRVAKLLDENGIRTDEADRVLERLEKAHRELLEDYKRALEKIKETLERVLREAEEVVKKIDDALRKLGGSKEVLKRLLEELLRLVEKIAEEIKRLLSELVRVTEELVRTNKELLEEAVRVIRKEVGDDSLVREVEELIKRLEKHIDDLLKTLRMSCAQESDLVDEVVKRVEDLVE

SEQ ID NO: 999 - protein, 227 aa, Artificial Sequence
  Synthetic sequence.
SEKELVDDIRRILEEILRLLRSLLEEVIRLLEENEKLVRRHLKTVIDILRRVAKLLDENGIRTDEADRVLERLEKAHRELLEDYKRALEKIKETLERVLREAEEVVKKIDDALRKLGGSKEVLKRLLEELLRLVEKIAEEIKRLLSELVRVTEELVRTNKELLEEAVRVIRKEVGDDSLVREVEELIKRLEKHIDDLLKTSRDLVMSCAQESDEVVKRVEDLVERVK

SEQ ID NO: 1000 - protein, 228 aa, Artificial Sequence
  Synthetic sequence.
SEKELVDDIRRILEEILRLLRSLLEEVIRLLEENEKLVRRHLKTVIDILRRVAKLLDENGIRTDEADRVLERLEKAHRELLEDYKRALEKIKETLERVLREAEEVVKKIDDALRKLGGSKEVLKRLLEELLRLVEKIAEEIKRLLSELVRVTEELVRTNKELLEEAVRVIRKEVGDDSLVREVEELIKRLEKHIDDLLKTSRDLLKMSCAQESEVVKRVEDLVERVKE

SEQ ID NO: 1001 - protein, 231 aa, Artificial Sequence
  Synthetic sequence.
SEKELVDDIRRILEEILRLLRSLLEEVIRLLEENEKLVRRHLKTVIDILRRVAKLLDENGIRTDEADRVLERLEKAHRELLEDYKRALEKIKETLERVLREAEEVVKKIDDALRKLGGSKEVLKRLLEELLRLVEKIAEEIKRLLSELVRVTEELVRTNKELLEEAVRVIRKEVGDDSLVREVEELIKRLEKHIDDLLKTSRDLVKRLAMSCAQESKRVEDLVERVKEKID

SEQ ID NO: 1002 - protein, 217 aa, Artificial Sequence
  Synthetic sequence.
SEKELVDDIRRILEEILRLLRSLLEEVIRLLEENEKLVRRHLKTVIDILRRVAKLLDENGIRTDEADRVLERLEKAHRELLEDYKRALEKIKETLERVLREAEEVVKKIDDALRKLGGSKEVLKRLLEELLRLVEKIAEEIKRLLSELVRVTEELVRTNKELLEEAVRVIRKEVGDDSLVREVEELIKRLEKHLKMSCAQESDLVKRVLDLVDEVVK

SEQ ID NO: 1003 - protein, 219 aa, Artificial Sequence
  Synthetic sequence.
SEKELVDDIRRILEEILRLLRSLLEEVIRLLEENEKLVRRHLKTVIDILRRVAKLLDENGIRTDEADRVLERLEKAHRELLEDYKRALEKIKETLERVLREAEEVVKKIDDALRKLGGSKEVLKRLLEELLRLVEKIAEEIKRLLSELVRVTEELVRTNKELLEEAVRVIRKEVGDDSLVREVEELIKRLEKHIDLLMSCAQESVKRVLDLVDEVVKRV

SEQ ID NO: 1004 - protein, 220 aa, Artificial Sequence; identical to SEQ ID NO: 997
  Synthetic sequence.

SEQ ID NO: 1005 - protein, 223 aa, Artificial Sequence
  Synthetic sequence.
SEKELVDDIRRILEEILRLLRSLLEEVIRLLEENEKLVRRHLKTVIDILRRVAKLLDENGIRTDEADRVLERLEKAHRELLEDYKRALEKIKETLERVLREAEEVVKKIDDALRKLGGSKEVLKRLLEELLRLVEKIAEEIKRLLSELVRVTEELVRTNKELLEEAVRVIRKEVGDDSLVREVEELIKRLEKHIDDLLKLAMSCAQESLDLVDEVVKRVEDLV

SEQ ID NO: 1006 - protein, 224 aa, Artificial Sequence
  Synthetic sequence.
SEKELVDDIRRILEEILRLLRSLLEEVIRLLEENEKLVRRHLKTVIDILRRVAKLLDENGIRTDEADRVLERLEKAHRELLEDYKRALEKIKETLERVLREAEEVVKKIDDALRKLGGSKEVLKRLLEELLRLVEKIAEEIKRLLSELVRVTEELVRTNKELLEEAVRVIRKEVGDDSLVREVEELIKRLEKHIDDLLKTLIMSCAQESDLVDEVVKRVEDLVE

SEQ ID NO: 1007 - protein, 227 aa, Artificial Sequence
  Synthetic sequence.
SEKELVDDIRRILEEILRLLRSLLEEVIRLLEENEKLVRRHLKTVIDILRRVAKLLDENGIRTDEADRVLERLEKAHRELLEDYKRALEKIKETLERVLREAEEVVKKIDDALRKLGGSKEVLKRLLEELLRLVEKIAEEIKRLLSELVRVTEELVRTNKELLEEAVRVIRKEVGDDSLVREVEELIKRLEKHIDDLLKTSRDLCMSCAQESDEVVKRVEDLVERVK

SEQ ID NO: 1008 - protein, 228 aa, Artificial Sequence; identical to SEQ ID NO: 1000
  Synthetic sequence.

SEQ ID NO: 1009 - protein, 231 aa, Artificial Sequence; identical to SEQ ID NO: 1001
  Synthetic sequence.

SEQ ID NO: 1010 - protein, 239 aa, Artificial Sequence
  Synthetic sequence.
DEERLAEELERVLDRNRKLLEEALRELRRVIEENRKSVKRLLDELKRVLDELLKVLRELSRGDSDEELRKVIEDLIRKLTKVLDKVRSLVEENIERLARVLEKLERLARENLEDLKKVLDDVDKKLKDRRLVERLAELVRELIEVNKEILEMLKEIVRELLEINRTLLERLKDLVATALEIIKLLARGDGTEEDVERAVKEIRDRLRKLLEDYERLVMSCAQESRRVRERYEAVLKRIK

SEQ ID NO: 1011 - protein, 243 aa, Artificial Sequence
  Synthetic sequence.
DEERLAEELERVLDRNRKLLEEALRELRRVIEENRKSVKRLLDELKRVLDELLKVLRELSRGDSDEELRKVIEDLIRKLTKVLDKVRSLVEENIERLARVLEKLERLARENLEDLKKVLDDVDKKLKDRRLVERLAELVRELIEVNKEILEMLKEIVRELLEINRTLLERLKDLVATALEIIKLLARGDGTEEDVERAVKEIRDRLRKLLEDYERAVRRLLMSCAQESERYEAVLKRIKDKLE

SEQ ID NO: 1012 - protein, 246 aa, Artificial Sequence
  Synthetic sequence.
DEERLAEELERVLDRNRKLLEEALRELRRVIEENRKSVKRLLDELKRVLDELLKVLRELSRGDSDEELRKVIEDLIRKLTKVLDKVRSLVEENIERLARVLEKLERLARENLEDLKKVLDDVDKKLKDRRLVERLAELVRELIEVNKEILEMLKEIVRELLEINRTLLERLKDLVATALEIIKLLARGDGTEEDVERAVKEIRDRLRKLLEDYERAVRRLEDLLMSCAQESEAVLKRIKDKLEETK

SEQ ID NO: 1013 - protein, 236 aa, Artificial Sequence
  Synthetic sequence.
DEERLAEELERVLDRNRKLLEEALRELRRVIEENRKSVKRLLDELKRVLDELLKVLRELSRGDSDEELRKVIEDLIRKLTKVLDKVRSLVEENIERLARVLEKLERLARENLEDLKKVLDDVDKKLKDRRLVERLAELVRELIEVNKEILEMLKEIVRELLEINRTLLERLKDLVATALEIIKLLARGDGTEEDVERAVKEIRDRLRKLLEDLEMSCAQESDKLRRVRERYEAVLK

SEQ ID NO: 1014 - protein, 239 aa, Artificial Sequence; identical to SEQ ID NO: 1010
  Synthetic sequence.

SEQ ID NO: 1015 - protein, 243 aa, Artificial Sequence; identical to SEQ ID NO: 1011
  Synthetic sequence.

SEQ ID NO: 1016 - protein, 246 aa, Artificial Sequence
  Synthetic sequence.
DEERLAEELERVLDRNRKLLEEALRELRRVIEENRKSVKRLLDELKRVLDELLKVLRELSRGDSDEELRKVIEDLIRKLTKVLDKVRSLVEENIERLARVLEKLERLARENLEDLKKVLDDVDKKLKDRRLVERLAELVRELIEVNKEILEMLKEIVRELLEINRTLLERLKDLVATALEIIKLLARGDGTEEDVERAVKEIRDRLRKLLEDYERAVRRLEDLAMSCAQESEAVLKRIKDKLEETK

SEQ ID NO: 1017 - protein, 228 aa, Artificial Sequence
  Synthetic sequence.
SRVEELKKLIEDILRISREVVERIARVAEDIHRINRRVLDDLRKLIEDILRTVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGDDEVEREIRRVKEDLDRLLMSCAQESEEIKRKLEEILRRVE

SEQ ID NO: 1018 - protein, 232 aa, Artificial Sequence
  Synthetic sequence.
SRVEELKKLIEDILRISREVVERIARVAEDIHRINRRVLDDLRKLIEDILRTVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGDDEVEREIRRVKEDLDRILEELRMSCAQESRKLEEILRRVEELHR

SEQ ID NO: 1019 - protein, 235 aa, Artificial Sequence
  Synthetic sequence.
SRVEELKKLIEDILRISREVVERIARVAEDIHRINRRVLDDLRKLIEDILRTVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGDDEVEREIRRVKEDLDRILEEYRRLLMSCAQESEEILRRVEELHRRLR

SEQ ID NO: 1020 - protein, 239 aa, Artificial Sequence
  Synthetic sequence.
SRVEELKKLIEDILRISREVVERIARVAEDIHRINRRVLDDLRKLIEDILRTVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGDDEVEREIRRVKEDLDRILEEYRRLLEELLMSCAQESRRVEELHRRLRRKLE

SEQ ID NO: 1021 - protein, 228 aa, Artificial Sequence; identical to SEQ ID NO: 1017
  Synthetic sequence.

SEQ ID NO: 1022 - protein, 232 aa, Artificial Sequence; identical to SEQ ID NO: 1018
  Synthetic sequence.

SEQ ID NO: 1023 - protein, 239 aa, Artificial Sequence
  Synthetic sequence.
SRVEELKKLIEDILRISREVVERIARVAEDIHRINRRVLDDLRKLIEDILRTVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGDDEVEREIRRVKEDLDRILEEYRRLLEELYMSCAQESRRVEELHRRLRRKLE

SEQ ID NO: 1024 - protein, 236 aa, Artificial Sequence
  Synthetic sequence.
DEDRRLEDAVAKLRKEHADIMKKLDDIMRELDEDHARIKERLDRILEELKALLTRVLRETREDELLRKVLELLTRLLKLLADVLEENKRLLEDILRLLKELIETNLRLLEEILALLRKVARGPVSEEEAKRLVEEITRLLEASTEEARKLVETIKRLLEESLDKLRSLVEEIERRLRTVLEEIRRRGAPEEIERIIRRVIEVIREILDLVRKLNMSCAQESEEILEDLARVNKKAV

SEQ ID NO: 1025 - protein, 237 aa, Artificial Sequence
  Synthetic sequence.
DEDRRLEDAVAKLRKEHADIMKKLDDIMRELDEDHARIKERLDRILEELKALLTRVLRETREDELLRKVLELLTRLLKLLADVLEENKRLLEDILRLLKELIETNLRLLEEILALLRKVARGPVSEEEAKRLVEEITRLLEASTEEARKLVETIKRLLEESLDKLRSLVEEIERRLRTVLEEIRRRGAPEEIERIIRRVIEVIREILDLVRKVLKMSCAQESEILEDLARVNKKAVD

SEQ ID NO: 1026 - protein, 240 aa, Artificial Sequence
  Synthetic sequence.
DEDRRLEDAVAKLRKEHADIMKKLDDIMRELDEDHARIKERLDRILEELKALLTRVLRETREDELLRKVLELLTRLLKLLADVLEENKRLLEDILRLLKELIETNLRLLEEILALLRKVARGPVSEEEAKRLVEEITRLLEASTEEARKLVETIKRLLEESLDKLRSLVEEIERRLRTVLEEIRRRGAPEEIERIIRRVIEVIREILDLVRKVNKKLAMSCAQESEDLARVNKKAVDAID

SEQ ID NO: 1027 - protein, 243 aa, Artificial Sequence
  Synthetic sequence.
DEDRRLEDAVAKLRKEHADIMKKLDDIMRELDEDHARIKERLDRILEELKALLTRVLRETREDELLRKVLELLTRLLKLLADVLEENKRLLEDILRLLKELIETNLRLLEEILALLRKVARGPVSEEEAKRLVEEITRLLEASTEEARKLVETIKRLLEESLDKLRSLVEEIERRLRTVLEEIRRRGAPEEIERIIRRVIEVIREILDLVRKVNKKALRLCMSCAQESARVNKKAVDAIDELA

SEQ ID NO: 1028 - protein, 244 aa, Artificial Sequence
  Synthetic sequence.
DEDRRLEDAVAKLRKEHADIMKKLDDIMRELDEDHARIKERLDRILEELKALLTRVLRETREDELLRKVLELLTRLLKLLADVLEENKRLLEDILRLLKELIETNLRLLEEILALLRKVARGPVSEEEAKRLVEEITRLLEASTEEARKLVETIKRLLEESLDKLRSLVEEIERRLRTVLEEIRRRGAPEEIERIIRRVIEVIREILDLVRKVNKKALRVLEMSCAQESRVNKKAVDAIDELAK

SEQ ID NO: 1029 - protein, 237 aa, Artificial Sequence; identical to SEQ ID NO: 1025
  Synthetic sequence.

SEQ ID NO: 1030 - protein, 240 aa, Artificial Sequence; identical to SEQ ID NO: 1026
  Synthetic sequence.

SEQ ID NO: 1031 - protein, 243 aa, Artificial Sequence
  Synthetic sequence.
DEDRRLEDAVAKLRKEHADIMKKLDDIMRELDEDHARIKERLDRILEELKALLTRVLRETREDELLRKVLELLTRLLKLLADVLEENKRLLEDILRLLKELIETNLRLLEEILALLRKVARGPVSEEEAKRLVEEITRLLEASTEEARKLVETIKRLLEESLDKLRSLVEEIERRLRTVLEEIRRRGAPEEIERIIRRVIEVIREILDLVRKVNKKALRLIMSCAQESARVNKKAVDAIDELA

SEQ ID NO: 1032 - protein, 244 aa, Artificial Sequence; identical to SEQ ID NO: 1028
  Synthetic sequence.

SEQ ID NO: 1033 - protein, 225 aa, Artificial Sequence
  Synthetic sequence.
DEVEELLKRVRELLKASEELVRKILEDVKRLLERSIEEVEDLLRKVEELLKRLLDLVERGGSLDEILRELVRLLKEIVRKVLELNRKLVEDVIRIAKRLLELNAESVKEWDRILKLLRDGTGDKEELLKDAEEALEKYERAVREILKELEEIIKEYVRRVEELLKELKDAVDKAKDEVRKGSGDEDLIRDVDRVLKEIMDLLAMSCAQESELLEELLRLLEELVR

SEQ ID NO: 1034 - protein, 231 aa, Artificial Sequence
  Synthetic sequence.
DEVEELLKRVRELLKASEELVRKILEDVKRLLERSIEEVEDLLRKVEELLKRLLDLVERGGSLDEILRELVRLLKEIVRKVLELNRKLVEDVIRIAKRLLELNAESVKEWDRILKLLRDGTGDKEELLKDAEEALEKYERAVREILKELEEIIKEYVRRVEELLKELKDAVDKAKDEVRKGSGDEDLIRDVDRVLKEIMDLLRDLVRLTMSCAQESLRLLEELVRAHKELV

SEQ ID NO: 1035 - protein, 232 aa, Artificial Sequence
  Synthetic sequence.
DEVEELLKRVRELLKASEELVRKILEDVKRLLERSIEEVEDLLRKVEELLKRLLDLVERGGSLDEILRELVRLLKEIVRKVLELNRKLVEDVIRIAKRLLELNAESVKEWDRILKLLRDGTGDKEELLKDAEEALEKYERAVREILKELEEIIKEYVRRVEELLKELKDAVDKAKDEVRKGSGDEDLIRDVDRVLKEIMDLLRDLVRRLVMSCAQESRLLEELVRAHKELVR

SEQ ID NO: 1036 - protein, 236 aa, Artificial Sequence
  Synthetic sequence.
DEVEELLKRVRELLKASEELVRKILEDVKRLLERSIEEVEDLLRKVEELLKRLLDLVERGGSLDEILRELVRLLKEIVRKVLELNRKLVEDVIRIAKRLLELNAESVKEWDRILKLLRDGTGDKEELLKDAEEALEKYERAVREILKELEEIIKEYVRRVEELLKELKDAVDKAKDEVRKGSGDEDLIRDVDRVLKEIMDLLRDLVRRTKELLLMSCAQESELVRAHKELVRSILD

SEQ ID NO: 1037 - protein, 225 aa, Artificial Sequence; identical to SEQ ID NO: 1033
  Synthetic sequence.

SEQ ID NO: 1038 - protein, 236 aa, Artificial Sequence
  Synthetic sequence.
DEVEELLKRVRELLKASEELVRKILEDVKRLLERSIEEVEDLLRKVEELLKRLLDLVERGGSLDEILRELVRLLKEIVRKVLELNRKLVEDVIRIAKRLLELNAESVKEWDRILKLLRDGTGDKEELLKDAEEALEKYERAVREILKELEEIIKEYVRRVEELLKELKDAVDKAKDEVRKGSGDEDLIRDVDRVLKEIMDLLRDLVRRTKELLEMSCAQESELVRAHKELVRSILD

SEQ ID NO: 1039 - protein, 239 aa, Artificial Sequence
  Synthetic sequence.
DEVEELLKRVRELLKASEELVRKILEDVKRLLERSIEEVEDLLRKVEELLKRLLDLVERGGSLDEILRELVRLLKEIVRKVLELNRKLVEDVIRIAKRLLELNAESVKEWDRILKLLRDGTGDKEELLKDAEEALEKYERAVREILKELEEIIKEYVRRVEELLKELKDAVDKAKDEVRKGSGDEDLIRDVDRVLKEIMDLLRDLVRRTKELLEELLMSCAQESRAHKELVRSILDEIR

SEQ ID NO: 1040 - protein, 235 aa, Artificial Sequence
  Synthetic sequence.
SEAEELLRELEELLKKSEKVLEDLLRKNAELIKDSKARLDEVRRKVEKLAEEVEEVIRRGVSEEELIRVIKKVLDDLRSIIKELIEVSRKYLRTTLELVKELLDVSRDVLREVLRIIKALLDTGGKDGSEEKIKEIADVADEIRKLAEEDIRLIKKLLEESAKLVDEDVRKLEEIAKEITELVERLRRTGDKDAVRKLIEELKKLLEDLVELIMSCAQESHERLKALLDHHRELL

SEQ ID NO: 1041 - protein, 236 aa, Artificial Sequence
  Synthetic sequence.
SEAEELLRELEELLKKSEKVLEDLLRKNAELIKDSKARLDEVRRKVEKLAEEVEEVIRRGVSEEELIRVIKKVLDDLRSIIKELIEVSRKYLRTTLELVKELLDVSRDVLREVLRIIKALLDTGGKDGSEEKIKEIADVADEIRKLAEEDIRLIKKLLEESAKLVDEDVRKLEEIAKEITELVERLRRTGDKDAVRKLIEELKKLLEDLVEHLEMSCAQESERLKALLDHHRELLK

SEQ ID NO: 1042 - protein, 239 aa, Artificial Sequence
  Synthetic sequence.
SEAEELLRELEELLKKSEKVLEDLLRKNAELIKDSKARLDEVRRKVEKLAEEVEEVIRRGVSEEELIRVIKKVLDDLRSIIKELIEVSRKYLRTTLELVKELLDVSRDVLREVLRIIKALLDTGGKDGSEEKIKEIADVADEIRKLAEEDIRLIKKLLEESAKLVDEDVRKLEEIAKEITELVERLRRTGDKDAVRKLIEELKKLLEDLVEHHERLLMSCAQESKALLDHHRELLKTVL

SEQ ID NO: 1043 - protein, 235 aa, Artificial Sequence; identical to SEQ ID NO: 1040
  Synthetic sequence.

SEQ ID NO: 1044 - protein, 236 aa, Artificial Sequence; identical to SEQ ID NO: 1041
  Synthetic sequence.

SEQ ID NO: 1045 - protein, 239 aa, Artificial Sequence; identical to SEQ ID NO: 1042
  Synthetic sequence.

SEQ ID NO: 1046 - protein, 230 aa, Artificial Sequence
  Synthetic sequence.
DEEELLRRVTEELKRLLDEARKLHEDVKRELEKLLKENDDLLADVKRKLESLLEALKRGSGTADEVIERILRLVEELLKRHAETVERILKLVRDLLRLHEKLVKEILDLLTRLLELLERRGGSGNSEKVDALKKLAKSVVDEVERSLEELRRLVEEVIKRIRDSLRASARIVKEAVRELRELLRDGRDADKLLERIRALLETLLEVLLMSCAQESRILEELLRVAEENLR

SEQ ID NO: 1047 - protein, 236 aa, Artificial Sequence
  Synthetic sequence.
DEEELLRRVTEELKRLLDEARKLHEDVKRELEKLLKENDDLLADVKRKLESLLEALKRGSGTADEVIERILRLVEELLKRHAETVERILKLVRDLLRLHEKLVKEILDLLTRLLELLERRGGSGNSEKVDALKKLAKSVVDEVERSLEELRRLVEEVIKRIRDSLRASARIVKEAVRELRELLRDGRDADKLLERIRALLETLLEVLKRDNELIMSCAQESLRVAEENLRRIKEII

SEQ ID NO: 1048 - protein, 241 aa, Artificial Sequence
  Synthetic sequence.
DEEELLRRVTEELKRLLDEARKLHEDVKRELEKLLKENDDLLADVKRKLESLLEALKRGSGTADEVIERILRLVEELLKRHAETVERILKLVRDLLRLHEKLVKEILDLLTRLLELLERRGGSGNSEKVDALKKLAKSVVDEVERSLEELRRLVEEVIKRIRDSLRASARIVKEAVRELRELLRDGRDADKLLERIRALLETLLEVLKRDNEEIKRILEMSCAQESENLRRIKEIIDRLLD

SEQ ID NO: 1049 - protein, 244 aa, Artificial Sequence
  Synthetic sequence.
DEEELLRRVTEELKRLLDEARKLHEDVKRELEKLLKENDDLLADVKRKLESLLEALKRGSGTADEVIERILRLVEELLKRHAETVERILKLVRDLLRLHEKLVKEILDLLTRLLELLERRGGSGNSEKVDALKKLAKSVVDEVERSLEELRRLVEEVIKRIRDSLRASARIVKEAVRELRELLRDGRDADKLLERIRALLETLLEVLKRDNEEIKRILEELLMSCAQESRRIKEIIDRLLDATR

SEQ ID NO: 1050 - protein, 230 aa, Artificial Sequence
  Synthetic sequence.
DEEELLRRVTEELKRLLDEARKLHEDVKRELEKLLKENDDLLADVKRKLESLLEALKRGSGTADEVIERILRLVEELLKRHAETVERILKLVRDLLRLHEKLVKEILDLLTRLLELLERRGGSGNSEKVDALKKLAKSVVDEVERSLEELRRLVEEVIKRIRDSLRASARIVKEAVRELRELLRDGRDADKLLERIRALLETLLEVLKMSCAQESRILEELLRVAEENLR

SEQ ID NO: 1051 - protein, 236 aa, Artificial Sequence; identical to SEQ ID NO: 1047
  Synthetic sequence.

SEQ ID NO: 1052 - protein, 240 aa, Artificial Sequence
  Synthetic sequence.
DEEELLRRVTEELKRLLDEARKLHEDVKRELEKLLKENDDLLADVKRKLESLLEALKRGSGTADEVIERILRLVEELLKRHAETVERILKLVRDLLRLHEKLVKEILDLLTRLLELLERRGGSGNSEKVDALKKLAKSVVDEVERSLEELRRLVEEVIKRIRDSLRASARIVKEAVRELRELLRDGRDADKLLERIRALLETLLEVLKRDNEEIKRLIMSCAQESEENLRRIKEIIDRLL

SEQ ID NO: 1053 - protein, 241 aa, Artificial Sequence; identical to SEQ ID NO: 1048
  Synthetic sequence.

SEQ ID NO: 1054 - protein, 244 aa, Artificial Sequence; identical to SEQ ID NO: 1049
  Synthetic sequence.

SEQ ID NO: 1055 - protein, 234 aa, Artificial Sequence
  Synthetic sequence.
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDLAMSCAQESREVERIVRELAKRSD

SEQ ID NO: 1056 - protein, 237 aa, Artificial Sequence
  Synthetic sequence.
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDVKKLAMSCAQESERIVRELAKRSDEIL

SEQ ID NO: 1057 - protein, 241 aa, Artificial Sequence
  Synthetic sequence.
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDVKKASEDLVMSCAQESRELAKRSDEILKKLE

SEQ ID NO: 1058 - protein, 244 aa, Artificial Sequence
  Synthetic sequence.
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDVKKASEDIVRLQMSCAQESAKRSDEILKKLEDIV

SEQ ID NO: 1059 - protein, 245 aa, Artificial Sequence
  Synthetic sequence.
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDVKKASEDIVRELLMSCAQESKRSDEILKKLEDIVE

SEQ ID NO: 1060 - protein, 248 aa, Artificial Sequence
  Synthetic sequence.
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDVKKASEDIVREVERLVMSCAQESDEILKKLEDIVEKLR

SEQ ID NO: 1061 - protein, 234 aa, Artificial Sequence
  Synthetic sequence.
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDLRMSCAQESREVERIVRELAKRSD

SEQ ID NO: 1062 - protein, 237 aa, Artificial Sequence
  Synthetic sequence.
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDVKKLSMSCAQESERIVRELAKRSDEIL

SEQ ID NO: 1063 - protein, 238 aa, Artificial Sequence
  Synthetic sequence.
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDVKKALKMSCAQESRIVRELAKRSDEILK

SEQ ID NO: 1064 - protein, 241 aa, Artificial Sequence; identical to SEQ ID NO: 1057
  Synthetic sequence.

SEQ ID NO: 1065 - protein, 244 aa, Artificial Sequence
  Synthetic sequence.
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDVKKASEDIVRLVMSCAQESAKRSDEILKKLEDIV

SEQ ID NO: 1066 - protein, 245 aa, Artificial Sequence
  Synthetic sequence.
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDVKKASEDIVRELQMSCAQESKRSDEILKKLEDIVE

SEQ ID NO: 1067 - protein, 248 aa, Artificial Sequence; identical to SEQ ID NO: 1060
  Synthetic sequence.

SEQ ID NO: 1068 - protein, 232 aa, Artificial Sequence
  Synthetic sequence.
DKDKRLEELLKRLKELNDKTFEELERILEELKRANEASLREAERILEELRARIEGGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKDIIRTILEVARDLLRLLEEDSRTLAMSCAQESDLLREDSKANSEVVK

SEQ ID NO: 1069 - protein, 236 aa, Artificial Sequence
  Synthetic sequence.
DKDKRLEELLKRLKELNDKTFEELERILEELKRANEASLREAERILEELRARIEGGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKDIIRTILEVARDLLRLLEEDSRTNSEVLKMSCAQESEDSKANSEVVKRLLD

SEQ ID NO: 1070 - protein, 239 aa, Artificial Sequence
  Synthetic sequence.
DKDKRLEELLKRLKELNDKTFEELERILEELKRANEASLREAERILEELRARIEGGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKDIIRTILEVARDLLRLLEEDSRTNSEVVKRLKMSCAQESKANSEVVKRLLDVLR

SEQ ID NO: 1071 - protein, 232 aa, Artificial Sequence
  Synthetic sequence.
DKDKRLEELLKRLKELNDKTFEELERILEELKRANEASLREAERILEELRARIEGGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKDIIRTILEVARDLLRLLEEDSRTLSMSCAQESDLLREDSKANSEVVK

SEQ ID NO: 1072 - protein, 235 aa, Artificial Sequence
  Synthetic sequence.
DKDKRLEELLKRLKELNDKTFEELERILEELKRANEASLREAERILEELRARIEGGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKDIIRTILEVARDLLRLLEEDSRTNSELAMSCAQESREDSKANSEVVKRLL

SEQ ID NO: 1073 - protein, 232 aa, Artificial Sequence
  Synthetic sequence.
SKEETLKRLLDELEKRNRETVERLERLLKELEDRNRASLEELEAVLEELERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELLAMSCAQESELLKEDSKLNLDVAR

SEQ ID NO: 1074 - protein, 236 aa, Artificial Sequence
  Synthetic sequence.
SKEETLKRLLDELEKRNRETVERLERLLKELEDRNRASLEELEAVLEELERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELNLDVLRMSCAQESEDSKLNLDVARELLE

SEQ ID NO: 1075 - protein, 238 aa, Artificial Sequence
  Synthetic sequence.
SKEETLKRLLDELEKRNRETVERLERLLKELEDRNRASLEELEAVLEELERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELNLDVAKLLMSCAQESSKLNLDVARELLELL

SEQ ID NO: 1076 - protein, 239 aa, Artificial Sequence
  Synthetic sequence.
SKEETLKRLLDELEKRNRETVERLERLLKELEDRNRASLEELEAVLEELERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELNLDVAKKLAMSCAQESKLNLDVARELLELLD

SEQ ID NO: 1077 - protein, 225 aa, Artificial Sequence
  Synthetic sequence.
SKEETLKRLLDELEKRNRETVERLERLLKELEDRNRASLEELEAVLEELERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRMSCAQESDVAKKLLELLKEDSK

SEQ ID NO: 1078 - protein, 232 aa, Artificial Sequence
  Synthetic sequence.
SKEETLKRLLDELEKRNRETVERLERLLKELEDRNRASLEELEAVLEELERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELLLMSCAQESELLKEDSKLNLDVAR

SEQ ID NO: 1079 - protein, 235 aa, Artificial Sequence
  Synthetic sequence.
SKEETLKRLLDELEKRNRETVERLERLLKELEDRNRASLEELEAVLEELERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELNLDLAMSCAQESKEDSKLNLDVARELL

SEQ ID NO: 1080 - protein, 236 aa, Artificial Sequence
  Synthetic sequence.
SKEETLKRLLDELEKRNRETVERLERLLKELEDRNRASLEELEAVLEELERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELNLDVLYMSCAQESEDSKLNLDVARELLE

SEQ ID NO: 1081 - protein, 238 aa, Artificial Sequence
  Synthetic sequence.
SKEETLKRLLDELEKRNRETVERLERLLKELEDRNRASLEELEAVLEELERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELNLDVAKLAMSCAQESSKLNLDVARELLELL

SEQ ID NO: 1082 - protein, 239 aa, Artificial Sequence
  Synthetic sequence.
SKEETLKRLLDELEKRNRETVERLERLLKELEDRNRASLEELEAVLEELERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELNLDVAKKLKMSCAQESKLNLDVARELLELLD

SEQ ID NO: 1083 - protein, 228 aa, Artificial Sequence
  Synthetic sequence.
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEEARRRLEELLRELNELTMSCAQESEKLLRDLNELTKALE

SEQ ID NO: 1084 - protein, 235 aa, Artificial Sequence
  Synthetic sequence.
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEEARRRLEELLRELNEITKDLEALLMSCAQESNELTKALEEELKRLL

SEQ ID NO: 1085 - protein, 236 aa, Artificial Sequence
  Synthetic sequence.
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEEARRRLEELLRELNEITKDLEAKLKMSCAQESELTKALEEELKRLLD

SEQ ID NO: 1086 - protein, 239 aa, Artificial Sequence
  Synthetic sequence.
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEEARRRLEELLRELNEITKDLEAKLEKLLMSCAQESKALEEELKRLLDELK

SEQ ID NO: 1087 - protein, 242 aa, Artificial Sequence
  Synthetic sequence.
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEEARRRLEELLRELNEITKDLEAKLEKLLRLLMSCAQESEEELKRLLDELKKRT

SEQ ID NO: 1088 - protein, 243 aa, Artificial Sequence
  Synthetic sequence.
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEEARRRLEELLRELNEITKDLEAKLEKLLRDLAMSCAQESEELKRLLDELKKRTD

SEQ ID NO: 1089 - protein, 228 aa, Artificial Sequence
  Synthetic sequence.
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEEARRRLEELLRELNELAMSCAQESEKLLRDLNELTKALE

SEQ ID NO: 1090 - protein, 232 aa, Artificial Sequence
  Synthetic sequence.
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEEARRRLEELLRELNEITKDLEMSCAQESRDLNELTKALEEELK

SEQ ID NO: 1091 - protein, 235 aa, Artificial Sequence
  Synthetic sequence.
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEEARRRLEELLRELNEITKDLEALMMSCAQESNELTKALEEELKRLL

SEQ ID NO: 1092 - protein, 239 aa, Artificial Sequence; identical to SEQ ID NO: 1086
  Synthetic sequence.

SEQ ID NO: 1093 - protein, 242 aa, Artificial Sequence; identical to SEQ ID NO: 1087
  Synthetic sequence.

SEQ ID NO: 1094 - protein, 243 aa, Artificial Sequence; identical to SEQ ID NO: 1088
  Synthetic sequence.

SEQ ID NO: 1095 - protein, 235 aa, Artificial Sequence
  Synthetic sequence.
SEAERTKESLKKVLKALVDLNRELLRKLEENMRELTKLNEEVKRALKEVLDKVREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRKIVEEILKEIKELADRYREEVRKLKMSCAQESEDYKRKVDELKERLR

SEQ ID NO: 1096 - protein, 239 aa, Artificial Sequence
  Synthetic sequence.
SEAERTKESLKKVLKALVDLNRELLRKLEENMRELTKLNEEVKRALKEVLDKVREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRKIVEEILKEIKELADRYREEVRKSKDKLRMSCAQESRKVDELKERLRELIE

SEQ ID NO: 1097 - protein, 239 aa, Artificial Sequence; identical to SEQ ID NO: 1096
  Synthetic sequence.

SEQ ID NO: 1098 - protein, 224 aa, Artificial Sequence
  Synthetic sequence.
SEVEDILRRLAELNKRLIDKLRELIDRIARLNEELLRVVEDILSRLKRLADELIRVVRERGDIPEELLRKLEEELKKIVDELRRLVEEYEKALRDLIKELRKAVEEYRRTLAELVERLRRLEGPEELLKDLAEDVSRNIKAVEEVIRRFEKNVEDNIEVVRRLVDALEKLVRRLESVLRGKGSDEDLKRLLEKLKEDVERLLMSCAQESAESLKHLEDVIRELE

SEQ ID NO: 1099 - protein, 231 aa, Artificial Sequence
  Synthetic sequence.
SEVEDILRRLAELNKRLIDKLRELIDRIARLNEELLRVVEDILSRLKRLADELIRVVRERGDIPEELLRKLEEELKKIVDELRRLVEEYEKALRDLIKELRKAVEEYRRTLAELVERLRRLEGPEELLKDLAEDVSRNIKAVEEVIRRFEKNVEDNIEVVRRLVDALEKLVRRLESVLRGKGSDEDLKRLLEKLKEDVERVLKEVRDLTMSCAQESEDVIRELEKKTEDSL

SEQ ID NO: 1100 - protein, 235 aa, Artificial Sequence
  Synthetic sequence.
SEVEDILRRLAELNKRLIDKLRELIDRIARLNEELLRVVEDILSRLKRLADELIRVVRERGDIPEELLRKLEEELKKIVDELRRLVEEYEKALRDLIKELRKAVEEYRRTLAELVERLRRLEGPEELLKDLAEDVSRNIKAVEEVIRRFEKNVEDNIEVVRRLVDALEKLVRRLESVLRGKGSDEDLKRLLEKLKEDVERVLKEVRDRTAELLMSCAQESRELEKKTEDSLRHME

SEQ ID NO: 1101 - protein, 238 aa, Artificial Sequence
  Synthetic sequence.
SEVEDILRRLAELNKRLIDKLRELIDRIARLNEELLRVVEDILSRLKRLADELIRVVRERGDIPEELLRKLEEELKKIVDELRRLVEEYEKALRDLIKELRKAVEEYRRTLAELVERLRRLEGPEELLKDLAEDVSRNIKAVEEVIRRFEKNVEDNIEVVRRLVDALEKLVRRLESVLRGKGSDEDLKRLLEKLKEDVERVLKEVRDRTAESLKLAMSCAQESEKKTEDSLRHMEERR

SEQ ID NO: 1102 - protein, 224 aa, Artificial Sequence; identical to SEQ ID NO: 1098
  Synthetic sequence.

SEQ ID NO: 1103 - protein, 231 aa, Artificial Sequence; identical to SEQ ID NO: 1099
  Synthetic sequence.

SEQ ID NO: 1104 - protein, 235 aa, Artificial Sequence; identical to SEQ ID NO: 1100
  Synthetic sequence.

SEQ ID NO: 1105 - protein, 238 aa, Artificial Sequence
  Synthetic sequence.
SEVEDILRRLAELNKRLIDKLRELIDRIARLNEELLRVVEDILSRLKRLADELIRVVRERGDIPEELLRKLEEELKKIVDELRRLVEEYEKALRDLIKELRKAVEEYRRTLAELVERLRRLEGPEELLKDLAEDVSRNIKAVEEVIRRFEKNVEDNIEVVRRLVDALEKLVRRLESVLRGKGSDEDLKRLLEKLKEDVERVLKEVRDRTAESLKLLMSCAQESEKKTEDSLRHMEERR

SEQ ID NO: 1106 - protein, 228 aa, Artificial Sequence
  Synthetic sequence.
DEERIIKTLEDINAKLVEDIKRILDKVAELNERLADAIRKILEETKRILEATTRKVRKDGEISEELLRRLEEKLRKLLEDLERVLAEHEDESRRILEEVERLLKRHADASKELLDRARSVARGVKSDKELVDRLKKLIDDSLESVRELIERLKELLDRLVKSVEDLIRTIKELLDRLVEVLREGVSDKDTLRTVEKLVEDVKRRLDMSCAQESRLIEEVKKELDKLLK

SEQ ID NO: 1107 - protein, 231 aa, Artificial Sequence
  Synthetic sequence.
DEERIIKTLEDINAKLVEDIKRILDKVAELNERLADAIRKILEETKRILEATTRKVRKDGEISEELLRRLEEKLRKLLEDLERVLAEHEDESRRILEEVERLLKRHADASKELLDRARSVARGVKSDKELVDRLKKLIDDSLESVRELIERLKELLDRLVKSVEDLIRTIKELLDRLVEVLREGVSDKDTLRTVEKLVEDVKRRLDKLGMSCAQESEEVKKELDKLLKEYE

SEQ ID NO: 1108 - protein, 235 aa, Artificial Sequence
  Synthetic sequence.
DEERIIKTLEDINAKLVEDIKRILDKVAELNERLADAIRKILEETKRILEATTRKVRKDGEISEELLRRLEEKLRKLLEDLERVLAEHEDESRRILEEVERLLKRHADASKELLDRARSVARGVKSDKELVDRLKKLIDDSLESVRELIERLKELLDRLVKSVEDLIRTIKELLDRLVEVLREGVSDKDTLRTVEKLVEDVKRRLDKLLEDLKMSCAQESKELDKLLKEYEDALR

SEQ ID NO: 1109 - protein, 238 aa, Artificial Sequence
  Synthetic sequence.
DEERIIKTLEDINAKLVEDIKRILDKVAELNERLADAIRKILEETKRILEATTRKVRKDGEISEELLRRLEEKLRKLLEDLERVLAEHEDESRRILEEVERLLKRHADASKELLDRARSVARGVKSDKELVDRLKKLIDDSLESVRELIERLKELLDRLVKSVEDLIRTIKELLDRLVEVLREGVSDKDTLRTVEKLVEDVKRRLDKLLEDYKRLMMSCAQESDKLLKEYEDALREIK

SEQ ID NO: 1110 - protein, 242 aa, Artificial Sequence
  Synthetic sequence.
DEERIIKTLEDINAKLVEDIKRILDKVAELNERLADAIRKILEETKRILEATTRKVRKDGEISEELLRRLEEKLRKLLEDLERVLAEHEDESRRILEEVERLLKRHADASKELLDRARSVARGVKSDKELVDRLKKLIDDSLESVRELIERLKELLDRLVKSVEDLIRTIKELLDRLVEVLREGVSDKDTLRTVEKLVEDVKRRLDKLLEDYKRLIEELKMSCAQESKEYEDALREIKKRID

SEQ ID NO: 1111 - protein, 228 aa, Artificial Sequence; identical to SEQ ID NO: 1106
  Synthetic sequence.

SEQ ID NO: 1112 - protein, 231 aa, Artificial Sequence; identical to SEQ ID NO: 1107
  Synthetic sequence.

SEQ ID NO: 1113 - protein, 235 aa, Artificial Sequence; identical to SEQ ID NO: 1108
  Synthetic sequence.

SEQ ID NO: 1114 - protein, 239 aa, Artificial Sequence
  Synthetic sequence.
DEERIIKTLEDINAKLVEDIKRILDKVAELNERLADAIRKILEETKRILEATTRKVRKDGEISEELLRRLEEKLRKLLEDLERVLAEHEDESRRILEEVERLLKRHADASKELLDRARSVARGVKSDKELVDRLKKLIDDSLESVRELIERLKELLDRLVKSVEDLIRTIKELLDRLVEVLREGVSDKDTLRTVEKLVEDVKRRLDKLLEDYKRLLEMSCAQESKLLKEYEDALREIKK

SEQ ID NO: 1115 - protein, 242 aa, Artificial Sequence; identical to SEQ ID NO: 1110
  Synthetic sequence.

SEQ ID NO: 1116 - protein, 217 aa, Artificial Sequence
  Synthetic sequence.
TEEEVVEDVKRVLDESHDDLRRLIETLTRVLRESLKRIKEALEELERVLKKLLDLLEGGRDAREVLDEIRKVLERLREVIEELLRINKEVLRELERVIRELLKKNEDLARRVRSGVKSRLLEVLERLARESLELNRAILEELRKLVEKSLRAVEKILKRLEEIVRKLLKLVEDGGPREEVKRVLEEARDELRRLLMSCAQESEELERELERLLREHR

SEQ ID NO: 1117 - protein, 221 aa, Artificial Sequence
  Synthetic sequence.
TEEEVVEDVKRVLDESHDDLRRLIETLTRVLRESLKRIKEALEELERVLKKLLDLLEGGRDAREVLDEIRKVLERLREVIEELLRINKEVLRELERVIRELLKKNEDLARRVRSGVKSRLLEVLERLARESLELNRAILEELRKLVEKSLRAVEKILKRLEEIVRKLLKLVEDGGPREEVKRVLEEARDELRRLLEELKMSCAQESRELERLLREHREVIR

SEQ ID NO: 1118 - protein, 224 aa, Artificial Sequence
  Synthetic sequence.
TEEEVVEDVKRVLDESHDDLRRLIETLTRVLRESLKRIKEALEELERVLKKLLDLLEGGRDAREVLDEIRKVLERLREVIEELLRINKEVLRELERVIRELLKKNEDLARRVRSGVKSRLLEVLERLARESLELNRAILEELRKLVEKSLRAVEKILKRLEEIVRKLLKLVEDGGPREEVKRVLEEARDELRRLLEEYKALVMSCAQESERLLREHREVIRRIK

SEQ ID NO: 1119 - protein, 231 aa, Artificial Sequence
  Synthetic sequence.
TEEEVVEDVKRVLDESHDDLRRLIETLTRVLRESLKRIKEALEELERVLKKLLDLLEGGRDAREVLDEIRKVLERLREVIEELLRINKEVLRELERVIRELLKKNEDLARRVRSGVKSRLLEVLERLARESLELNRAILEELRKLVEKSLRAVEKILKRLEEIVRKLLKLVEDGGPREEVKRVLEEARDELRRLLEEYKAIIEELERLLMSCAQESREVIRRIKEEIDKSS

SEQ ID NO: 1120 - protein, 217 aa, Artificial Sequence; identical to SEQ ID NO: 1116
  Synthetic sequence.

SEQ ID NO: 1121 - protein, 221 aa, Artificial Sequence; identical to SEQ ID NO: 1117
  Synthetic sequence.

SEQ ID NO: 1122 - protein, 224 aa, Artificial Sequence; identical to SEQ ID NO: 1118
  Synthetic sequence.

SEQ ID NO: 1123 - protein, 228 aa, Artificial Sequence
  Synthetic sequence.
TEEEVVEDVKRVLDESHDDLRRLIETLTRVLRESLKRIKEALEELERVLKKLLDLLEGGRDAREVLDEIRKVLERLREVIEELLRINKEVLRELERVIRELLKKNEDLARRVRSGVKSRLLEVLERLARESLELNRAILEELRKLVEKSLRAVEKILKRLEEIVRKLLKLVEDGGPREEVKRVLEEARDELRRLLEEYKAIIEELEMSCAQESREHREVIRRIKEEID

SEQ ID NO: 1124 - protein, 231 aa, Artificial Sequence; identical to SEQ ID NO: 1119
  Synthetic sequence.

SEQ ID NO: 1125 - protein, 219 aa, Artificial Sequence
  Synthetic sequence.
SEVERAVEDVKRALEENVRLSKELVDRVTKMAEDNVKLTKDIVDKVRRILEELVEVIERGGSDDTRRELIDKARRLLRKLRDELKESLDDARRLLEDIKRLIEESVKRLRDLLEKIRREKSLPEDLLRLLREVLEELKKINDELLDAVRRVLENSARVLETLLKLIEDVLRELERVTDKDEVRKIVRELVEEAKKLAMSCAQESKRVVEELKRVVKRDA

SEQ ID NO: 1126 - protein, 222 aa, Artificial Sequence
  Synthetic sequence.
SEVERAVEDVKRALEENVRLSKELVDRVTKMAEDNVKLTKDIVDKVRRILEELVEVIERGGSDDTRRELIDKARRLLRKLRDELKESLDDARRLLEDIKRLIEESVKRLRDLLEKIRREKSLPEDLLRLLREVLEELKKINDELLDAVRRVLENSARVLETLLKLIEDVLRELERVTDKDEVRKIVRELVEEAKKVVELAMSCAQESVEELKRVVKRDADVV

SEQ ID NO: 1127 - protein, 223 aa, Artificial Sequence
  Synthetic sequence.
SEVERAVEDVKRALEENVRLSKELVDRVTKMAEDNVKLTKDIVDKVRRILEELVEVIERGGSDDTRRELIDKARRLLRKLRDELKESLDDARRLLEDIKRLIEESVKRLRDLLEKIRREKSLPEDLLRLLREVLEELKKINDELLDAVRRVLENSARVLETLLKLIEDVLRELERVTDKDEVRKIVRELVEEAKKVVEYLAMSCAQESEELKRVVKRDADVVR

SEQ ID NO: 1128 - protein, 226 aa, Artificial Sequence
  Synthetic sequence.
SEVERAVEDVKRALEENVRLSKELVDRVTKMAEDNVKLTKDIVDKVRRILEELVEVIERGGSDDTRRELIDKARRLLRKLRDELKESLDDARRLLEDIKRLIEESVKRLRDLLEKIRREKSLPEDLLRLLREVLEELKKINDELLDAVRRVLENSARVLETLLKLIEDVLRELERVTDKDEVRKIVRELVEEAKKVVEYDTELAMSCAQESKRVVKRDADVVRKLV

SEQ ID NO: 1129 - protein, 230 aa, Artificial Sequence
  Synthetic sequence.
SEVERAVEDVKRALEENVRLSKELVDRVTKMAEDNVKLTKDIVDKVRRILEELVEVIERGGSDDTRRELIDKARRLLRKLRDELKESLDDARRLLEDIKRLIEESVKRLRDLLEKIRREKSLPEDLLRLLREVLEELKKINDELLDAVRRVLENSARVLETLLKLIEDVLRELERVTDKDEVRKIVRELVEEAKKVVEYDTENAKRLHMSCAQESKRDADVVRKLVELLD

SEQ ID NO: 1130 - protein, 234 aa, Artificial Sequence
  Synthetic sequence.
SEVERAVEDVKRALEENVRLSKELVDRVTKMAEDNVKLTKDIVDKVRRILEELVEVIERGGSDDTRRELIDKARRLLRKLRDELKESLDDARRLLEDIKRLIEESVKRLRDLLEKIRREKSLPEDLLRLLREVLEELKKINDELLDAVRRVLENSARVLETLLKLIEDVLRELERVTDKDEVRKIVRELVEEAKKVVEYDTENAKRVVEELKMSCAQESDVVRKLVELLDRKAR

SEQ ID NO: 1131 - protein, 219 aa, Artificial Sequence
  Synthetic sequence.
SEVERAVEDVKRALEENVRLSKELVDRVTKMAEDNVKLTKDIVDKVRRILEELVEVIERGGSDDTRRELIDKARRLLRKLRDELKESLDDARRLLEDIKRLIEESVKRLRDLLEKIRREKSLPEDLLRLLREVLEELKKINDELLDAVRRVLENSARVLETLLKLIEDVLRELERVTDKDEVRKIVRELVEEAKKLVMSCAQESKRVVEELKRVVKRDA

SEQ ID NO: 1132 - protein, 222 aa, Artificial Sequence; identical to SEQ ID NO: 1126
  Synthetic sequence.

SEQ ID NO: 1133 - protein, 226 aa, Artificial Sequence; identical to SEQ ID NO: 1128
  Synthetic sequence.

SEQ ID NO: 1134 - protein, 234 aa, Artificial Sequence; identical to SEQ ID NO: 1130
  Synthetic sequence.

SEQ ID NO: 1135 - protein, 225 aa, Artificial Sequence
  Synthetic sequence.
SLEEIVKKLEDLNKKAVEILRRVLEEHEKLVEKVKKVLRDVLRLLEKVVREVIETLKKGDTDEKTREALKELEEVVRKIKEEVEKVLKRLEEVSKRLKDEVRRVLKESEDVAKKIRRDVRGVRSEDAAKRATDLLKETLTILEEAIRRIVKVIEDSLEILREAVEAIVRLLEELLSILARIGLDEEVLRKLKEIIKELKDRLIMSCAQESRIIDELRAELERVLR

SEQ ID NO: 1136 - protein, 232 aa, Artificial Sequence
  Synthetic sequence.
SLEEIVKKLEDLNKKAVEILRRVLEEHEKLVEKVKKVLRDVLRLLEKVVREVIETLKKGDTDEKTREALKELEEVVRKIKEEVEKVLKRLEEVSKRLKDEVRRVLKESEDVAKKIRRDVRGVRSEDAAKRATDLLKETLTILEEAIRRIVKVIEDSLEILREAVEAIVRLLEELLSILARIGLDEEVLRKLKEIIKELKDRLKKLLDDLAMSCAQESAELERVLREYEKILE

SEQ ID NO: 1137 - protein, 235 aa, Artificial Sequence
  Synthetic sequence.
SLEEIVKKLEDLNKKAVEILRRVLEEHEKLVEKVKKVLRDVLRLLEKVVREVIETLKKGDTDEKTREALKELEEVVRKIKEEVEKVLKRLEEVSKRLKDEVRRVLKESEDVAKKIRRDVRGVRSEDAAKRATDLLKETLTILEEAIRRIVKVIEDSLEILREAVEAIVRLLEELLSILARIGLDEEVLRKLKEIIKELKDRLKKLLDDYERLVMSCAQESERVLREYEKILEDLR

SEQ ID NO: 1138 - protein, 225 aa, Artificial Sequence; identical to SEQ ID NO: 1135
  Synthetic sequence.

SEQ ID NO: 1139 - protein, 232 aa, Artificial Sequence
  Synthetic sequence.
SLEEIVKKLEDLNKKAVEILRRVLEEHEKLVEKVKKVLRDVLRLLEKVVREVIETLKKGDTDEKTREALKELEEVVRKIKEEVEKVLKRLEEVSKRLKDEVRRVLKESEDVAKKIRRDVRGVRSEDAAKRATDLLKETLTILEEAIRRIVKVIEDSLEILREAVEAIVRLLEELLSILARIGLDEEVLRKLKEIIKELKDRLKKLLDDLKMSCAQESAELERVLREYEKILE

SEQ ID NO: 1140 - protein, 235 aa, Artificial Sequence; identical to SEQ ID NO: 1137
  Synthetic sequence.

SEQ ID NO: 1141 - protein, 238 aa, Artificial Sequence
  Synthetic sequence.
SLEEIVKKLEDLNKKAVEILRRVLEEHEKLVEKVKKVLRDVLRLLEKVVREVIETLKKGDTDEKTREALKELEEVVRKIKEEVEKVLKRLEEVSKRLKDEVRRVLKESEDVAKKIRRDVRGVRSEDAAKRATDLLKETLTILEEAIRRIVKVIEDSLEILREAVEAIVRLLEELLSILARIGLDEEVLRKLKEIIKELKDRLKKLLDDYERIIDLLMSCAQESLREYEKILEDLRKEL

SEQ ID NO: 1142 - protein, 226 aa, Artificial Sequence
  Synthetic sequence.
SADEALEELVRRLLEVLKTVLERTKELSRDDLRVVKEVLRIIEELVKRLLKVIRDGLDDADRVLEEVERVIREAKREVKRWEEVVRKVVEDSRRLIERVLAEVEEVIKEAKRLLDERKSGGSREVIEELLSLLREIVRHHKEVSDEHLKLSAELVKRILDVVEETLRLATEIVRRIKEGGNSEDVRRDIERLLEELKRRVERLLMSCAQESAELEKLNEDVLRENK

SEQ ID NO: 1143 - protein, 226 aa, Artificial Sequence; identical to SEQ ID NO: 1142
  Synthetic sequence.

SEQ ID NO: 1144 - protein, 240 aa, Artificial Sequence
  Synthetic sequence.
SADEALEELVRRLLEVLKTVLERTKELSRDDLRVVKEVLRIIEELVKRLLKVIRDGLDDADRVLEEVERVIREAKREVKRWEEVVRKVVEDSRRLIERVLAEVEEVIKEAKRLLDERKSGGSREVIEELLSLLREIVRHHKEVSDEHLKLSAELVKRILDVVEETLRLATEIVRRIKEGGNSEDVRRDIERLLEELKRRVERLLEDIERLLAELEKLIMSCAQESKALLEDLERRVRERK

SEQ ID NO: 1145 - protein, 350 aa, Artificial Sequence; identical to SEQ ID NO: 1
  Synthetic sequence.

SEQ ID NO: 1146 - protein, 350 aa, Artificial Sequence; identical to SEQ ID NO: 2
  Synthetic sequence.

SEQ ID NO: 1147 - protein, 350 aa, Artificial Sequence; identical to SEQ ID NO: 3
  Synthetic sequence.

SEQ ID NO: 1148 - protein, 347 aa, Artificial Sequence; identical to SEQ ID NO: 4
  Synthetic sequence.

SEQ ID NO: 1149 - protein, 343 aa, Artificial Sequence; identical to SEQ ID NO: 5
  Synthetic sequence.

SEQ ID NO: 1150 - protein, 228 aa, Artificial Sequence; identical to SEQ ID NO: 6
  Synthetic sequence.

SEQ ID NO: 1151 - protein, 225 aa, Artificial Sequence; identical to SEQ ID NO: 7
  Synthetic sequence.

SEQ ID NO: 1152 - protein, 232 aa, Artificial Sequence; identical to SEQ ID NO: 8
  Synthetic sequence.

SEQ ID NO: 1153 - protein, 229 aa, Artificial Sequence; identical to SEQ ID NO: 9
  Synthetic sequence.

SEQ ID NO: 1154 - protein, 359 aa, Artificial Sequence; identical to SEQ ID NO: 10
  Synthetic sequence.

SEQ ID NO: 1155 - protein, 353 aa, Artificial Sequence; identical to SEQ ID NO: 11
  Synthetic sequence.

SEQ ID NO: 1156 - protein, 288 aa, Artificial Sequence; identical to SEQ ID NO: 12
  Synthetic sequence.

SEQ ID NO: 1157 - protein, 283 aa, Artificial Sequence; identical to SEQ ID NO: 13
  Synthetic sequence.

SEQ ID NO: 1158 - protein, 280 aa, Artificial Sequence; identical to SEQ ID NO: 14
  Synthetic sequence.

SEQ ID NO: 1159 - protein, 277 aa, Artificial Sequence; identical to SEQ ID NO: 15
  Synthetic sequence.

SEQ ID NO: 1160 - protein, 353 aa, Artificial Sequence; identical to SEQ ID NO: 16
  Synthetic sequence.

SEQ ID NO: 1161 - protein, 349 aa, Artificial Sequence; identical to SEQ ID NO: 17
  Synthetic sequence.

SEQ ID NO: 1162 - protein, 353 aa, Artificial Sequence; identical to SEQ ID NO: 18
  Synthetic sequence.

SEQ ID NO: 1163 - protein, 349 aa, Artificial Sequence; identical to SEQ ID NO: 19
  Synthetic sequence.

SEQ ID NO: 1164 - protein, 229 aa, Artificial Sequence; identical to SEQ ID NO: 20
  Synthetic sequence.

SEQ ID NO: 1165 - protein, 225 aa, Artificial Sequence; identical to SEQ ID NO: 21
  Synthetic sequence.

SEQ ID NO: 1166 - protein, 233 aa, Artificial Sequence; identical to SEQ ID NO: 22
  Synthetic sequence.

SEQ ID NO: 1167 - protein, 229 aa, Artificial Sequence; identical to SEQ ID NO: 23
  Synthetic sequence.

SEQ ID NO: 1168 - protein, 353 aa, Artificial Sequence; identical to SEQ ID NO: 24
  Synthetic sequence.

SEQ ID NO: 1169 - protein, 353 aa, Artificial Sequence; identical to SEQ ID NO: 25
  Synthetic sequence.

SEQ ID NO: 1170 - protein, 36 aa, Artificial Sequence
  Synthetic sequence.
DEARKAIARVKRESKRIVEDAERLIREAAAASEKIS

SEQ ID NO: 1171 - protein, 40 aa, Artificial Sequence
  Synthetic sequence.
  MOD_RES (40)..(40): The residue at position 40 is biotinylated.
DEARKAIARVKRESKRIVEDAERLIREAAAASEKISGSGK

SEQ ID NO: 1172 - protein, 447 aa, Artificial Sequence
  Synthetic sequence.
MDPDEARKAIARVKRESKRIVEDAERLIREAAAASEKISREASSGLVPRGSHMKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELVKDPRIAATMENAQKGEIMPNIPQMSAFWYAVRTAVINAASGRQTVDEALKDAQTNSSGSGLNDIFEAQKIEWHELEHHHHHH

SEQ ID NO: 1173 - protein, 455 aa, Artificial Sequence
  Synthetic sequence.
MDPDEARKAIARVKRESKRIVEDAERLIREAAAASEKISREAERLIREAASSGLVPRGSHMKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELVKDPRIAATMENAQKGEIMPNIPQMSAFWYAVRTAVINAASGRQTVDEALKDAQTNSSGSGLNDIFEAQKIEWHELEHHHHHH

SEQ ID NO: 1174 - protein, 464 aa, Artificial Sequence
  Synthetic sequence.
MDPDEARKAIARVKRESKRIVEDAERLIREAAAASEKISREAERLIREAAAASEKISRESSGLVPRGSHMKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELVKDPRIAATMENAQKGEIMPNIPQMSAFWYAVRTAVINAASGRQTVDEALKDAQTNSSGSGLNDIFEAQKIEWHELEHHHHHH

SEQ ID NO: 1175 - protein, 456 aa, Artificial Sequence
  Synthetic sequence.
MGSSHHHHHHSSGLVPRGSHMKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELVKDPRIAATMENAQKGEIMPNIPQMSAFWYAVRTAVINAASGRQTVDEALKDAQTNSGSGSGENLYFQDEARKAIARVKRESKRIVEDAERLIREAAAASEKISREAERLIREAAAASEKISRE

SEQ ID NO: 1176 - protein, 445 aa, Artificial Sequence
  Synthetic sequence.
MNKEEIEKLAKEAREKLKKAEKEHKEIHDKLRKKNKKAREDLKKKADELRETNKRVNGSENLYFQGSGSGKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELVKDPRIAATMENAQKGEIMPNIPQMSAFWYAVRTAVINAASGRQTVDEALKDAQTNLEHHHHHH

SEQ ID NO: 1177 - protein, 445 aa, Artificial Sequence
  Synthetic sequence.
MSSEKVRRELKESLKENHKQNQKLLKDHKRAQEKLNRELEELKKKHKKTLDDIRRESGSENLYFQGSGSGKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELVKDPRIAATMENAQKGEIMPNIPQMSAFWYAVRTAVINAASGRQTVDEALKDAQTNLEHHHHHH

SEQ ID NO: 1178 - protein, 445 aa, Artificial Sequence
  Synthetic sequence.
MDTVKRILEELRRRFEKLAKDLDDIARKLLEDHKKHNKELKDKQRKIKKEADDAARSGSENLYFQGSGSGKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELVKDPRIAATMENAQKGEIMPNIPQMSAFWYAVRTAVINAASGRQTVDEALKDAQTNLEHHHHHH

SEQ ID NO: 1179 - protein, 445 aa, Artificial Sequence
  Synthetic sequence.
MDDVERRLRKANKESKKEAEELTEEAKKANEKTKEDSKELTKENRKTNKTIKDEARSGSENLYFQGSGSGKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELVKDPRIAATMENAQKGEIMPNIPQMSAFWYAVRTAVINAASGRQTVDEALKDAQTNLEHHHHHH

SEQ ID NO: 1180 - protein, 445 aa, Artificial Sequence
  Synthetic sequence.
MDDEERRSEKTVQDAKREIKKVEDDLQRLNEEQKKKVKKQEDENQKTLKKHKDDARSGSENLYFQGSGSGKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELVKDPRIAATMENAQKGEIMPNIPQMSAFWYAVRTAVINAASGRQTVDEALKDAQTNLEHHHHHH

SEQ ID NO: 1181 - protein, 456 aa, Artificial Sequence; identical to SEQ ID NO: 1175
  Synthetic sequence.

SEQ ID NO: 1182 - protein, 444 aa, Artificial Sequence
  Synthetic sequence.
MGSSHHHHHHSSGLVPRGSHMKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELVKDPRIAATMENAQKGEIMPNIPQMSAFWYAVRTAVINAASGRQTVDEALKDAQTNSGSGSGENLYFQDEARKAIARVKRESKRIVEDAERLIREAAAASEKISREAERLIR

SEQ ID NO: 1183 - protein, 456 aa, Artificial Sequence
  Synthetic sequence.
MGSSHHHHHHSSGLVPRGSHMKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELVKDPRIAATMENAQKGEIMPNIPQMSAFWYAVRTAVINAASGRQTVDEALKDAQTNSGSGSGENLYFQDEARKAIARVKRESKRIVEDAERLIREAAQASEKISREARELIERAAQASEKISRE

SEQ ID NO: 1184 - protein, 444 aa, Artificial Sequence
  Synthetic sequence.
MGSSHHHHHHSSGLVPRGSHMKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELVKDPRIAATMENAQKGEIMPNIPQMSAFWYAVRTAVINAASGRQTVDEALKDAQTNSGSGSGENLYFQDEARKAIARVKRESKRIVEDAERLIREAAQASEKISREAERLIR

SEQ ID NO: 1185 - protein, 80 aa, Artificial Sequence
  Synthetic sequence.
MGSHHHHHHGSGSENLYFQGSGGSDEARKAIARVKRESKRIVEDAEGLISEAAAASEKISREAERLIREAAAASEKISRE

SEQ ID NO: 1186 - protein, 80 aa, Artificial Sequence
  Synthetic sequence.
MGSHHHHHHGSGSENLYFQGSGGSDEARKAIARVKRESKRIVEDAERLIREAAGSSEKISREAERLIREAAAASEKISRE

SEQ ID NO: 1187 - protein, 80 aa, Artificial Sequence
  Synthetic sequence.
MGSHHHHHHGSGSENLYFQGSGGSDEARKAIARVKRESKRIVEDAERLIGEAAAASEKISREAERLIREAAAASEKISRE

SEQ ID NO: 1188 - protein, 68 aa, Artificial Sequence
  Synthetic sequence.
MGSHHHHHHGSGSENLYFQGSGGSDEARKAIARVKRESKRIVGDAERLIREAAAASEKISREAERLIR

SEQ ID NO: 1189 - protein, 68 aa, Artificial Sequence
  Synthetic sequence.
MGSHHHHHHGSGSENLYFQGSGGSDEARKAIARVKRESKRIVEDAEGLISEAAAASEKISREAERLIR

SEQ ID NO: 1190 - protein, 68 aa, Artificial Sequence
  Synthetic sequence.
MGSHHHHHHGSGSENLYFQGSGGSDEARKAIARVAEESKRIVEDAERLIREAAAASEKISREAERLIR

SEQ ID NO: 1191 - protein, 68 aa, Artificial Sequence
  Synthetic sequence.
MGSHHHHHHGSGSENLYFQGSGGSDEAAKAIARVAEESKRIVEDAERLIREAAAASEKISREAERLIR

SEQ ID NO: 1192 - protein, 68 aa, Artificial Sequence
  Synthetic sequence.
MGSHHHHHHGSGSENLYFQGSGGSDEARKAIARVKRESKRIVEDAERLIREAAEASEEISREAERLIR

SEQ ID NO: 1193 - protein, 492 aa, Artificial Sequence
  Synthetic sequence.
MGSHHHHHHGSGSENLYFQGSGGSMKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELVKDPRIAATMENAQKGEIMPNIPQMSAFWYAVRTAVINAASGRQTVDEALKDAQTNSGSGSGENLYFQDEARKAIARVKRESKRIVEDAERLIREAAAASEKISREAERLIREAAAASEKISREGGGSGSGSGSGKPGQASGSAHIVMVDAYKPTK

SEQ ID NO: 1194 - protein, 480 aa, Artificial Sequence
  Synthetic sequence.
MGSHHHHHHGSGSENLYFQGSGGSMKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELVKDPRIAATMENAQKGEIMPNIPQMSAFWYAVRTAVINAASGRQTVDEALKDAQTNSGSGSGENLYFQDEARKAIARVKRESKRIVEDAERLIREAAAASEKISREAERLIRGGGSGSGSGSGKPGQASGSAHIVMVDAYKPTK

SEQ ID NO: 1195 - protein, 510 aa, Artificial Sequence
  Synthetic sequence.
MGSSHHHHHHSSGLVPRGSHMSKGEELFTGVVPILVELDGDVNGHKFSVRGEGEGDATNGKLTLKFICTTGKLPVPWPTLVTTLTYGVQCFARYPDHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSVLSKDPNEKRDHMVLLEFVTAAGITHGMDELYKSGSGSGCFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPILYGGSGGSDEARKAIARVKRESKRIVEDAERLIREAAAASEKISREAERLIREAAAASEKISRE

SEQ ID NO: 1196 - protein, 394 aa, Artificial Sequence
  Synthetic sequence.
MGSHHHHHHGSGSENLYFQGSGDEARKAIARVKRESKRIVEDAERLIREAAAASEKISREAERLIREAAAASEKISREGSGGSGSGGGVLLNVLSKCAGSKKFRPAPAAAFARECRGFYFELQELKEDDYYGITLSDDSDHQFLLANQVVVHNCGSGGSVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 1197 - protein, 58 aa, Artificial Sequence
  Synthetic sequence.
DKVRKVAEVAEKVLRDIDKLDRESKEAFRRTNGEISKLDEDTRRVAERVKKAIEDLAK

SEQ ID NO: 1198 - protein, 54 aa, Artificial Sequence
  Synthetic sequence.
SEVDEIIADNERALDEVRREVEEIDKENAERLKEWVEEAREILDRLAKALEEIR

SEQ ID NO: 1199 - protein, 60 aa, Artificial Sequence
  Synthetic sequence.
PEEALSKAIKDVRDIVKKVKDELKEWRDRNKELVDRLSEELKEWLKDVERVLKELTDKDR

SEQ ID NO: 1200 - protein, 56 aa, Artificial Sequence
  Synthetic sequence.
DERVREELKKLLTRVEEEHRKVLETDKKILKEAHKESKEVNDRDRELLERLEESVR

SEQ ID NO: 1201 - protein, 59 aa, Artificial Sequence
  Synthetic sequence.
SRLVKKLDEIVKEVAKKLEDVVRANEELWRKLVELNKESVARLREAVERVARDLEETAR

SEQ ID NO: 1202 - protein, 54 aa, Artificial Sequence
  Synthetic sequence.
SDEERLEKVVKDVIEKVRRILEKWKKDIDKVVKELRRILEEWEKIIREVLDKVR

SEQ ID NO: 1203 - protein, 57 aa, Artificial Sequence
  Synthetic sequence.
DKDAVIKVIEKLIRANAAVWDALLKINEDLVRVNKTVWKELLRVNEKLARDLERVVK

SEQ ID NO: 1204 - protein, 55 aa, Artificial Sequence
  Synthetic sequence.
SLVDELRKSLERNVRVSEEVARRLKEALKRWVDVVRKVVEDLIRLNEDVVRVVEK

SEQ ID NO: 1205 - protein, 59 aa, Artificial Sequence; identical to SEQ ID NO: 1201
  Synthetic sequence.

SEQ ID NO: 1206 - protein, 58 aa, Artificial Sequence
  Synthetic sequence.
SGSKEVLDILERAVEVVRRVIKALKEVLERHVDATREVIERVKRVNKRLLEAVREVVT

SEQ ID NO: 1207 - protein, 58 aa, Artificial Sequence
  Synthetic sequence.
GVPEEIDRELKRVVEELRRLHEEIKERLDDVARRSEEELRRIIKKLKEVVKEIRKKLK

SEQ ID NO: 1208 - protein, 55 aa, Artificial Sequence
  Synthetic sequence.
DLLRKLEEELRRIKEKLRKALEELEREHRELEKELDKLHDESRKEHERIEEELRR

SEQ ID NO: 1209 - protein, 57 aa, Artificial Sequence
  Synthetic sequence.
DEDLLEKIKRVIREHIKALEKLARDLKEILRRHIEALKELARDLAEVIRKLLEDVKR

SEQ ID NO: 1210 - protein, 54 aa, Artificial Sequence
  Synthetic sequence.
DLERLRRKVEELEDRLRRLLEKLARDSAELMRELERILDRYARESEELDRRLAE

SEQ ID NO: 1211 - protein, 54 aa, Artificial Sequence
  Synthetic sequence.
DLEDILRKNLDRLRKLLERLREILRENLEALKKTLKRLEDVVREILEDLKRERK

SEQ ID NO: 1212 - protein, 54 aa, Artificial Sequence; identical to SEQ ID NO: 1210
  Synthetic sequence.

SEQ ID NO: 1213 - protein, 58 aa, Artificial Sequence; identical to SEQ ID NO: 1206
  Synthetic sequence.

SEQ ID NO: 1214 - protein, 54 aa, Artificial Sequence; identical to SEQ ID NO: 1210
  Synthetic sequence.

SEQ ID NO: 1215 - protein, 58 aa, Artificial Sequence
  Synthetic sequence.
RLIEEVVRLLRENLDVVRRILEALAKLIKELLEALEEVLRRNKELIRELLRVLDEALK

SEQ ID NO: 1216 - protein, 55 aa, Artificial Sequence
  Synthetic sequence.
DIVRAMEEVIRRLIEILRRDVELNLDVAKKLLELLKEDSKLNLDVARELLELLDR

SEQ ID NO: 1217 - protein, 55 aa, Artificial Sequence; identical to SEQ ID NO: 1216
  Synthetic sequence.

SEQ ID NO: 1218 - protein, 58 aa, Artificial Sequence; identical to SEQ ID NO: 1215
  Synthetic sequence.

SEQ ID NO: 1219 - protein, 58 aa, Artificial Sequence; identical to SEQ ID NO: 1215
  Synthetic sequence.

SEQ ID NO: 1220 - protein, 55 aa, Artificial Sequence; identical to SEQ ID NO: 1208
  Synthetic sequence.

SEQ ID NO: 1221 - protein, 55 aa, Artificial Sequence; identical to SEQ ID NO: 1208
  Synthetic sequence.

SEQ ID NO: 1222 - protein, 58 aa, Artificial Sequence
  Synthetic sequence.
ELAREVERVIKELLDKSKEILERIERAIDELLKVSEEILKLSEDASEELLKILREFAK

SEQ ID NO: 1223 - protein, 58 aa, Artificial Sequence
  Synthetic sequence.
DVKDIIRTILEVARDLLRLLEEDSRTNSEVVKRLLDLLREDSKANSEVVKRLLDVLRE

SEQ ID NO: 1224 - protein, 54 aa, Artificial Sequence; identical to SEQ ID NO: 1210
  Synthetic sequence.

SEQ ID NO: 1225 - protein, 54 aa, Artificial Sequence; identical to SEQ ID NO: 1210
  Synthetic sequence.

SEQ ID NO: 1226 - protein, 58 aa, Artificial Sequence; identical to SEQ ID NO: 1215
  Synthetic sequence.

SEQ ID NO: 1227 - protein, 54 aa, Artificial Sequence; identical to SEQ ID NO: 1211
  Synthetic sequence.

SEQ ID NO: 1228 - protein, 55 aa, Artificial Sequence; identical to SEQ ID NO: 1208
  Synthetic sequence.

SEQ ID NO: 1229 - protein, 57 aa, Artificial Sequence; identical to SEQ ID NO: 1209
  Synthetic sequence.

SEQ ID NO: 1230 - protein, 58 aa, Artificial Sequence
  Synthetic sequence.
ELVRIAIEVLKRLLEIIEELVRLNNEILERLLKIVRELHKDNIKILEDLLRIIEEVLR

SEQ ID NO: 1231 - protein, 58 aa, Artificial Sequence; identical to SEQ ID NO: 1230
  Synthetic sequence.

SEQ ID NO: 1232 - protein, 58 aa, Artificial Sequence
  Synthetic sequence.
RLARLLKALADKLIRVLEEILKINEELNRKIIKFARENLERNRRVNKKVIEVLREAAR

SEQ ID NO: 1233 - protein, 54 aa, Artificial Sequence; identical to SEQ ID NO: 1210
  Synthetic sequence.

SEQ ID NO: 1234 - protein, 58 aa, Artificial Sequence; identical to SEQ ID NO: 1230
  Synthetic sequence.

SEQ ID NO: 1235 - protein, 58 aa, Artificial Sequence; identical to SEQ ID NO: 1230
  Synthetic sequence.

SEQ ID NO: 1236 - protein, 55 aa, Artificial Sequence; identical to SEQ ID NO: 1216
  Synthetic sequence.

SEQ ID NO: 1237 - protein, 58 aa, Artificial Sequence
  Synthetic sequence.
RKIAKIIEELKRLLEDLARDTRRVIEEAKRLLKEWRDRNKEVADTLKKLLEDLIRKIR

SEQ ID NO: 1238 - protein, 55 aa, Artificial Sequence; identical to SEQ ID NO: 1208
  Synthetic sequence.

SEQ ID NO: 1239 - protein, 55 aa, Artificial Sequence; identical to SEQ ID NO: 1208
  Synthetic sequence.

SEQ ID NO: 1240 - protein, 58 aa, Artificial Sequence; identical to SEQ ID NO: 1237
  Synthetic sequence.

SEQ ID NO: 1241 - protein, 58 aa, Artificial Sequence; identical to SEQ ID NO: 1230
  Synthetic sequence.

SEQ ID NO: 1242 - protein, 57 aa, Artificial Sequence
  Synthetic sequence.
TVRRLREALKKLEDDLRKIERDAEREYKKLKDELEELTERYRREIRKLKEELKADRK

SEQ ID NO: 1243 - protein, 58 aa, Artificial Sequence
  Synthetic sequence.
DEAERRRRELKDKLDRLREEHEEVKRRLEEELTRLRETHKKIEKELREALKRVRDRST

SEQ ID NO: 1244 - protein, 58 aa, Artificial Sequence; identical to SEQ ID NO: 1243
  Synthetic sequence.

SEQ ID NO: 1245 - protein, 54 aa, Artificial Sequence; identical to SEQ ID NO: 1211
  Synthetic sequence.

SEQ ID NO: 1246 - protein, 54 aa, Artificial Sequence; identical to SEQ ID NO: 1210
  Synthetic sequence.

SEQ ID NO: 1247 - protein, 58 aa, Artificial Sequence; identical to SEQ ID NO: 1243
  Synthetic sequence.

SEQ ID NO: 1248 - protein, 58 aa, Artificial Sequence; identical to SEQ ID NO: 1243
  Synthetic sequence.

SEQ ID NO: 1249 - protein, 58 aa, Artificial Sequence; identical to SEQ ID NO: 1243
  Synthetic sequence.

SEQ ID NO: 1250 - protein, 56 aa, Artificial Sequence
  Synthetic sequence.
DKAVEELEKALEEIKRRLKEVIDRYEDELRKLRKEYKEKIDKYERKLEEIERRERT

SEQ ID NO: 1251 - protein, 58 aa, Artificial Sequence
  Synthetic sequence.
DVKRALEELVSRLRKLLEDVKKASEDIVREVERIVRELAKRSDEILKKLEDIVEKLRE

SEQ ID NO: 1252 - protein, 58 aa, Artificial Sequence; identical to SEQ ID NO: 1251
  Synthetic sequence.

SEQ ID NO: 1253 - protein, 58 aa, Artificial Sequence; identical to SEQ ID NO: 1243
  Synthetic sequence.

SEQ ID NO: 1254 - protein, 58 aa, Artificial Sequence; identical to SEQ ID NO: 1251
  Synthetic sequence.

SEQ ID NO: 1255 - protein, 58 aa, Artificial Sequence
  Synthetic sequence.
EVKRRLEEKERRIRTRYEELRRRLRKRVKDYEDKLREIEKKVRRDAERIEEELERAKK

SEQ ID NO: 1256 - protein, 58 aa, Artificial Sequence; identical to SEQ ID NO: 1243
  Synthetic sequence.

SEQ ID NO: 1257 - protein, 58 aa, Artificial Sequence
  Synthetic sequence.
KIAEEIERELEELRRMIKRLHEDLERKLKESEDELREIEARLEEKIRRLEEKLERKRR

SEQ ID NO: 1258 - protein, 58 aa, Artificial Sequence; identical to SEQ ID NO: 1257
  Synthetic sequence.

SEQ ID NO: 1259 - protein, 56 aa, Artificial Sequence; identical to SEQ ID NO: 1250
  Synthetic sequence.

SEQ ID NO: 1260 - protein, 58 aa, Artificial Sequence; identical to SEQ ID NO: 1257
  Synthetic sequence.

SEQ ID NO: 1261 - protein, 58 aa, Artificial Sequence; identical to SEQ ID NO: 1230
  Synthetic sequence.

SEQ ID NO: 1262 - protein, 55 aa, Artificial Sequence
  Synthetic sequence.
DEVEREIRRVKEDLDRILEEYRRLLEEIKRKLEEILRRVEELHRRLRRKLEEIDR

SEQ ID NO: 1263 - protein, 58 aa, Artificial Sequence; identical to SEQ ID NO: 1251
  Synthetic sequence.

SEQ ID NO: 1264 - protein, 58 aa, Artificial Sequence; identical to SEQ ID NO: 1243
  Synthetic sequence.

SEQ ID NO: 1265 - protein, 58 aa, Artificial Sequence; identical to SEQ ID NO: 1243
  Synthetic sequence.

SEQ ID NO: 1266 - protein, 58 aa, Artificial Sequence
  Synthetic sequence.
TLREVVRKVLEEAKRLLDELEEVHKRVKKELEDIIEENRRVVKRVRDELREIKRELDE

SEQ ID NO: 1267 - protein, 58 aa, Artificial Sequence; identical to SEQ ID NO: 1251
  Synthetic sequence.

SEQ ID NO: 1268 - protein, 58 aa, Artificial Sequence; identical to SEQ ID NO: 1251
  Synthetic sequence.

SEQ ID NO: 1269 - protein, 58 aa, Artificial Sequence; identical to SEQ ID NO: 1243
  Synthetic sequence.

SEQ ID NO: 1270 - protein, 58 aa, Artificial Sequence; identical to SEQ ID NO: 1243
  Synthetic sequence.

SEQ ID NO: 1271 - protein, 58 aa, Artificial Sequence; identical to SEQ ID NO: 1257
  Synthetic sequence.

SEQ ID NO: 1272 - protein, 58 aa, Artificial Sequence; identical to SEQ ID NO: 1251
  Synthetic sequence.

SEQ ID NO: 1273 - protein, 58 aa, Artificial Sequence
  Synthetic sequence.
SEAERLADEVRKAVKKSEEDNETLVREVEKAVRELKKNNKTWVDEVRKLMKRLVDLLR

SEQ ID NO: 1274 - protein, 58 aa, Artificial Sequence; identical to SEQ ID NO: 1273
  Synthetic sequence.

SEQ ID NO: 1275 - protein, 58 aa, Artificial Sequence
  Synthetic sequence.
DKDKRLEELLKRLKELNDKTFEELERILEELKRANEASLREAERILEELRARIEGGNL

SEQ ID NO: 1276 - protein, 58 aa, Artificial Sequence
  Synthetic sequence.
SEAEDLEELIKELAELLKDVIRKLEKINRRLVKILEDIIRRLKEISKEAEEELRKGTV

SEQ ID NO: 1277 - protein, 58 aa, Artificial Sequence
  Synthetic sequence.
SDKEEIKRRVEKTARDLETEHDKIKKRLEDTVRDIKRELDELLEKYERVLRKIEKTLR

SEQ ID NO: 1278 - protein, 58 aa, Artificial Sequence
  Synthetic sequence.
SEAEKIREALETNLRLLEELIKRLKEILDTHNELLRRVIETLERLLKELLELLEEGGL

SEQ ID NO: 1279 - protein, 58 aa, Artificial Sequence; identical to SEQ ID NO: 1278
  Synthetic sequence.

SEQ ID NO: 1280 - protein, 58 aa, Artificial Sequence
  Synthetic sequence.
SKEERLREVAEKHKKDLEDIVKRVDEAAKETARRLEEILKRLEEVLKKILDDLEKGPD

SEQ ID NO: 1281 - protein, 58 aa, Artificial Sequence
  Synthetic sequence.
SLEEITKRLLELVEENLARHEEILRELLELAKRLAKEDRDILEEVLKLIEELLKLLED

SEQ ID NO: 1282 - protein, 58 aa, Artificial Sequence
  Synthetic sequence.
SKEETLKRLLDELEKRNRETVERLERLLKELEDRNRASLEELEAVLEELERKIEESGL

SEQ ID NO: 1283 - protein, 58 aa, Artificial Sequence; identical to SEQ ID NO: 1282
  Synthetic sequence.

SEQ ID NO: 1284 - protein, 58 aa, Artificial Sequence; identical to SEQ ID NO: 1282
  Synthetic sequence.

SEQ ID NO: 1285 - protein, 58 aa, Artificial Sequence
  Synthetic sequence.
STREKAKKVLDTLRADNEDMKRVVEKILRALKRTNERAEKLAREITEEIKRILKEVGV

SEQ ID NO: 1286 - protein, 58 aa, Artificial Sequence
  Synthetic sequence.
DAEEVVKRLADVLRENDETIRKVVEDLVRIAEENDRLWKKLVEDIAEILRRIVELLRR

SEQ ID NO: 1287 - protein, 58 aa, Artificial Sequence; identical to SEQ ID NO: 1282
  Synthetic sequence.

SEQ ID NO: 1288 - protein, 58 aa, Artificial Sequence; identical to SEQ ID NO: 1285
  Synthetic sequence.

SEQ ID NO: 1289 - protein, 58 aa, Artificial Sequence
  Synthetic sequence.
SKEEEVEKVLRKWEEILRRLIEENKRANDKIRREYEELVKEIRRVLEEIKEVAERLGV

SEQ ID NO: 1290 - protein, 58 aa, Artificial Sequence
  Synthetic sequence.
DREKSVRDIEEDLKRVLDKLRRRVETSKEELKKVLKADKENADELEKTLRDVVRELDR

SEQ ID NO: 1291 - protein, 58 aa, Artificial Sequence; identical to SEQ ID NO: 1277
  Synthetic sequence.

SEQ ID NO: 1292 - protein, 58 aa, Artificial Sequence; identical to SEQ ID NO: 1285
  Synthetic sequence.

SEQ ID NO: 1293 - protein, 58 aa, Artificial Sequence
  Synthetic sequence.
SKDEELARLLEELVERWRKIVEDLERDHRRLVKEIRELVERIRKKLEELVDRIRKNGI

SEQ ID NO: 1294 - protein, 58 aa, Artificial Sequence; identical to SEQ ID NO: 1273
  Synthetic sequence.

SEQ ID NO: 1295 - protein, 58 aa, Artificial Sequence; identical to SEQ ID NO: 1293
  Synthetic sequence.

SEQ ID NO: 1296 - protein, 58 aa, Artificial Sequence
  Synthetic sequence.
KEIEETLKELEDLNREMVETNRRVLEETRRLNKETVDRVKATLDELAKMLKKLVDDVR

SEQ ID NO: 1297 - protein, 58 aa, Artificial Sequence; identical to SEQ ID NO: 1273
  Synthetic sequence.

SEQ ID NO: 1298 - protein, 58 aa, Artificial Sequence; identical to SEQ ID NO: 1282
  Synthetic sequence.

SEQ ID NO: 1299 - protein, 58 aa, Artificial Sequence
  Synthetic sequence.
DKAEVLREALKLLKDLLEELIKIHEESLKRILDLIDTLVKVHEDALRALKELLERSGL

SEQ ID NO: 1300 - protein, 58 aa, Artificial Sequence; identical to SEQ ID NO: 1289
  Synthetic sequence.

SEQ ID NO: 1301 - protein, 58 aa, Artificial Sequence; identical to SEQ ID NO: 1282
  Synthetic sequence.

SEQ ID NO: 1302 - protein, 56 aa, Artificial Sequence
  Synthetic sequence.
SERVKEILERILRVVEEAVRLNEESLRRILDVVRKAVKLDRESLKKILDVVEEAVR

SEQ ID NO: 1303 - protein, 56 aa, Artificial Sequence; identical to SEQ ID NO: 1302
  Synthetic sequence.

SEQ ID NO: 1304 - protein, 57 aa, Artificial Sequence
  Synthetic sequence.
DERRIAERIRELLRESKKLVRDVVEEAKRLLKENRDSTRKIIEDIRRLLRKIEDSTR

SEQ ID NO: 1305 - protein, 55 aa, Artificial Sequence
  Synthetic sequence.
DALSRLLEELLRVVDDLIRVLKELIDKSRKVIEELLELLKRINEENLKVLAEIIK

SEQ ID NO: 1306 - protein, 57 aa, Artificial Sequence; identical to SEQ ID NO: 1304
  Synthetic sequence.

SEQ ID NO: 1307 - protein, 58 aa, Artificial Sequence
  Synthetic sequence.
EALRKLVELLVEVLRRLIRVNRELVKLLREVLERLLRILRESVKKLKRLIEKVIKDAT

SEQ ID NO: 1308 - protein, 58 aa, Artificial Sequence; identical to SEQ ID NO: 1307
  Synthetic sequence.

SEQ ID NO: 1309 - protein, 58 aa, Artificial Sequence
  Synthetic sequence.
AAKRLVEELLKAVTDLSRKNKRILEELLKAIETLSDENKKILTEILDALRRLVEKIEK

SEQ ID NO: 1310 - protein, 58 aa, Artificial Sequence; identical to SEQ ID NO: 1307
  Synthetic sequence.

SEQ ID NO: 1311 - protein, 58 aa, Artificial Sequence; identical to SEQ ID NO: 1307
  Synthetic sequence.

SEQ ID NO: 1312 - protein, 55 aa, Artificial Sequence; identical to SEQ ID NO: 1305
  Synthetic sequence.

SEQ ID NO: 1313 - protein, 55 aa, Artificial Sequence; identical to SEQ ID NO: 1305
  Synthetic sequence.

SEQ ID NO: 1314 - protein, 58 aa, Artificial Sequence
  Synthetic sequence.
RAVKKLDEIVKEVAKKLEDVVRANEELWRALVELNKESVRRLREIVERVARDLEETAR

SEQ ID NO: 1315 - protein, 58 aa, Artificial Sequence
  Synthetic sequence.
DRLDKVEELVKKLLEDTKRTVDRVRELVRKILKKSRETLEELERLIEKILRELEKDAR

SEQ ID NO: 1316 - protein, 55 aa, Artificial Sequence; identical to SEQ ID NO: 1305
  Synthetic sequence.

SEQ ID NO: 1317 - protein, 58 aa, Artificial Sequence; identical to SEQ ID NO: 1314
  Synthetic sequence.

SEQ ID NO: 1318 - protein, 58 aa, Artificial Sequence; identical to SEQ ID NO: 1314
  Synthetic sequence.

SEQ ID NO: 1319 - protein, 57 aa, Artificial Sequence
  Synthetic sequence.
SEDDLKRVVDEVEKKLRELKRRYAEALERIKEKIKELKDRYERAVREVVAELRKTTK

SEQ ID NO: 1320 - protein, 58 aa, Artificial Sequence; identical to SEQ ID NO: 1314
  Synthetic sequence.

SEQ ID NO: 1321 - protein, 55 aa, Artificial Sequence; identical to SEQ ID NO: 1262
  Synthetic sequence.

SEQ ID NO: 1322 - protein, 57 aa, Artificial Sequence; identical to SEQ ID NO: 1319
  Synthetic sequence.

SEQ ID NO: 1323 - protein, 58 aa, Artificial Sequence
  Synthetic sequence.
DEAKELLDEIRKAVKESEDRLEKLLRDYEKELRRLEKELRDLKRRIEEKLEELRRGSL

SEQ ID NO: 1324 - protein, 58 aa, Artificial Sequence
  Synthetic sequence.
SEKEDAARKLRKLVEELTREYEELVKKLERLIEEIEKVSEESVRKLEKLLAEISEEVR

SEQ ID NO: 1325 - protein, 58 aa, Artificial Sequence
  Synthetic sequence.
SEDEIIKKIIEDLRRVLKEVEEIHKEVEERLDKVLKEAEEMHKEVLKELDRVLDEVKR

SEQ ID NO: 1326 - protein, 58 aa, Artificial Sequence
  Synthetic sequence.
SKAEEIAEKLDRLLEENRRALEEITTRLDDLLRRNKDALRKVMEKLKRLLDDLRRGGI

SEQ ID NO: 1327 - protein, 58 aa, Artificial Sequence
  Synthetic sequence.
SEKEKLLKESEEEVRRLRRTLEELLRKYREVLERLRKELREIEERVRDVVRRLKEVLD

SEQ ID NO: 1328 - protein, 58 aa, Artificial Sequence; identical to SEQ ID NO: 1324
  Synthetic sequence.

SEQ ID NO: 1329 - protein, 58 aa, Artificial Sequence
  Synthetic sequence.
SKEETLRKEAEDLLRRLEELTRRLEKKARELLERAKKLSRDLAEELKRLLKELREKGV

SEQ ID NO: 1330 - protein, 58 aa, Artificial Sequence; identical to SEQ ID NO: 1324
  Synthetic sequence.

SEQ ID NO: 1331 - protein, 58 aa, Artificial Sequence; identical to SEQ ID NO: 1326
  Synthetic sequence.

SEQ ID NO: 1332 - protein, 58 aa, Artificial Sequence; identical to SEQ ID NO: 1324
  Synthetic sequence.

SEQ ID NO: 1333 - protein, 58 aa, Artificial Sequence; identical to SEQ ID NO: 1326
  Synthetic sequence.

SEQ ID NO: 1334 - protein, 58 aa, Artificial Sequence; identical to SEQ ID NO: 1329
  Synthetic sequence.

SEQ ID NO: 1335 - protein, 58 aa, Artificial Sequence
  Synthetic sequence.
SRVEELKKLIEDILRISREVVERIKRVAEDIHRINRRVLDDLRKLIEDILRTVEEILA

SEQ ID NO: 1336 - protein, 58 aa, Artificial Sequence; identical to SEQ ID NO: 1329
  Synthetic sequence.

SEQ ID NO: 1337 - protein, 58 aa, Artificial Sequence; identical to SEQ ID NO: 1326
  Synthetic sequence.

SEQ ID NO: 1338 - protein, 58 aa, Artificial Sequence; identical to SEQ ID NO: 1329
  Synthetic sequence.

SEQ ID NO: 1339 - protein, 58 aa, Artificial Sequence; identical to SEQ ID NO: 1324
  Synthetic sequence.

SEQ ID NO: 1340 - protein, 58 aa, Artificial Sequence; identical to SEQ ID NO: 1329
  Synthetic sequence.

SEQ ID NO: 1341 - protein, 58 aa, Artificial Sequence
  Synthetic sequence.
SERETVKRRLEELLKEVKRTLDKLKEEHDRLLEDVRRVVEELKREHDKLLKEVKDSGV

SEQ ID NO: 1342 - protein, 58 aa, Artificial Sequence; identical to SEQ ID NO: 1324
  Synthetic sequence.

SEQ ID NO: 1343 - protein, 58 aa, Artificial Sequence; identical to SEQ ID NO: 1329
  Synthetic sequence.

SEQ ID NO: 1344 - protein, 58 aa, Artificial Sequence
  Synthetic sequence.
KEREEVKEKLDRLLEEVEKTVRELKREHDELLKEVEKLVRDLKKEHDELLKKVKDDGV

SEQ ID NO: 1345 - protein, 58 aa, Artificial Sequence
  Synthetic sequence.
SREEVLRELEEVIEDNRRLLEELIEKSKKVLDESLKLIDELLRRLEEVLERVLRLLEE

SEQ ID NO: 1346 - protein, 56 aa, Artificial Sequence
  Synthetic sequence.
DEVVKRVRDLLDTVRRRNEKVNEDVKRMNDKLRRDNEDVIRRVEKLLRELEEKRRT

SEQ ID NO: 1347 - protein, 57 aa, Artificial Sequence
  Synthetic sequence.
SEDSVERIARELERNLDDLARVLKESEDDLAEILRRLKEVLEESERDLERVEREVRK

SEQ ID NO: 1348 - protein, 56 aa, Artificial Sequence
  Synthetic sequence.
SKELLEKAKAVVDEIKRLAEESLKRLEDLSRDHKRRAKELNDEIAKVVDELAKRAT

SEQ ID NO: 1349 - protein, 57 aa, Artificial Sequence
  Synthetic sequence.
SKEKIDRIIRELERILEEAKKKHEDVLRRLEDSLRRVAELLKAALDRLREIVDRLRR

SEQ ID NO: 1350 - protein, 56 aa, Artificial Sequence; identical to SEQ ID NO: 1346
  Synthetic sequence.

SEQ ID NO: 1351 - protein, 57 aa, Artificial Sequence
  Synthetic sequence.
DIKTLLDRVRKLAEEDAERLDRLRRESEELNERVRRVDKKLLEEIRRKAKKVEDDTR

SEQ ID NO: 1352 - protein, 57 aa, Artificial Sequence
  Synthetic sequence.
DAETLLRELEKLSRDNKELLKKIEKEIRDLIKEDKERNIELSERLRKLVEELKKKAT

SEQ ID NO: 1353 - protein, 56 aa, Artificial Sequence; identical to SEQ ID NO: 1346
  Synthetic sequence.

SEQ ID NO: 1354 - protein, 57 aa, Artificial Sequence; identical to SEQ ID NO: 1351
  Synthetic sequence.

SEQ ID NO: 1355 - protein, 56 aa, Artificial Sequence
  Synthetic sequence.
SEELSAEVKKLLDEVRKALARHKDENDKLLKEIEDSLRRHKEENDRLLEKLKESTR

SEQ ID NO: 1356 - protein, 57 aa, Artificial Sequence
  Synthetic sequence.
DADDVLARVEELAKRAHDENERLIREVEELVRAHNKRNKELVDEVKRLVEKVIEEER

SEQ ID NO: 1357 - protein, 57 aa, Artificial Sequence; identical to SEQ ID NO: 1349
  Synthetic sequence.

SEQ ID NO: 1358 - protein, 56 aa, Artificial Sequence; identical to SEQ ID NO: 1346
  Synthetic sequence.

SEQ ID NO: 1359 - protein, 56 aa, Artificial Sequence; identical to SEQ ID NO: 1355
  Synthetic sequence.

SEQ ID NO: 1360 - protein, 57 aa, Artificial Sequence
  Synthetic sequence.
DAETVLRSAEDIVAKNRKLAEEVLRRVKKIVEENRKIASEVLDDVRKLVEDVLARAS

SEQ ID NO: 1361 - protein, 57 aa, Artificial Sequence; identical to SEQ ID NO: 1356
  Synthetic sequence.

SEQ ID NO: 1362 - protein, 57 aa, Artificial Sequence; identical to SEQ ID NO: 1349
  Synthetic sequence.

SEQ ID NO: 1363 - protein, 57 aa, Artificial Sequence
  Synthetic sequence.
DEEKLKDLIRKLRDILRRAAEAHKKLIDDARESLERAKREHEKLIDRLKKILEELER

SEQ ID NO: 1364 - protein, 57 aa, Artificial Sequence; identical to SEQ ID NO: 1351
  Synthetic sequence.

SEQ ID NO: 1365 - protein, 57 aa, Artificial Sequence
  Synthetic sequence.
DATRVIEEAKRILDEARKLNEETIRRSEELVRRIERVIEEIIKRSEKLLEDVARESK

SEQ ID NO: 1366 - protein, 56 aa, Artificial Sequence; identical to SEQ ID NO: 1355
  Synthetic sequence.

SEQ ID NO: 1367 - protein, 57 aa, Artificial Sequence; identical to SEQ ID NO: 1360
  Synthetic sequence.

SEQ ID NO: 1368 - protein, 57 aa, Artificial Sequence; identical to SEQ ID NO: 1356
  Synthetic sequence.

SEQ ID NO: 1369 - protein, 56 aa, Artificial Sequence; identical to SEQ ID NO: 1348
  Synthetic sequence.

SEQ ID NO: 1370 - protein, 56 aa, Artificial Sequence
  Synthetic sequence.
DEEVLKKLAEIVRRVKEENRKVNEEVEKRLRELEEENKKVIEDLKSTVEELVERLR

SEQ ID NO: 1371 - protein, 56 aa, Artificial Sequence; identical to SEQ ID NO: 1370
  Synthetic sequence.

SEQ ID NO: 1372 - protein, 55 aa, Artificial Sequence
  Synthetic sequence.
DKLLKEARDLIREIEKRLEELLKRVEKLTEDAKRDLERSNREHKELADRIKETAR

SEQ ID NO: 1373 - protein, 56 aa, Artificial Sequence
  Synthetic sequence.
DKDSARELERIVKENAELAERVFREVEKIVRENTKLAEDSVRELKRLVEELKKRAK

SEQ ID NO: 1374 - protein, 57 aa, Artificial Sequence; identical to SEQ ID NO: 1349
  Synthetic sequence.

SEQ ID NO: 1375 - protein, 57 aa, Artificial Sequence; identical to SEQ ID NO: 1363
  Synthetic sequence.

SEQ ID NO: 1376 - protein, 56 aa, Artificial Sequence; identical to SEQ ID NO: 1346
  Synthetic sequence.

SEQ ID NO: 1377 - protein, 57 aa, Artificial Sequence
  Synthetic sequence.
DEEVLRTLEEIIRRLTKELEDVLREYERELRRLEEENKRVIDKTEEEIRRLADRLRR

SEQ ID NO: 1378 - protein, 57 aa, Artificial Sequence
  Synthetic sequence.
DERILRELEERVKELEKEAREILKRSEDETDKLREKAERILEDLERANRRTMDEARR

SEQ ID NO: 1379 - protein, 56 aa, Artificial Sequence; identical to SEQ ID NO: 1355
  Synthetic sequence.

SEQ ID NO: 1380 - protein, 58 aa, Artificial Sequence
  Synthetic sequence.
LPEEVLRELEELLKESEERIKRIEEEIKKIIDKSREDIKRVLEEIERLNAKAADDLRK

SEQ ID NO: 1381 - protein, 57 aa, Artificial Sequence; identical to SEQ ID NO: 1356
  Synthetic sequence.

SEQ ID NO: 1382 - protein, 56 aa, Artificial Sequence; identical to SEQ ID NO: 1370
  Synthetic sequence.

SEQ ID NO: 1383 - protein, 55 aa, Artificial Sequence; identical to SEQ ID NO: 1372
  Synthetic sequence.

SEQ ID NO: 1384 - protein, 57 aa, Artificial Sequence; identical to SEQ ID NO: 1377
  Synthetic sequence.

SEQ ID NO: 1385 - protein, 56 aa, Artificial Sequence
  Synthetic sequence.
DRRIEKVLKEIEEKIREVIKEWERVHREVEELLKRLIDENRKVLDEIRKLLEEKSK

SEQ ID NO: 1386 - protein, 57 aa, Artificial Sequence; identical to SEQ ID NO: 1378
  Synthetic sequence.

SEQ ID NO: 1387 - protein, 56 aa, Artificial Sequence; identical to SEQ ID NO: 1355
  Synthetic sequence.

SEQ ID NO: 1388 - protein, 56 aa, Artificial Sequence; identical to SEQ ID NO: 1370
  Synthetic sequence.

SEQ ID NO: 1389 - protein, 57 aa, Artificial Sequence; identical to SEQ ID NO: 1349
  Synthetic sequence.

SEQ ID NO: 1390 - protein, 56 aa, Artificial Sequence; identical to SEQ ID NO: 1385
  Synthetic sequence.

SEQ ID NO: 1391 - protein, 57 aa, Artificial Sequence
  Synthetic sequence.
TLRELARSIRKLSAENKERLKELLRELKKLSDENKERIKKLLSDAEKIIEDVARRAK

SEQ ID NO: 1392 - protein, 57 aa, Artificial Sequence; identical to SEQ ID NO: 1378
  Synthetic sequence.

SEQ ID NO: 1393 - protein, 58 aa, Artificial Sequence
  Synthetic sequence.
EKLKELRDVIAEVAKRIDELDEYTRESIRRAKKEIERLNRETKKVIEEVVKRIEEERK

SEQ ID NO: 1394 - protein, 56 aa, Artificial Sequence; identical to SEQ ID NO: 1200
  Synthetic sequence.

SEQ ID NO: 1395 - protein, 57 aa, Artificial Sequence; identical to SEQ ID NO: 1356
  Synthetic sequence.

SEQ ID NO: 1396 - protein, 57 aa, Artificial Sequence
  Synthetic sequence.
TVKRLLDELRELLERLKRTIEELLKRNRDLLADAEEKARRLLEENRKLLKAARDTAT

SEQ ID NO: 1397 - protein, 56 aa, Artificial Sequence; identical to SEQ ID NO: 1370
  Synthetic sequence.

SEQ ID NO: 1398 - protein, 57 aa, Artificial Sequence; identical to SEQ ID NO: 1349
  Synthetic sequence.

SEQ ID NO: 1399 - protein, 57 aa, Artificial Sequence; identical to SEQ ID NO: 1378
  Synthetic sequence.

SEQ ID NO: 1400 - protein, 57 aa, Artificial Sequence; identical to SEQ ID NO: 1365
  Synthetic sequence.

SEQ ID NO: 1401 - protein, 58 aa, Artificial Sequence
  Synthetic sequence.
EAAREIIKRLREVNKRTKEKLDELIKHSEEVLERVKRLIDELRKHSEEVLEDLRRRAK

SEQ ID NO: 1402 - protein, 58 aa, Artificial Sequence; identical to SEQ ID NO: 1393
  Synthetic sequence.

SEQ ID NO: 1403 - protein, 58 aa, Artificial Sequence
  Synthetic sequence.
ELLRRIKKLLDEIKKAIEDSSREIKRLLEESERVMKRSSEDIKRTLDDTRRVVEEVRR

SEQ ID NO: 1404 - protein, 55 aa, Artificial Sequence
  Synthetic sequence.
SKAIKDVRDIVKKVKDELKEWRDRNKELVDRLSEELKEWLKDVERVLKELTDKDR

SEQ ID NO: 1405 - protein, 56 aa, Artificial Sequence; identical to SEQ ID NO: 1200
  Synthetic sequence.

SEQ ID NO: 1406 - protein, 57 aa, Artificial Sequence
  Synthetic sequence.
DIDKLLKELRDLVEKIKKDLKELLERYEEIVRRIKELLKDLNREAEEVVRRLKEELR

SEQ ID NO: 1407 - protein, 57 aa, Artificial Sequence; identical to SEQ ID NO: 1356
  Synthetic sequence.

SEQ ID NO: 1408 - protein, 56 aa, Artificial Sequence; identical to SEQ ID NO: 1370
  Synthetic sequence.

SEQ ID NO: 1409 - protein, 58 aa, Artificial Sequence
  Synthetic sequence.
EREEELKEVADRVKEKLDRLNRENEKSSEELKRELDKINDENRETSERLKREIDETTR

SEQ ID NO: 1410 - protein, 57 aa, Artificial Sequence; identical to SEQ ID NO: 1349
  Synthetic sequence.

SEQ ID NO: 1411 - protein, 57 aa, Artificial Sequence; identical to SEQ ID NO: 1349
  Synthetic sequence.

SEQ ID NO: 1412 - protein, 57 aa, Artificial Sequence
  Synthetic sequence.
TKDLLDENSKRSNEISREVKKDLERTVRENKKIVDEVAKALEDTVDKNRRIVEEVTT

SEQ ID NO: 1413 - protein, 56 aa, Artificial Sequence; identical to SEQ ID NO: 1346
  Synthetic sequence.

SEQ ID NO: 1414 - protein, 56 aa, Artificial Sequence; identical to SEQ ID NO: 1385
  Synthetic sequence.

SEQ ID NO: 1415 - protein, 58 aa, Artificial Sequence; identical to SEQ ID NO: 1403
  Synthetic sequence.

SEQ ID NO: 1416 - protein, 56 aa, Artificial Sequence; identical to SEQ ID NO: 1355
  Synthetic sequence.

SEQ ID NO: 1417 - protein, 57 aa, Artificial Sequence; identical to SEQ ID NO: 1406
  Synthetic sequence.

SEQ ID NO: 1418 - protein, 57 aa, Artificial Sequence; identical to SEQ ID NO: 1356
  Synthetic sequence.

SEQ ID NO: 1419 - protein, 56 aa, Artificial Sequence; identical to SEQ ID NO: 1370
  Synthetic sequence.

SEQ ID NO: 1420 - protein, 56 aa, Artificial Sequence; identical to SEQ ID NO: 1370
  Synthetic sequence.

SEQ ID NO: 1421 - protein, 57 aa, Artificial Sequence; identical to SEQ ID NO: 1349
  Synthetic sequence.

SEQ ID NO: 1422 - protein, 56 aa, Artificial Sequence
  Synthetic sequence.
SEELREELKKLERKIEKVAKEIHDHDKEVTERLEDLLRRITEHARKSDREIEETAR

SEQ ID NO: 1423 - protein, 56 aa, Artificial Sequence; identical to SEQ ID NO: 1385
  Synthetic sequence.

SEQ ID NO: 1424 - protein, 57 aa, Artificial Sequence; identical to SEQ ID NO: 1365
  Synthetic sequence.

SEQ ID NO: 1425 - protein, 58 aa, Artificial Sequence; identical to SEQ ID NO: 1393
  Synthetic sequence.

SEQ ID NO: 1426 - protein, 58 aa, Artificial Sequence; identical to SEQ ID NO: 1403
  Synthetic sequence.

SEQ ID NO: 1427 - protein, 57 aa, Artificial Sequence; identical to SEQ ID NO: 1406
  Synthetic sequence.

SEQ ID NO: 1428 - protein, 58 aa, Artificial Sequence
  Synthetic sequence.
EAKKKLDEVLERAKRTIDRLLETSDRSLEKVEADLRRLNEELDRSLERAERTIRELAK

SEQ ID NO: 1429 - protein, 56 aa, Artificial Sequence; identical to SEQ ID NO: 1370
  Synthetic sequence.

SEQ ID NO: 1430 - protein, 56 aa, Artificial Sequence; identical to SEQ ID NO: 1370
  Synthetic sequence.

SEQ ID NO: 1431 - protein, 56 aa, Artificial Sequence; identical to SEQ ID NO: 1385
  Synthetic sequence.

SEQ ID NO: 1432 - protein, 57 aa, Artificial Sequence; identical to SEQ ID NO: 1378
  Synthetic sequence.

SEQ ID NO: 1433 - protein, 57 aa, Artificial Sequence
  Synthetic sequence.
DLKRVEERAREVSRRNEESMRRVKEDADRVSEANKEVLDRVREEVKRLIEEVRETLR

SEQ ID NO: 1434 - protein, 58 aa, Artificial Sequence; identical to SEQ ID NO: 1393
  Synthetic sequence.

SEQ ID NO: 1435 - protein, 58 aa, Artificial Sequence; identical to SEQ ID NO: 1403
  Synthetic sequence.

SEQ ID NO: 1436 - protein, 58 aa, Artificial Sequence; identical to SEQ ID NO: 1403
  Synthetic sequence.

SEQ ID NO: 1437 - protein, 58 aa, Artificial Sequence; identical to SEQ ID NO: 1380
  Synthetic sequence.

SEQ ID NO: 1438 - protein, 58 aa, Artificial Sequence; identical to SEQ ID NO: 1428
  Synthetic sequence.

SEQ ID NO: 1439 - protein, 56 aa, Artificial Sequence; identical to SEQ ID NO: 1370
  Synthetic sequence.

SEQ ID NO: 1440 - protein, 55 aa, Artificial Sequence; identical to SEQ ID NO: 1372
  Synthetic sequence.

SEQ ID NO: 1441 - protein, 55 aa, Artificial Sequence; identical to SEQ ID NO: 1372
  Synthetic sequence.

SEQ ID NO: 1442 - protein, 58 aa, Artificial Sequence
  Synthetic sequence.
DIVRKIERIVETIEREVRESVKKVEEIARDIRRKVDESVKNVEKLLRDVDKKARDRKK

SEQ ID NO: 1443 - protein, 55 aa, Artificial Sequence
  Synthetic sequence.
DEIKRIVDEVRERLKRIVDENAKIVEDARRALEKIVKENEEILRRLKKELRELRK

SEQ ID NO: 1444 - protein, 56 aa, Artificial Sequence; identical to SEQ ID NO: 1385
  Synthetic sequence.

SEQ ID NO: 1445 - protein, 57 aa, Artificial Sequence; identical to SEQ ID NO: 1433
  Synthetic sequence.

SEQ ID NO: 1446 - protein, 57 aa, Artificial Sequence; identical to SEQ ID NO: 1365
  Synthetic sequence.

SEQ ID NO: 1447 - protein, 57 aa, Artificial Sequence
  Synthetic sequence.
DAETIERVVRELLEENKEVLRKTEEAVKRSTETNKRLLEASKEVADRLRERIKEAAK

SEQ ID NO: 1448 - protein, 58 aa, Artificial Sequence; identical to SEQ ID NO: 1393
  Synthetic sequence.

SEQ ID NO: 1449 - protein, 58 aa, Artificial Sequence; identical to SEQ ID NO: 1403
  Synthetic sequence.

SEQ ID NO: 1450 - protein, 55 aa, Artificial Sequence
  Synthetic sequence.
DEVVERAERISEENKRRVEDVARKSKELVEDVRRHSEEVVRRVEELVKEVEERVR

SEQ ID NO: 1451 - protein, 58 aa, Artificial Sequence; identical to SEQ ID NO: 1428
  Synthetic sequence.

SEQ ID NO: 1452 - protein, 57 aa, Artificial Sequence
  Synthetic sequence.
TAERARETLKRLLDENRDRSKKVKEEIRRILEDLTRTTERVKREIAKLLKELEDTAR

SEQ ID NO: 1453 - protein, 58 aa, Artificial Sequence
  Synthetic sequence.
EAVRRLKEILERLKEEVRRSLEELRKEVERLKKEVEDSLRELKKSLEEWVKSLEEATR

SEQ ID NO: 1454 - protein, 57 aa, Artificial Sequence; identical to SEQ ID NO: 1378
  Synthetic sequence.

SEQ ID NO: 1455 - protein, 57 aa, Artificial Sequence; identical to SEQ ID NO: 1365
  Synthetic sequence.

SEQ ID NO: 1456 - protein, 58 aa, Artificial Sequence
  Synthetic sequence.
DKARKVAEVAEKVLRDIDKLDRESKEAFRATNEEIAKLDEDTARVAERVKKAIEDLAK

SEQ ID NO: 1457 - protein, 58 aa, Artificial Sequence; identical to SEQ ID NO: 1393
  Synthetic sequence.

SEQ ID NO: 1458 - protein, 58 aa, Artificial Sequence; identical to SEQ ID NO: 1403
  Synthetic sequence.

SEQ ID NO: 1459 - protein, 58 aa, Artificial Sequence
  Synthetic sequence.
DKVERVVREVEKLHEEDRKRLEESTRSVRKLLEELKRELEKSTRSVKALVDELRERVR

SEQ ID NO: 1460 - protein, 55 aa, Artificial Sequence; identical to SEQ ID NO: 1450
  Synthetic sequence.

SEQ ID NO: 1461 - protein, 58 aa, Artificial Sequence; identical to SEQ ID NO: 1428
  Synthetic sequence.

SEQ ID NO: 1462 - protein, 57 aa, Artificial Sequence; identical to SEQ ID NO: 1452
  Synthetic sequence.

SEQ ID NO: 1463 - protein, 57 aa, Artificial Sequence; identical to SEQ ID NO: 1378
  Synthetic sequence.

SEQ ID NO: 1464 - protein, 57 aa, Artificial Sequence; identical to SEQ ID NO: 1378
  Synthetic sequence.

SEQ ID NO: 1465 - protein, 57 aa, Artificial Sequence; identical to SEQ ID NO: 1433
  Synthetic sequence.

SEQ ID NO: 1466 - protein, 58 aa, Artificial Sequence; identical to SEQ ID NO: 1456
  Synthetic sequence.

SEQ ID NO: 1467 - protein, 58 aa, Artificial Sequence; identical to SEQ ID NO: 1403
  Synthetic sequence.

SEQ ID NO: 1468 - protein, 55 aa, Artificial Sequence; identical to SEQ ID NO: 1404
  Synthetic sequence.

SEQ ID NO: 1469 - protein, 58 aa, Artificial Sequence; identical to SEQ ID NO: 1459
  Synthetic sequence.

SEQ ID NO: 1470 - protein, 57 aa, Artificial Sequence; identical to SEQ ID NO: 1406
  Synthetic sequence.

SEQ ID NO: 1471 - protein, 58 aa, Artificial Sequence; identical to SEQ ID NO: 1428
  Synthetic sequence.

SEQ ID NO: 1472 - protein, 55 aa, Artificial Sequence; identical to SEQ ID NO: 1372
  Synthetic sequence.

SEQ ID NO: 1473 - protein, 57 aa, Artificial Sequence; identical to SEQ ID NO: 1452
  Synthetic sequence.

SEQ ID NO: 1474 - protein, 55 aa, Artificial Sequence; identical to SEQ ID NO: 1443
  Synthetic sequence.

SEQ ID NO: 1475 - protein, 55 aa, Artificial Sequence
  Synthetic sequence.
DRIEEELKRLIDTLREKNREVEKRARDSNRDLKRTNDEIAKEVRELIKKLREDLK

SEQ ID NO: 1476 - protein, 57 aa, Artificial Sequence; identical to SEQ ID NO: 1378
  Synthetic sequence.

SEQ ID NO: 1477 - protein, 57 aa, Artificial Sequence; identical to SEQ ID NO: 1447
  Synthetic sequence.

SEQ ID NO: 1478 - protein, 58 aa, Artificial Sequence; identical to SEQ ID NO: 1456
  Synthetic sequence.

SEQ ID NO: 1479 - protein, 58 aa, Artificial Sequence; identical to SEQ ID NO: 1459
  Synthetic sequence.

SEQ ID NO: 1480 - protein, 57 aa, Artificial Sequence
  Synthetic sequence.
DIERILRELEAVLKKLTDESERLNREVERVSRDTKKKSKELNEELKAVLDEVKRKAD

SEQ ID NO: 1481 - protein, 55 aa, Artificial Sequence; identical to SEQ ID NO: 1450
  Synthetic sequence.

SEQ ID NO: 1482 - protein, 58 aa, Artificial Sequence; identical to SEQ ID NO: 1428
  Synthetic sequence.

SEQ ID NO: 1483 - protein, 57 aa, Artificial Sequence; identical to SEQ ID NO: 1452
  Synthetic sequence.

SEQ ID NO: 1484 - protein, 55 aa, Artificial Sequence; identical to SEQ ID NO: 1443
  Synthetic sequence.

SEQ ID NO: 1485 - protein, 56 aa, Artificial Sequence; identical to SEQ ID NO: 1385
  Synthetic sequence.

SEQ ID NO: 1486 - protein, 57 aa, Artificial Sequence; identical to SEQ ID NO: 1433
  Synthetic sequence.

SEQ ID NO: 1487 - protein, 57 aa, Artificial Sequence; identical to SEQ ID NO: 1447
  Synthetic sequence.

SEQ ID NO: 1488 - protein, 58 aa, Artificial Sequence; identical to SEQ ID NO: 1456
  Synthetic sequence.

SEQ ID NO: 1489 - protein, 58 aa, Artificial Sequence; identical to SEQ ID NO: 1403
  Synthetic sequence.

SEQ ID NO: 1490 - protein, 58 aa, Artificial Sequence; identical to SEQ ID NO: 1459
  Synthetic sequence.

SEQ ID NO: 1491 - protein, 58 aa, Artificial Sequence; identical to SEQ ID NO: 1428
  Synthetic sequence.

SEQ ID NO: 1492 - protein, 57 aa, Artificial Sequence; identical to SEQ ID NO: 1452
  Synthetic sequence.

SEQ ID NO: 1493 - protein, 55 aa, Artificial Sequence; identical to SEQ ID NO: 1443
  Synthetic sequence.

SEQ ID NO: 1494 - protein, 58 aa, Artificial Sequence; identical to SEQ ID NO: 1456
  Synthetic sequence.

SEQ ID NO: 1495 - protein, 58 aa, Artificial Sequence
  Synthetic sequence.
DEVTKVKKVADDVLAEIKKLDDETRRVIEDTNKKIADLDKATRDVVRKVLEEVKKLEK

SEQ ID NO: 1496 - protein, 57 aa, Artificial Sequence; identical to SEQ ID NO: 1406
  Synthetic sequence.

SEQ ID NO: 1497 - protein, 57 aa, Artificial Sequence; identical to SEQ ID NO: 1452
  Synthetic sequence.

SEQ ID NO: 1498 - protein, 55 aa, Artificial Sequence; identical to SEQ ID NO: 1443
  Synthetic sequence.

SEQ ID NO: 1499 - protein, 58 aa, Artificial Sequence
  Synthetic sequence.
RLVREVEDLVRRLVRRSEKSNEEVKRTVEELVRRMEESNDRVRDLVRRLVEELKRAVD

SEQ ID NO: 1500 - protein, 58 aa, Artificial Sequence; identical to SEQ ID NO: 1456
  Synthetic sequence.

SEQ ID NO: 1501 - protein, 58 aa, Artificial Sequence; identical to SEQ ID NO: 1428
  Synthetic sequence.

SEQ ID NO: 1502 - protein, 58 aa, Artificial Sequence; identical to SEQ ID NO: 1499
  Synthetic sequence.

SEQ ID NO: 1503 - protein, 58 aa, Artificial Sequence; identical to SEQ ID NO: 1456
  Synthetic sequence.

SEQ ID NO: 1504 - protein, 58 aa, Artificial Sequence; identical to SEQ ID NO: 1495
  Synthetic sequence.

SEQ ID NO: 1505 - protein, 57 aa, Artificial Sequence; identical to SEQ ID NO: 1452
  Synthetic sequence.

SEQ ID NO: 1506 - protein, 57 aa, Artificial Sequence; identical to SEQ ID NO: 1433
  Synthetic sequence.

SEQ ID NO: 1507 - protein, 58 aa, Artificial Sequence; identical to SEQ ID NO: 1456
  Synthetic sequence.

SEQ ID NO: 1508 - protein, 58 aa, Artificial Sequence; identical to SEQ ID NO: 1495
  Synthetic sequence.

SEQ ID NO: 1509 - protein, 58 aa, Artificial Sequence; identical to SEQ ID NO: 1459
  Synthetic sequence.

SEQ ID NO: 1510 - protein, 58 aa, Artificial Sequence; identical to SEQ ID NO: 1428
  Synthetic sequence.

SEQ ID NO: 1511 - protein, 57 aa, Artificial Sequence; identical to SEQ ID NO: 1452
  Synthetic sequence.

SEQ ID NO: 1512 - protein, 57 aa, Artificial Sequence; identical to SEQ ID NO: 1452
  Synthetic sequence.

SEQ ID NO: 1513 - protein, 58 aa, Artificial Sequence; identical to SEQ ID NO: 1456
  Synthetic sequence.

SEQ ID NO: 1514 - protein, 58 aa, Artificial Sequence; identical to SEQ ID NO: 1495
  Synthetic sequence.

SEQ ID NO: 1515 - protein, 58 aa, Artificial Sequence; identical to SEQ ID NO: 1459
  Synthetic sequence.

SEQ ID NO: 1516 - protein, 57 aa, Artificial Sequence; identical to SEQ ID NO: 1452
  Synthetic sequence.

SEQ ID NO: 1517 - protein, 58 aa, Artificial Sequence; identical to SEQ ID NO: 1456
  Synthetic sequence.

SEQ ID NO: 1518 - protein, 58 aa, Artificial Sequence; identical to SEQ ID NO: 1499
  Synthetic sequence.

SEQ ID NO: 1519 - protein, 58 aa, Artificial Sequence
  Synthetic sequence.
SESDEVIRDLARLLDELARHVDDSVRRMDEVVKRSTREADELAKRLDELVKEVEKKPG

SEQ ID NO: 1520 - protein, 58 aa, Artificial Sequence
  Synthetic sequence.
SRAETVLKEVTDKIKKLADSSDELLRRNKENIDELKKSSEELLRRLTKAIEEIEKGSV

SEQ ID NO: 1521 - protein, 58 aa, Artificial Sequence
  Synthetic sequence.
SVDEVLKEIEDALRRLKEEVERVLKENEDELRRLEEEVRRVLKEDEELLESLKRGVGE

SEQ ID NO: 1522 - protein, 58 aa, Artificial Sequence
  Synthetic sequence.
SEVDEIIKELERLLAEIARENERIIRESRKLADEVRKRNEDAIRKLEELVARLADAVR

SEQ ID NO: 1523 - protein, 58 aa, Artificial Sequence
  Synthetic sequence.
SEVDDVLRRLEELIKTLEDINAKSLEDIKKLIDDLAKILEDALRKHEKLIRELREAKK

SEQ ID NO: 1524 - protein, 58 aa, Artificial Sequence; identical to SEQ ID NO: 1523
  Synthetic sequence.

SEQ ID NO: 1525 - protein, 58 aa, Artificial Sequence; identical to SEQ ID NO: 1520
  Synthetic sequence.

SEQ ID NO: 1526 - protein, 58 aa, Artificial Sequence
  Synthetic sequence.
KEVEDAVKELEDLLRANEDKTRSIVEDMRASNKDLEDHSRASEEEVRKLLDDLRRAGV

SEQ ID NO: 1527 - protein, 58 aa, Artificial Sequence; identical to SEQ ID NO: 1523
  Synthetic sequence.

SEQ ID NO: 1528 - protein, 58 aa, Artificial Sequence; identical to SEQ ID NO: 1519
  Synthetic sequence.

SEQ ID NO: 1529 - protein, 58 aa, Artificial Sequence
  Synthetic sequence.
SESDDVIRKLRELLEELRTHVEKSIRDLRKILEDSTRHAKRSIEELERLLEEVRKKPG

SEQ ID NO: 1530 - protein, 58 aa, Artificial Sequence; identical to SEQ ID NO: 1520
  Synthetic sequence.

SEQ ID NO: 1531 - protein, 58 aa, Artificial Sequence
  Synthetic sequence.
SEAEKAKETIDRLADRVRKLLEEIKRSLDDSRRKSKETVEENEKTLDRMRKEVDAAKR

SEQ ID NO: 1532 - protein, 58 aa, Artificial Sequence; identical to SEQ ID NO: 1531
  Synthetic sequence.

SEQ ID NO: 1533 - protein, 58 aa, Artificial Sequence
  Synthetic sequence.
SEVEELIKRLAKVLKELVDKVRKVIEDTKELLERLKRRSEDHIRKLREVLKEAKDQPI

SEQ ID NO: 1534 - protein, 58 aa, Artificial Sequence
  Synthetic sequence.
SELEEIEKKVRELTKRHRELVERVRKTVKELIETNRRLLETLTERIKRVLEEVRDLER

SEQ ID NO: 1535 - protein, 58 aa, Artificial Sequence
  Synthetic sequence.
SSEERLRAVIEDLKRLAEESRKRHKELIDELAKAVERIERRHKKLLDEIKAVVDDIRR

SEQ ID NO: 1536 - protein, 58 aa, Artificial Sequence
  Synthetic sequence.
DEIRKVVKEITDLLKASNDKNRKVVEEIRDLLRKSKKLADELVERLRALVEDLRRRID

SEQ ID NO: 1537 - protein, 58 aa, Artificial Sequence
  Synthetic sequence.
STAETVAEEVERVLKHSDDLIKEVEDVNRRVEEEIKRVIRELEEENERLVAEVRKGVK

SEQ ID NO: 1538 - protein, 58 aa, Artificial Sequence; identical to SEQ ID NO: 1522
  Synthetic sequence.

SEQ ID NO: 1539 - protein, 58 aa, Artificial Sequence
  Synthetic sequence.
SEIDEVLTRLRKISKDLNETSDRVNERARKIIDDIKKESKRVNDEAREIVERLKREID

SEQ ID NO: 1540 - protein, 58 aa, Artificial Sequence
  Synthetic sequence.
SEDEDLDRVAEKLAREHKKSVEEIKRVLKSADEESKKLVRDTERVIEEIKREVEEARR

SEQ ID NO: 1541 - protein, 58 aa, Artificial Sequence
  Synthetic sequence.
SSVEELLERLRRISEENKRRIEKLLREVEKVLRELKDRHRKLLKRVEEIIRKVKEEIK

SEQ ID NO: 1542 - protein, 58 aa, Artificial Sequence
  Synthetic sequence.
SAADEVVERMKELVATVKRENDEVVKELKKLVKELEDDNRRVVEESKKSVEDLARRVG

SEQ ID NO: 1543 - protein, 58 aa, Artificial Sequence; identical to SEQ ID NO: 1519
  Synthetic sequence.

SEQ ID NO: 1544 - protein, 58 aa, Artificial Sequence; identical to SEQ ID NO: 1526
  Synthetic sequence.

SEQ ID NO: 1545 - protein, 58 aa, Artificial Sequence; identical to SEQ ID NO: 1536
  Synthetic sequence.

SEQ ID NO: 1546 - protein, 58 aa, Artificial Sequence
  Synthetic sequence.
SRVEEIIEDLRRLLEEIRKENEDSIRRSKELLDRVKEINDTIIAELERLLKDIEKEVR

SEQ ID NO: 1547 - protein, 58 aa, Artificial Sequence; identical to SEQ ID NO: 1546
  Synthetic sequence.

SEQ ID NO: 1548 - protein, 58 aa, Artificial Sequence; identical to SEQ ID NO: 1523
  Synthetic sequence.

SEQ ID NO: 1549 - protein, 58 aa, Artificial Sequence
  Synthetic sequence.
SKLEEVEKAVRKVIEDSRRVNEEVNRRSEEVVRELEKVHREVNDASRRVVEKARRVLK

SEQ ID NO: 1550 - protein, 58 aa, Artificial Sequence; identical to SEQ ID NO: 1519
  Synthetic sequence.

SEQ ID NO: 1551 - protein, 58 aa, Artificial Sequence; identical to SEQ ID NO: 1519
  Synthetic sequence.

SEQ ID NO: 1552 - protein, 58 aa, Artificial Sequence; identical to SEQ ID NO: 1529
  Synthetic sequence.

SEQ ID NO: 1553 - protein, 58 aa, Artificial Sequence
  Synthetic sequence.
DEVRELLERNRRLLEEIKKTVKDLIRANEELLKRIEDDAKRLIDRNEELLDELEKGLS

SEQ ID NO: 1554 - protein, 58 aa, Artificial Sequence; identical to SEQ ID NO: 1536
  Synthetic sequence.

SEQ ID NO: 1555 - protein, 58 aa, Artificial Sequence; identical to SEQ ID NO: 1520
  Synthetic sequence.

SEQ ID NO: 1556 - protein, 58 aa, Artificial Sequence
  Synthetic sequence.
DEEEDLERAIKKLLDENRELLKRIAEELRRLLEELRRLTEESADRLRRLLKELKDRGV

SEQ ID NO: 1557 - protein, 58 aa, Artificial Sequence; identical to SEQ ID NO: 1536
  Synthetic sequence.

SEQ ID NO: 1558 - protein, 58 aa, Artificial Sequence
  Synthetic sequence.
SKEDRLREELKKLLARLAEEIERLKRALEESNKDLKRTIDASEKHLRDVNEDVKRGGV

SEQ ID NO: 1559 - protein, 58 aa, Artificial Sequence; identical to SEQ ID NO: 1519
  Synthetic sequence.

SEQ ID NO: 1560 - protein, 58 aa, Artificial Sequence; identical to SEQ ID NO: 1519
  Synthetic sequence.

SEQ ID NO: 1561 - protein, 58 aa, Artificial Sequence; identical to SEQ ID NO: 1529
  Synthetic sequence.

SEQ ID NO: 1562 - protein, 58 aa, Artificial Sequence; identical to SEQ ID NO: 1546
  Synthetic sequence.

SEQ ID NO: 1563 - protein, 58 aa, Artificial Sequence; identical to SEQ ID NO: 1522
  Synthetic sequence.

SEQ ID NO: 1564 - protein, 58 aa, Artificial Sequence; identical to SEQ ID NO: 1541
  Synthetic sequence.

SEQ ID NO: 1565 - protein, 58 aa, Artificial Sequence
  Synthetic sequence.
SELEEVLRRIEALVRKAHKENEDVLREIERLVRTAHRLNKKVDDDSAKIAEDLKRGGR

SEQ ID NO: 1566 - protein, 58 aa, Artificial Sequence; identical to SEQ ID NO: 1519
  Synthetic sequence.

SEQ ID NO: 1567 - protein, 58 aa, Artificial Sequence; identical to SEQ ID NO: 1529
  Synthetic sequence.

SEQ ID NO: 1568 - protein, 58 aa, Artificial Sequence; identical to SEQ ID NO: 1520
  Synthetic sequence.

SEQ ID NO: 1569 - protein, 58 aa, Artificial Sequence; identical to SEQ ID NO: 1553
  Synthetic sequence.

SEQ ID NO: 1570 - protein, 58 aa, Artificial Sequence
  Synthetic sequence.
STEEVLDEIRKLHKTLTEDIKRVLREIEELHRRTIEENKEVLDKIAEDYKRVIDDVRT

SEQ ID NO: 1571 - protein, 58 aa, Artificial Sequence
  Synthetic sequence.
SEIEKILKEIEDLARRDEEVSKKIVEDIRRLAKEVEDTSRDIVRKIEELAKRVLDRLR

SEQ ID NO: 1572 - protein, 58 aa, Artificial Sequence
  Synthetic sequence.
SEAERLEARARELLRANEELMDDLRAKAEELLKRNDRLVKEIEKKVREVLAAIEELKR

SEQ ID NO: 1573 - protein, 58 aa, Artificial Sequence
  Synthetic sequence.
DDLERAREEVADLIRKHEEKTRRILEESRRLNERHRELSARILDEIRKLAERIEELIK

SEQ ID NO: 1574 - protein, 58 aa, Artificial Sequence; identical to SEQ ID NO: 1556
  Synthetic sequence.

SEQ ID NO: 1575 - protein, 58 aa, Artificial Sequence; identical to SEQ ID NO: 1536
  Synthetic sequence.

SEQ ID NO: 1576 - protein, 58 aa, Artificial Sequence; identical to SEQ ID NO: 1536
  Synthetic sequence.

SEQ ID NO: 1577 - protein, 58 aa, Artificial Sequence
  Synthetic sequence.
STAETVEKKVEEVIRENEKSMRESEEKVDRSTKRIEDVLRRLEETIRKTSDDIAKGVK

SEQ ID NO: 1578 - protein, 58 aa, Artificial Sequence; identical to SEQ ID NO: 1546
  Synthetic sequence.

SEQ ID NO: 1579 - protein, 58 aa, Artificial Sequence; identical to SEQ ID NO: 1546
  Synthetic sequence.

SEQ ID NO: 1580 - protein, 58 aa, Artificial Sequence
  Synthetic sequence.
REVEEMIKELEELLKDLKEKNERASKRNRELVRRLEEENKRVIEELKKLVKELEDLVR

SEQ ID NO: 1581 - protein, 58 aa, Artificial Sequence; identical to SEQ ID NO: 1523
  Synthetic sequence.

SEQ ID NO: 1582 - protein, 58 aa, Artificial Sequence; identical to SEQ ID NO: 1549
  Synthetic sequence.

SEQ ID NO: 1583 - protein, 58 aa, Artificial Sequence
  Synthetic sequence.
DEVEDVLRKIEKILDDHRKRIEKNSRDMARIIDEHRRKVEENSREMKKLVDDLKKAVD

SEQ ID NO: 1584 - protein, 58 aa, Artificial Sequence; identical to SEQ ID NO: 1541
  Synthetic sequence.

SEQ ID NO: 1585 - protein, 58 aa, Artificial Sequence
  Synthetic sequence.
DEVEKVLEEIKRALDDLRKKVEESKREIKEALKAVEKHTRDSDTANKRTLAEIERGVK

SEQ ID NO: 1586 - protein, 58 aa, Artificial Sequence; identical to SEQ ID NO: 1519
  Synthetic sequence.

SEQ ID NO: 1587 - protein, 58 aa, Artificial Sequence; identical to SEQ ID NO: 1526
  Synthetic sequence.

SEQ ID NO: 1588 - protein, 58 aa, Artificial Sequence; identical to SEQ ID NO: 1536
  Synthetic sequence.

SEQ ID NO: 1589 - protein, 58 aa, Artificial Sequence; identical to SEQ ID NO: 1537
  Synthetic sequence.

SEQ ID NO: 1590 - protein, 58 aa, Artificial Sequence; identical to SEQ ID NO: 1546
  Synthetic sequence.

SEQ ID NO: 1591 - protein, 58 aa, Artificial Sequence; identical to SEQ ID NO: 1522
  Synthetic sequence.

SEQ ID NO: 1592 - protein, 58 aa, Artificial Sequence; identical to SEQ ID NO: 1523
  Synthetic sequence.

SEQ ID NO: 1593 - protein, 58 aa, Artificial Sequence; identical to SEQ ID NO: 1549
  Synthetic sequence.

SEQ ID NO: 1594 - protein, 58 aa, Artificial Sequence
  Synthetic sequence.
SAEEVKEELKRIATKLKEEIKENIRRLEESVEKIAKELAENIKRLEDILRDVKRGLRD

SEQ ID NO: 1595 - protein, 58 aa, Artificial Sequence
  Synthetic sequence.
SDVDRVLEEIRKLLEDLKRHSEKVSEENEDLLRANTELNKRVSEDNERLLEELKRLRE

SEQ ID NO: 1596 - protein, 58 aa, Artificial Sequence; identical to SEQ ID NO: 1583
  Synthetic sequence.

SEQ ID NO: 1597 - protein, 58 aa, Artificial Sequence; identical to SEQ ID NO: 1541
  Synthetic sequence.

SEQ ID NO: 1598 - protein, 58 aa, Artificial Sequence
  Synthetic sequence.
DREREVKKRLDEVRERIERLLRRVEEESRRVAEEIRRLIEEVRRRNKKVTEEIRELLK

SEQ ID NO: 1599 - protein, 58 aa, Artificial Sequence; identical to SEQ ID NO: 1520
  Synthetic sequence.

SEQ ID NO: 1600 - protein, 58 aa, Artificial Sequence; identical to SEQ ID NO: 1571
  Synthetic sequence.

SEQ ID NO: 1601 - protein, 58 aa, Artificial Sequence; identical to SEQ ID NO: 1531
  Synthetic sequence.

SEQ ID NO: 1602 - protein, 58 aa, Artificial Sequence; identical to SEQ ID NO: 1533
  Synthetic sequence.

SEQ ID NO: 1603 - protein, 58 aa, Artificial Sequence; identical to SEQ ID NO: 1536
  Synthetic sequence.

SEQ ID NO: 1604 - protein, 58 aa, Artificial Sequence; identical to SEQ ID NO: 1536
  Synthetic sequence.

SEQ ID NO: 1605 - protein, 58 aa, Artificial Sequence; identical to SEQ ID NO: 1577
  Synthetic sequence.

SEQ ID NO: 1606 - protein, 58 aa, Artificial Sequence; identical to SEQ ID NO: 1546
  Synthetic sequence.

SEQ ID NO: 1607 - protein, 58 aa, Artificial Sequence; identical to SEQ ID NO: 1580
  Synthetic sequence.

SEQ ID NO: 1608 - protein, 58 aa, Artificial Sequence
  Synthetic sequence.
DAVEEAEKLIRKVIADSEKLLRDLADLNAKSIRRSEKLVEDDRRANEDVIRKLEELRR

SEQ ID NO: 1609 - protein, 58 aa, Artificial Sequence; identical to SEQ ID NO: 1523
  Synthetic sequence.

SEQ ID NO: 1610 - protein, 58 aa, Artificial Sequence
  Synthetic sequence.
SEIERVKKRLEELLAEVEESTRRLEERLKRLLEEAKRSSEEVEKELRRLLEAVRRGLS

SEQ ID NO: 1611 - protein, 58 aa, Artificial Sequence; identical to SEQ ID NO: 1595
  Synthetic sequence.

SEQ ID NO: 1612 - protein, 58 aa, Artificial Sequence; identical to SEQ ID NO: 1583
  Synthetic sequence.

SEQ ID NO: 1613 - protein, 58 aa, Artificial Sequence; identical to SEQ ID NO: 1519
  Synthetic sequence.

SEQ ID NO: 1614 - protein, 58 aa, Artificial Sequence; identical to SEQ ID NO: 1520
  Synthetic sequence.

SEQ ID NO: 1615 - protein, 58 aa, Artificial Sequence; identical to SEQ ID NO: 1556
  Synthetic sequence.

SEQ ID NO: 1616 - protein, 58 aa, Artificial Sequence; identical to SEQ ID NO: 1536
  Synthetic sequence.

SEQ ID NO: 1617 - protein, 58 aa, Artificial Sequence; identical to SEQ ID NO: 1608
  Synthetic sequence.

SEQ ID NO: 1618 - protein, 58 aa, Artificial Sequence; identical to SEQ ID NO: 1540
  Synthetic sequence.

SEQ ID NO: 1619 - protein, 58 aa, Artificial Sequence; identical to SEQ ID NO: 1558
  Synthetic sequence.

SEQ ID NO: 1620 - protein, 59 aa, Artificial Sequence
  Synthetic sequence.
REVEEIERRLRELVRRSDELVRTVAEELEKLVRRNKKLVEDVMKRLRDLVERLRELVDA

SEQ ID NO: 1621 - protein, 58 aa, Artificial Sequence
  Synthetic sequence.
DEVRKVLKDVTELSKTSEDKLEKVVREVKRKLDEVNRDLERVVREAKKLLREVRERLE

SEQ ID NO: 1622 - protein, 59 aa, Artificial Sequence
  Synthetic sequence.
DEVDEIRRRLKKLLDDSRKTSKDIERRLRELLDRNRRLVERVEEELRKLIKELEELVRS

SEQ ID NO: 1623 - protein, 58 aa, Artificial Sequence
  Synthetic sequence.
EEVEKVLKEARDVSEDSKRETTEVLKEAKKALEDINKRLREIVETVREALERVERALT

SEQ ID NO: 1624 - protein, 59 aa, Artificial Sequence
  Synthetic sequence.
DEKETVKDVVRRLVEKLEEVVKESKKLVDDLVKRAKEIVRESEELVRRNVRRAEEVARE

SEQ ID NO: 1625 - protein, 55 aa, Artificial Sequence
  Synthetic sequence.
EKVLKELEDAVREVKERIKKTNKELEEMVRRVEEEIRESDERLKKASEEVEEKIR

SEQ ID NO: 1626 - protein, 59 aa, Artificial Sequence
  Synthetic sequence.
SEMETVLDDVRRVVEESEELVKRARDRVKKLVDDLKRLVEKNEEDVKRVVDELDKLVEK

SEQ ID NO: 1627 - protein, 56 aa, Artificial Sequence
  Synthetic sequence.
EEVLEEARRLSERSREELRRVLEEARRLIRRVREELKRVHDKARRLVERVEEKLRT

SEQ ID NO: 1628 - protein, 59 aa, Artificial Sequence
  Synthetic sequence.
DEVEEVLERVKKVVADSEELVKRNRERVKKVVDDIRDLIRRNAETVKEVVKTIRELVKK

SEQ ID NO: 1629 - protein, 56 aa, Artificial Sequence
  Synthetic sequence.
EEALKDAERRSDESRKKLKKVHDDADRMVREVTRRLDEVHKEAEKRVREVLAELDT

SEQ ID NO: 1630 - protein, 60 aa, Artificial Sequence
  Synthetic sequence.
SIEEVLKEAHELNKEANKRLRDVEEDAKRLIEEVLRRLEDVLRESERLAREVLEELKRKG

SEQ ID NO: 1631 - protein, 56 aa, Artificial Sequence
  Synthetic sequence.
AKELRRRVERSVEESKRLVDELRKDVKRVVDEIRKVVEEDLRHAKRVVDEIREKVR

SEQ ID NO: 1632 - protein, 59 aa, Artificial Sequence
  Synthetic sequence.
DEAEEVKRVVEESVRRNEELVRRNEELVRDVLRRLKEVVDENERLVKEVVDRLRDLVRR

SEQ ID NO: 1633 - protein, 56 aa, Artificial Sequence
  Synthetic sequence.
ERVLKEVEELDRRVLEELKRVNDEARKRVRTLLEELRRVNEKVEELVRRILEELKK

SEQ ID NO: 1634 - protein, 57 aa, Artificial Sequence
  Synthetic sequence.
DEAEDVVRKVMDEIRKLIEVSKEILKELRRLVEELKKHSDRTVEELRRVVTELLKKE

SEQ ID NO: 1635 - protein, 55 aa, Artificial Sequence
  Synthetic sequence.
TDAVRRVRELLETVRRTSEEVLKTLEEFLRRVEKSTRRAEEELEEFLKRVEDRVK

SEQ ID NO: 1636 - protein, 61 aa, Artificial Sequence
  Synthetic sequence.
KEADKLAKELEETIERLKRDSERLVTDLERLLERLERRSRELVKRLRRHVEELLKTVRRDG

SEQ ID NO: 1637 - protein, 55 aa, Artificial Sequence
  Synthetic sequence.
REVIKKVEDLLREVEETSKRILDRVRELLKKVEDSSRRINEESKKLLKRVEEEAR

SEQ ID NO: 1638 - protein, 58 aa, Artificial Sequence
  Synthetic sequence.
SELEKILEDLKRVAERVAKALDRSLRELEKVLRRVEEELTRSNERLREVVKEVEDAAD

SEQ ID NO: 1639 - protein, 56 aa, Artificial Sequence
  Synthetic sequence.
DEEVRKLVEDLARRLDDIVRRSEELSRKLAEDVEEIVERSKRLSEELAREARELVR

SEQ ID NO: 1640 - protein, 60 aa, Artificial Sequence
  Synthetic sequence.
SEIEDVVRKVETLARESDERVKTLMEENKDLAEKLKKLVRDVVEKVKREVTRLLDEVRRR

SEQ ID NO: 1641 - protein, 58 aa, Artificial Sequence
  Synthetic sequence.
EELKKVKERLDEAERRSKELIDEADRLNREMLKRVKEAIKKVKETLDKALEDVERAVR

SEQ ID NO: 1642 - protein, 57 aa, Artificial Sequence
  Synthetic sequence.
SDLERVEERLERAVREVEKLHEDSRRELRRVVKEVHDSTRKVEERNRKLVKRVEEAD

SEQ ID NO: 1643 - protein, 55 aa, Artificial Sequence
  Synthetic sequence.
KKVIKKLEDMLREWAKLVEKSIKELKELLEELRKVSKKLVDDNDRLAEELKRRVD

SEQ ID NO: 1644 - protein, 61 aa, Artificial Sequence
  Synthetic sequence.
DEVKALVDKVRELVRKLKEESDDLVRRNEELAKEVEKRSREVVEKVRDTVRKLLEELERAD

SEQ ID NO: 1645 - protein, 55 aa, Artificial Sequence
  Synthetic sequence.
KKVRDDLRKALEDVNRSSKRVEERDKEVLDEAHRSSTRVLETLKRMLERLDEKIR

SEQ ID NO: 1646 - protein, 61 aa, Artificial Sequence
  Synthetic sequence.
DEVEKLVKKVEDLVKRLIEVSEDVVREVEKRLRELEKVHREALRKNRKLLEDLLRRLREAD

SEQ ID NO: 1647 - protein, 55 aa, Artificial Sequence
  Synthetic sequence.
DKVREKLKRALDRVNKSSREVEETLRRADKRLNDLVKEIKDEDKRMLERLERETQ

SEQ ID NO: 1648 - protein, 61 aa, Artificial Sequence
  Synthetic sequence.
KEVEELVKEVRKLATKVIETSKRVVEELEKLAERLLRTSKEVVKRNKELVDDLLRRVREVS

SEQ ID NO: 1649 - protein, 55 aa, Artificial Sequence
  Synthetic sequence.
EEVRKELRELLRRVNESSKDVKRRLEDLDREINRLSKRVKEEDRRALKEVEEEIK

SEQ ID NO: 1650 - protein, 60 aa, Artificial Sequence
  Synthetic sequence.
SKEEEVKRVLREALERVEELNKRLNEEDKRMLDEVRKVNRDAERVLREALKRVEELLSRV

SEQ ID NO: 1651 - protein, 55 aa, Artificial Sequence
  Synthetic sequence.
DELVTDVERVVRELLDHVRRLVRESKELARELIRRSEEIVRTVEEVVRKLEKDVR

SEQ ID NO: 1652 - protein, 60 aa, Artificial Sequence
  Synthetic sequence.
DKAKKVEELLRKAIEEVEKLNDEVNRTDEKMLRRVKELNDDVHRTLEEAIKRVRELLSRV

SEQ ID NO: 1653 - protein, 55 aa, Artificial Sequence
  Synthetic sequence.
DEVVTEVEKLMRELLEHVKRLIDESRKLAADLEKHSRDIVEEVRRLVEELLRTVK

SEQ ID NO: 1654 - protein, 60 aa, Artificial Sequence
  Synthetic sequence.
SKERDVERKVREVIKRVEDLNKRVHKTLEDVIREVEKLNEEVKTRVEKLIREVEELLKRV

SEQ ID NO: 1655 - protein, 55 aa, Artificial Sequence
  Synthetic sequence.
DRVVEEVERLLRELEKHSKEIEEAVDRLVRKLEEHVKKVVEEVARLVAELKERVK

SEQ ID NO: 1656 - protein, 60 aa, Artificial Sequence
  Synthetic sequence.
SVAEEVKKVKDKLKKDVERLNEEDRRVLEKAKRESKKLLDEIKRVLEELERKLEELLRRD

SEQ ID NO: 1657 - protein, 55 aa, Artificial Sequence
  Synthetic sequence.
KEVVTEIRRVVKELLDKVRESIKETERVVRELLERNRKILKEIREVVRKLLEDVR

SEQ ID NO: 1658 - protein, 61 aa, Artificial Sequence
  Synthetic sequence.
DEARKLLEELKRLAERVLKTDTDLLDESRRILEEVLKTNKKSIEDSKRLAEDVLRKVAREG

SEQ ID NO: 1659 - protein, 59 aa, Artificial Sequence
  Synthetic sequence.
EEVLDRVREIMERVLTESKELNDRIHTISRKAEEDSKRLNEEDRAIMEDVRRELKRVVD

SEQ ID NO: 1660 - protein, 61 aa, Artificial Sequence
  Synthetic sequence.
SEAEKLLEELRTIAKEVLDRVRKMLRESEKLAEDVLRENKKSIEDSRRIAKKVLDELRRDG

SEQ ID NO: 1661 - protein, 59 aa, Artificial Sequence
  Synthetic sequence.
EEVLERIRRIFEDVLRKLRKLLDEIHRISEKVKKESEELNEEDKRIVDDAERRLEDLER

SEQ ID NO: 1662 - protein, 60 aa, Artificial Sequence
  Synthetic sequence.
SVKDAVEKILREAEETVKRLNEETKRRLDEAREESKRLIDEVRRILEKLKEVLDEVLRRV

SEQ ID NO: 1663 - protein, 55 aa, Artificial Sequence
  Synthetic sequence.
EELLERVKRLMDELEETSRRILEEVERVIRRNKELADRILKEVAELLKRLEEELR

SEQ ID NO: 1664 - protein, 60 aa, Artificial Sequence
  Synthetic sequence.
DEAEELRKTVEDIMKELREELKRLEEESRRIMEELKKRLEKLIEDSRKAAEDLKREADRL

SEQ ID NO: 1665 - protein, 59 aa, Artificial Sequence
  Synthetic sequence.
KRLLEEIKERVDRVKKELDEADKRINDSSREVEKTLEDLDRKINKSSEEVRRVLEEAER

SEQ ID NO: 1666 - protein, 60 aa, Artificial Sequence
  Synthetic sequence.
DVEETLTRLLKEILDVVRKALRDTREIVRDVRRVSEEVLKELEDLLREVDREVKRVLAEL

SEQ ID NO: 1667 - protein, 56 aa, Artificial Sequence
  Synthetic sequence.
DTEVVKRIRELVEKLRELVKRSNDNLKEHVKRNKELAKRLLDELRKLVEDLKRARK

SEQ ID NO: 1668 - protein, 60 aa, Artificial Sequence
  Synthetic sequence.
DMEEEVKKLIDEVRRVLEEVLKRVEDIIDASRRTLKKVVDDVRRIDEDVERELKEAEKRG

SEQ ID NO: 1669 - protein, 56 aa, Artificial Sequence
  Synthetic sequence.
KEEVLREVDRLVKKVEKTARELLRLLEESIEKSKREAEKLLRSNEDVVRRVRERVR

SEQ ID NO: 1670 - protein, 56 aa, Artificial Sequence
  Synthetic sequence.
DAEEDAKRLLKEVKDLLDEVRERHRELNERSRKVLEDARKTHEDLNEESRKTLEDR

SEQ ID NO: 1671 - protein, 55 aa, Artificial Sequence
  Synthetic sequence.
REARELLKRILKDIERILETVVRLSERDVEEVRKIMEELKKLSDDDLKRVEEEAR

SEQ ID NO: 1672 - protein, 56 aa, Artificial Sequence
  Synthetic sequence.
SAREEIEELIKRVKDTSKKILEDVRRMIERVKRKSKKIKEDAKRLIERVEKLLRDS

SEQ ID NO: 1673 - protein, 56 aa, Artificial Sequence
  Synthetic sequence.
KDELRELIKRLEDHSRRVVEEVARLVKELDEHSERVLKTLEDLIRRLDELVKRVTT

SEQ ID NO: 1674 - protein, 57 aa, Artificial Sequence
  Synthetic sequence.
KAEETVKELLDRVERISERARKEVRELLERSKESTKRILDEAREMIKRSRDELRRVG

SEQ ID NO: 1675 - protein, 56 aa, Artificial Sequence
  Synthetic sequence.
LEDLERLARELARHSEDVMRRLRDLARKDKELSEDLVRRLRELVKRDLDLVKTVKE

SEQ ID NO: 1676 - protein, 56 aa, Artificial Sequence
  Synthetic sequence.
SMEDRLREVNEKNNRLIEDATRKSERVLDKIRELLKEVKRRSEDVLRRIKELVEKL

SEQ ID NO: 1677 - protein, 59 aa, Artificial Sequence
  Synthetic sequence.
EKTLKELVEKIEKVAEDSLREAEEDVKRIEDLVREIKKRADDDVRRLEDRVRRLRERLE

SEQ ID NO: 1678 - protein, 59 aa, Artificial Sequence
  Synthetic sequence.
SSVEEVVEEIERLVDELRKRAEELVRESEKLVAELERRIRKLVEDSEKLVKDLKDRAAK

SEQ ID NO: 1679 - protein, 59 aa, Artificial Sequence
  Synthetic sequence.
DKVLRKIEDVDRRLKELVRRVKKKDRDSNERVKELVKRLNDENEKVLKRVEELVRRDKT

SEQ ID NO: 1680 - protein, 60 aa, Artificial Sequence
  Synthetic sequence.
DEIKKVVKDLEDLVKRLKDEVDRHVRENERIVEELKRNVDRHVEENRRLVKTLEDEVRKG

SEQ ID NO: 1681 - protein, 55 aa, Artificial Sequence
  Synthetic sequence.
EDLKRVLKAVEDVVREAKERLERVNRTIREVVKRAREKLKRVHDTIRKVVDDARR

SEQ ID NO: 1682 - protein, 59 aa, Artificial Sequence
  Synthetic sequence.
DEVEEVLKELKRSVDETRKLLKKIEDEAKRNVRRNEELAERVKRTVDRLVEELRDLIRR

SEQ ID NO: 1683 - protein, 55 aa, Artificial Sequence
  Synthetic sequence.
EKLKRAEKEDEEVVRRIRELIERLREENEDVIRRAEELLREVVKRIEEVITEARR

SEQ ID NO: 1684 - protein, 60 aa, Artificial Sequence
  Synthetic sequence.
SVEDEIRRVIEELDRLLRKDKETIKRVIKELRDLLREVKKRTEEMIRRLDELLETVTRRI

SEQ ID NO: 1685 - protein, 56 aa, Artificial Sequence
  Synthetic sequence.
VDDVRRLAKEVLDEVKKSVDETKRLADEVKTRVRKNVKDNTDLAREVLRRVAERAR

SEQ ID NO: 1686 - protein, 60 aa, Artificial Sequence
  Synthetic sequence.
SRLEKLVKEIRDVVRELAERVKESVDRARKVVKEDLEHAEESVRRVKKVVKELEELVRKL

SEQ ID NO: 1687 - protein, 55 aa, Artificial Sequence
  Synthetic sequence.
KDIKEVEKRLKDVLDEAHKLNKRTNDELKRVNKESNDLNRKTEEDLKRVLERAED

SEQ ID NO: 1688 - protein, 59 aa, Artificial Sequence
  Synthetic sequence.
KRKEDLVEEIRKIVKAVEDEVRRSVKESEDSVRENLKEAERIVRELEEIVKELEKLVRD

SEQ ID NO: 1689 - protein, 55 aa, Artificial Sequence
  Synthetic sequence.
ELLEDVRKKLEDVLREVEKLNKTVEDKNREVLRRIDELIRRVEEAIEDVRRKVEK

SEQ ID NO: 1690 - protein, 59 aa, Artificial Sequence
  Synthetic sequence.
DEKEELVKRVEDKVKDLRDKVEKSVRESTESVRDNERRVRESVERSRDLVRRLDELVRA

SEQ ID NO: 1691 - protein, 55 aa, Artificial Sequence
  Synthetic sequence.
EELERVRKELEEVLRRAKRLNEDVLEKNREVVRRAAELNKEVKKLLKEVLDRAKT

SEQ ID NO: 1692 - protein, 60 aa, Artificial Sequence
  Synthetic sequence.
DEKEDIDRRLRDMVRRDRELARRSVEEARKLVDKNRKLVERVFRELKKLVDELDELVRRR

SEQ ID NO: 1693 - protein, 55 aa, Artificial Sequence
  Synthetic sequence.
KLLKDLEEELRKTREEVHRLNEETNRRLDKVNKDARDLVRELEELIEDVLRKVET

SEQ ID NO: 1694 - protein, 59 aa, Artificial Sequence
  Synthetic sequence.
DEKETVEERLDRLVRHHEKLVRESVKELEELVRHNRELIKKSVEDARRLVEDLKRLIDE

SEQ ID NO: 1695 - protein, 55 aa, Artificial Sequence
  Synthetic sequence.
KLLDELRERIDKVNEDARKLNEEVERRITESEKEVTDLNRKVDEDIKRVLEKVER

SEQ ID NO: 1696 - protein, 60 aa, Artificial Sequence
  Synthetic sequence.
SVEKVVKDVTDTIKKVVDDARRLSEEVVERNERVNKKLERLSREVVERIKDVLKRLRDKK

SEQ ID NO: 1697 - protein, 56 aa, Artificial Sequence
  Synthetic sequence.
VEDLKRDADRIVEDIKRVVKELVKHAEKSVEDLERVVKEIVKDAERIVREIEKRVK

SEQ ID NO: 1698 - protein, 60 aa, Artificial Sequence
  Synthetic sequence.
DVEEVVRRAREENKRSHDEVRELVKEVNERNKTVLERIKELAERALREIREVLREVDERK

SEQ ID NO: 1699 - protein, 56 aa, Artificial Sequence
  Synthetic sequence.
TEKLKEDLDRIVRTSEELVRRLLERARRMVRETEELMRELLTEVKRIVEEVARRVK

SEQ ID NO: 1700 - protein, 59 aa, Artificial Sequence
  Synthetic sequence.
DKEELLKRVTEKLEKVSDKSRRLIEEVEREVEKVHREVEERVRKVREDVRDVLRKIRAQ

SEQ ID NO: 1701 - protein, 56 aa, Artificial Sequence
  Synthetic sequence.
TELVLREVERLVAENERSVEELKKELEKLVRRNRTLVRKIEEDVRRLVEKITKRRE

SEQ ID NO: 1702 - protein, 59 aa, Artificial Sequence
  Synthetic sequence.
SDSERVKKEAEDVLREIKRLIERNKRLAEETSERIRRLLEELKDLADKIVETLKDLIDR

SEQ ID NO: 1703 - protein, 56 aa, Artificial Sequence
  Synthetic sequence.
REVVDEVEKRIRELLERLKDVSKKVEESNKKLLDEIRETVERVKKRIKELLEELRR

SEQ ID NO: 1704 - protein, 60 aa, Artificial Sequence
  Synthetic sequence.
SLEEVVEEVKRRLTKLLKEIEDVIRRAEEESRRLLEEIERVIREAEKESRRLLEEIRTAG

SEQ ID NO: 1705 - protein, 56 aa, Artificial Sequence
  Synthetic sequence.
EDLVRKLAKELLDTLREVLKRIEEIAKEVLDLNDESLKEIRRIVEEDLRKLEEKMR

SEQ ID NO: 1706 - protein, 59 aa, Artificial Sequence
  Synthetic sequence.
SEEEEVKRLLDDVREKVKRVAEENRRTVEEVKRVVDEVRRRNKETVERDRRELEKVARD

SEQ ID NO: 1707 - protein, 55 aa, Artificial Sequence
  Synthetic sequence.
EEVVREIRRIVEDVRRKVKESVDRVKKILEKVRKDVEDSVREVERTMKKVSDDVT

SEQ ID NO: 1708 - protein, 63 aa, Artificial Sequence
  Synthetic sequence.
SKEETAKRLIEEVRKVIEEVKKRAEDSNDHNRRSIEEVEKTLKRLIDEVRRVVEEVKEKISRT

SEQ ID NO: 1709 - protein, 55 aa, Artificial Sequence
  Synthetic sequence.
KEAVEEIERLMRKIKKVVEDSVRNVERTMREVEEKVRKVEEDVRRLAEDVTRAVK

SEQ ID NO: 1710 - protein, 56 aa, Artificial Sequence
  Synthetic sequence.
DEVEEVLRRVRKIVKEDRDEAKDVREENRRLVEDDKRKVERVKEENRRLVEELRKR

SEQ ID NO: 1711 - protein, 56 aa, Artificial Sequence
  Synthetic sequence.
RRLLEEVERRVEKLVKESREIAKRSNDRTKDLVRRSEEILRESNERTRRLLEETER

SEQ ID NO: 1712 - protein, 56 aa, Artificial Sequence
  Synthetic sequence.
SEAEKVLKDIEKIVKDLERNAKEVLDRNKRNVEDDKRAAEEVLEKLERIVREIDRG

SEQ ID NO: 1713 - protein, 56 aa, Artificial Sequence
  Synthetic sequence.
RELLKKVIRTVEKLLEDVHKLNEDSERAAKKLTDESREIAREVEERVERLLREEER

SEQ ID NO: 1714 - protein, 57 aa, Artificial Sequence
  Synthetic sequence.
REVEEAEKRLREIVKEVTERNKEVVERLRDIVRKSEDDSRKSVETNKEIVDRVRRDV

SEQ ID NO: 1715 - protein, 56 aa, Artificial Sequence
  Synthetic sequence.
RDVLRELIRTLEEVLKRSEDTNRELEKRIKEVVEDNRRKLEESIKESEKVVDEIRK

SEQ ID NO: 1716 - protein, 57 aa, Artificial Sequence
  Synthetic sequence.
SEVEEAERRLKEIAEESKEISKRSVETNAKILDEVRRENTRVLETLKKILEEVERRV

SEQ ID NO: 1717 - protein, 56 aa, Artificial Sequence
  Synthetic sequence.
KDELERLIEDIREVVERNKKIADESIKRSRDVVKRSKETNDELEKTIREVVKRIED

SEQ ID NO: 1718 - protein, 57 aa, Artificial Sequence
  Synthetic sequence.
DEVEEVLKRLRDILREAKELVERSVKRNEEIAEESRKESEESVRRNEEIVDAVRKRV

SEQ ID NO: 1719 - protein, 56 aa, Artificial Sequence
  Synthetic sequence.
RRVLERLIRELERVLEELREKLKRSIEESEDVVRKNREILRRSIEKSEDVVRKIET

SEQ ID NO: 1720 - protein, 59 aa, Artificial Sequence
  Synthetic sequence.
DVDEVLDTVRRLVEELLKKVERTSRESVRLAEKLLDEVRESSKRSKDESRRLLEEVREI

SEQ ID NO: 1721 - protein, 59 aa, Artificial Sequence
  Synthetic sequence.
REKVDKVRRDVERLVEEVEKTVKRSVEENRRIAEEIKRTVEESVKTNEEVVKRIEETAR

SEQ ID NO: 1722 - protein, 58 aa, Artificial Sequence
  Synthetic sequence.
RERELVEEVERRLRESNERVKESVDRSRKLLETSHRRVKELVDRLKRVLERVEREVRN

SEQ ID NO: 1723 - protein, 55 aa, Artificial Sequence
  Synthetic sequence.
DELVKRVKEVVDHNERLAEESKKEVDDVVRRNEDLVRKVVEEVKDVVRRIKETVR

SEQ ID NO: 1724 - protein, 58 aa, Artificial Sequence
  Synthetic sequence.
RERELVEEVERELKRSTREVEESIEESRKRLEESHRLVAELVKRLEEVLERVRDDVRR

SEQ ID NO: 1725 - protein, 55 aa, Artificial Sequence
  Synthetic sequence.
DELRKRVEEVVRTNEELARESVRKVKEVVRRNKELVARVADKVREVVKRIRETLK

SEQ ID NO: 1726 - protein, 59 aa, Artificial Sequence
  Synthetic sequence.
SVKEIVKKVVEENKKSDDELREFARRVAERNKRVVEELKKRLEDLVRKNEEVVDRLRKR

SEQ ID NO: 1727 - protein, 59 aa, Artificial Sequence
  Synthetic sequence.
SEIVKEVVDRVRKSEESSRKLLEEIVRLVEKSLEEVKRILDEIRRRVEKSERDVRRLRK

SEQ ID NO: 1728 - protein, 57 aa, Artificial Sequence
  Synthetic sequence.
DIVEELKENVKRVEETIRKIVKEARENVDDVLKKNKDNVEHDKRTAEEVLKEVKKSI

SEQ ID NO: 1729 - protein, 60 aa, Artificial Sequence
  Synthetic sequence.
KDTVRRLLEEASKLNKDVIRRVRELLKRLHERNEESLRRARELNERSRREAERVLEEVRK

SEQ ID NO: 1730 - protein, 60 aa, Artificial Sequence
  Synthetic sequence.
SIVDRIREIMKEVREKVKRVVEENRRNAERIKRRVDEVVKTNRKTVDDVRRKVEDVVRKI

SEQ ID NO: 1731 - protein, 60 aa, Artificial Sequence
  Synthetic sequence.
REVVEELLRRLRKIVKDVERELKRSTEELNRRSREVLKELEKSTRDVEKVVRELEERLRK

SEQ ID NO: 1732 - protein, 60 aa, Artificial Sequence
  Synthetic sequence.
SVVDKIREIVRKSREDVRRVVEEIKDNARDLKRKAEEVVKEVKRIVDEVRETVRDVVEKI

SEQ ID NO: 1733 - protein, 60 aa, Artificial Sequence
  Synthetic sequence.
EEEARKLLEDVKKSSDDVRRELKRLLEEVNRVSREAEKKLRELLERVKRIIDTLKDELRK

SEQ ID NO: 1734 - protein, 60 aa, Artificial Sequence
  Synthetic sequence.
SVKDEIRRIVKESEEANRDVVEKIRRNVERIRRKVERVVEEIKRIVKEVKEKVEDVVRKN

SEQ ID NO: 1735 - protein, 60 aa, Artificial Sequence
  Synthetic sequence.
EEVVRKLLEEVKKSSDESKDRSRRLLEEVNRISRDVERKLEELLRKVEKVVRDLEEELRR

SEQ ID NO: 1736 - protein, 58 aa, Artificial Sequence
  Synthetic sequence.
SAEDVVRELKKRVDRSREDNTRVLEELKKAVEESRRLNEESNRRLEKIVRDIKEDLKR

SEQ ID NO: 1737 - protein, 59 aa, Artificial Sequence
  Synthetic sequence.
EEVLRELAKIREDIERENKRVLEELEDVLRKVKRVNEEALKNSEDILRDIKEKVDRRRK

SEQ ID NO: 1738 - protein, 59 aa, Artificial Sequence
  Synthetic sequence.
SVEELLRKLEEVLRKIREENERSLKELRDRAREIVKRNRETNRELEEVIKELEKRLSRR

SEQ ID NO: 1739 - protein, 59 aa, Artificial Sequence
  Synthetic sequence.
EDIVRKIERIVETIEREVRESVKKVEEIARDIRRKVDESVKNVEKLLRDVDKKARDRKK

SEQ ID NO: 1740 - protein, 61 aa, Artificial Sequence
  Synthetic sequence.
SEEEKVKEEIRKLIEDSRRHVDELKKRLEKLLRDSEKNVEDAHRTNEKLARELKEKVKKTG

SEQ ID NO: 1741 - protein, 55 aa, Artificial Sequence
  Synthetic sequence.
EDVLREAEEMLRDSNRELREILEKIERDLRKSDEELKKSVDDLRRLIKEVEDRLK

SEQ ID NO: 1742 - protein, 61 aa, Artificial Sequence
  Synthetic sequence.
SREEELKKELKKRIEDSDRHVKEEKDELDRLIRESEEHVKRLKEEARKKLERLKDLVRKDG

SEQ ID NO: 1743 - protein, 55 aa, Artificial Sequence
  Synthetic sequence.
EKVLREAEELLKEVDRKLERILEEIKRRLEKSDRDLRRVLKELEELIDEVRRRLE

SEQ ID NO: 1744 - protein, 61 aa, Artificial Sequence
  Synthetic sequence.
SEKEDIKERIKELLKRSEENVRKLREENRELVRRSEENVKEIHKENEDLIRKLEKLRTRDV

SEQ ID NO: 1745 - protein, 55 aa, Artificial Sequence
  Synthetic sequence.
EDVLREAKEALEESLRRLRKIHEDSERRLRESLEELRRSVEEAKRLLERLKRELD

SEQ ID NO: 1746 - protein, 61 aa, Artificial Sequence
  Synthetic sequence.
DELDRVIEEAEELIRRIEEKLRRINETAKRLLDENLRHSERVHEEINRALERVRKKVEDAG

SEQ ID NO: 1747 - protein, 56 aa, Artificial Sequence
  Synthetic sequence.
VKDVKDRLRRIIEELERRVRELKKRHEDILRELNRRSKELKDRHKKILEDLDRRVR

SEQ ID NO: 1748 - protein, 61 aa, Artificial Sequence
  Synthetic sequence.
EEVERVIDEARRLLRENERHSEEVIEEITKLIRDVEEKVKRINDRAREALEDIREEVKRKG

SEQ ID NO: 1749 - protein, 56 aa, Artificial Sequence
  Synthetic sequence.
VDELRKELERLIRDLNRLSKRIKEELKRRIEELEEEVKRLKEEHERIIEELRRRVK

SEQ ID NO: 1750 - protein, 59 aa, Artificial Sequence
  Synthetic sequence.
EEVERAKKELEDRIREWEEDSKRLKDELKRIIKEWEDESRRVKEELRKIIDDLRKAVEK

SEQ ID NO: 1751 - protein, 55 aa, Artificial Sequence
  Synthetic sequence.
ERILEEARRLVRRVHESSKRVLDDARRKLKELHERSKRVLDDVRRKLKKVADDTR

SEQ ID NO: 1752 - protein, 60 aa, Artificial Sequence
  Synthetic sequence.
SEVERIKEELKRIIEDWDRRSRRLKEELKKEIKDWEEDSRRLKRELEEELKKLKEKVERG

SEQ ID NO: 1753 - protein, 55 aa, Artificial Sequence
  Synthetic sequence.
KKIIDEARRLLEELHRKSREVAKEIRKEVKRLHDTSKKVLEDIRRAVKKVADDVK

SEQ ID NO: 1754 - protein, 59 aa, Artificial Sequence
  Synthetic sequence.
SEVEKIKRDLEEIIRRWEEDIKRVKKRLDEEIRRWEEESKKVKKKLEDLIRRLEKEVAD

SEQ ID NO: 1755 - protein, 55 aa, Artificial Sequence
  Synthetic sequence.
EKILEDARREAERLHKTSKDVLKKVEDLLRRVNEHSRRVLEEAERRIRDVAEKTR

SEQ ID NO: 1756 - protein, 59 aa, Artificial Sequence
  Synthetic sequence.
SEVEDIKRRLEKIIEDWRRKSKELEKRLEDIIDEWDKRSRKLKEDLKRIIEEARKAVDD

SEQ ID NO: 1757 - protein, 55 aa, Artificial Sequence
  Synthetic sequence.
EKVIKEAEDLLRELNESSRRVAKKAKDDLRELNERSRRALKEIRELLREVRERVE

SEQ ID NO: 1758 - protein, 61 aa, Artificial Sequence
  Synthetic sequence.
REVEKIITDLEEVIRRVEEYLKRSDEELEKELRRVKRYLDKSDKDLRDEIRRVKEELDKRG

SEQ ID NO: 1759 - protein, 56 aa, Artificial Sequence
  Synthetic sequence.
KDELRARVEDVVRRAEDELRRHSELNKRLVDEARKLLEDHSRRNEELMRELRKLVE

SEQ ID NO: 1760 - protein, 60 aa, Artificial Sequence
  Synthetic sequence.
SELEDILRKLEKRMTDVERYLDESNKDLERAVRRVVETLKRIDDEIRRLLEEVERDLDRK

SEQ ID NO: 1761 - protein, 56 aa, Artificial Sequence
  Synthetic sequence.
KDELETRLREITKTAEDELRKHSRTNEDIVRELKELVDEHEKELRKVVREAEDESR

SEQ ID NO: 1762 - protein, 61 aa, Artificial Sequence
  Synthetic sequence.
SELEEILKDLERMIREVEDYLRKSNERLEDVLRKVKKKLDEINDELRRVVEEVKKKLEDKG

SEQ ID NO: 1763 - protein, 56 aa, Artificial Sequence
  Synthetic sequence.
AEELKRRLEEIVKRARDLLKEHSDDNERLVERAERLVEEHRDKVRKIVEELEEEVR

SEQ ID NO: 1764 - protein, 61 aa, Artificial Sequence
  Synthetic sequence.
SEIERILEEVERAVRESDERLKDIVRKDREVVKRVKELLDKILRKDEEAIKRVIEDLERRG

SEQ ID NO: 1765 - protein, 56 aa, Artificial Sequence
  Synthetic sequence.
KDELKKEVDKWVKRARDIVKELEEHSRRSTDELRRTVEDLERHSEESVRRAEKTSE

SEQ ID NO: 1766 - protein, 61 aa, Artificial Sequence
  Synthetic sequence.
SELEKILKKIEDALKKVEEDLDRILEEDRKTLEEVKERLERDNEDLKRVVERVEEELKRRG

SEQ ID NO: 1767 - protein, 56 aa, Artificial Sequence
  Synthetic sequence.
TDELRKDVDRLVKRLKKLVDDLRRKSKETADRLRELVKRSRELSRTLAEELRKKTE

SEQ ID NO: 1768 - protein, 59 aa, Artificial Sequence
  Synthetic sequence.
SEDEEAKKRVEDLVRELKKSNDELRRKSEESLRRLKELNDELRKRVRDLEDRLRKLVED

SEQ ID NO: 1769 - protein, 55 aa, Artificial Sequence
  Synthetic sequence.
ERIIEELDKELKKSSEETDEIVKRDEDVLRRSDEESRRIIKKLEDVLRRADERVK

SEQ ID NO: 1770 - protein, 60 aa, Artificial Sequence
  Synthetic sequence.
SKDEEAKKRVEELTRKLEETVREDKKRIEDLAEKLKKVVDKLRRDSERTRKKLEEVERKG

SEQ ID NO: 1771 - protein, 55 aa, Artificial Sequence
  Synthetic sequence.
ERILRELEKVLREVKKKHKETLRTLEELLREVAKRAEDINEEDRKVLEDVVRKLT

SEQ ID NO: 1772 - protein, 61 aa, Artificial Sequence
  Synthetic sequence.
SEVEEILEDIRRRMTRVEERLRKSNKELEDAIREVTKRLKKSLDDLKKIIEEVKDVADKKG

SEQ ID NO: 1773 - protein, 56 aa, Artificial Sequence
  Synthetic sequence.
AEELRKMVEDLTKELEDLVEEDKERVKRWRDELEEIVKRDRDKVERWREEAEKIKK

SEQ ID NO: 1774 - protein, 61 aa, Artificial Sequence
  Synthetic sequence.
SELEEILRDVERLVRKVKTDLDDSLRRLKEVIDDVERLLRESNEKLRRVIKDVEDLADKKG

SEQ ID NO: 1775 - protein, 56 aa, Artificial Sequence
  Synthetic sequence.
EEALKKLVEDLRKRLREVVEEDKEKVRRWTEKAKRIVEDDKRRVEEWERKLEETVR

SEQ ID NO: 1776 - protein, 62 aa, Artificial Sequence
  Synthetic sequence.
DEVERVLDDVRRKLEKVRRDLRRIDEDLRRVVETVKRLLDESNKDLERAVRKVKDELDKKVR

SEQ ID NO: 1777 - protein, 56 aa, Artificial Sequence
  Synthetic sequence.
EEELRRVVKELKEDLERLVRELEETVREVKEELEKVVRDDEKLVEEWKKRLEERSR

SEQ ID NO: 1778 - protein, 61 aa, Artificial Sequence
  Synthetic sequence.
EEVERVLDDIRRVVEEVKRRLDEIDKKLTEENERVKEELDRIDDRLRKLVEEVKRRLDEKV

SEQ ID NO: 1779 - protein, 56 aa, Artificial Sequence
  Synthetic sequence.
REELEKVVEDIKRKLEKAVRDLEKTVKENKDRNDDIVRRVKKTVDDAEERLRRAVK

SEQ ID NO: 1780 - protein, 61 aa, Artificial Sequence
  Synthetic sequence.
KEVEDILRELRRAVEEHRRRSEELLRRMRKLVKDLEDRIREILERARRSVKEIKDRIEKDG

SEQ ID NO: 1781 - protein, 56 aa, Artificial Sequence
  Synthetic sequence.
EEVLKEVKKLLDEVRKRSKDIVDEVRKLLEEVLKEAERVLREWKKLNDEVEDRLRQ

SEQ ID NO: 1782 - protein, 61 aa, Artificial Sequence
  Synthetic sequence.
SEVEEVLKEVRKLIEDWRANSERILRRIERAIRELRRKIREWLERSKKKIKRLEEVIDKEV

SEQ ID NO: 1783 - protein, 56 aa, Artificial Sequence
  Synthetic sequence.
EDVLREARKRVDELEKRSREVAKRARDLLKEVRDKIKEVADRSRDLLRKVEEAIEK

SEQ ID NO: 1784 - protein, 60 aa, Artificial Sequence
  Synthetic sequence.
SAEEVDRRVEELLKELERRSEEVLETWKELNKKLNKDAKDVTDEVRELLKELAELIKRDG

SEQ ID NO: 1785 - protein, 59 aa, Artificial Sequence
  Synthetic sequence.
EEVVRRLLEDLRRLIDEWRKRSKEVEEEVRKSIEDIKRRIEEILRRIRKLIEEIRRRIK

SEQ ID NO: 1786 - protein, 59 aa, Artificial Sequence
  Synthetic sequence.
DEDERVKDLLRRVKKTVDELLEELKREVKKSREEAKRLLKELEDRLRRSRKEAEKLRSS

SEQ ID NO: 1787 - protein, 56 aa, Artificial Sequence
  Synthetic sequence.
REVLEEAKKILDDARRAIEEIIREWEEVNKEVDDRIDRIVEEWRKVNDKVNKDLTT

SEQ ID NO: 1788 - protein, 61 aa, Artificial Sequence
  Synthetic sequence.
SEEEKIVEDLRREVKRLAERVKELIETSKKLVEDSKRHVKDLARRLRDIIRKLKKDLRDKG

SEQ ID NO: 1789 - protein, 55 aa, Artificial Sequence
  Synthetic sequence.
RRALEELEKVVREIRRELERVHEETRRVIEESNRELEEILREAKELLEEVKKEAE

SEQ ID NO: 1790 - protein, 64 aa, Artificial Sequence
  Synthetic sequence.
RELEKALEEAKRLLDKVRKELKKIHEESRRLLKETRDETRRVLEEAERLLREIKKLIDRLREDR

SEQ ID NO: 1791 - protein, 59 aa, Artificial Sequence
  Synthetic sequence.
EEDVRRLVEELRDLIRELERKVKEVVETSRRLAEKDKEDNKRILEELRRLIRELEEDVR

SEQ ID NO: 1792 - protein, 60 aa, Artificial Sequence
  Synthetic sequence.
EEIERVEKLVEEVVRRAEDELRRSAEHVDRVVERAERLVERSREHSKDLMRRLEEVLRRG

SEQ ID NO: 1793 - protein, 59 aa, Artificial Sequence
  Synthetic sequence.
EDKAREIIERLRDVLRKIEEALERISRKLKEVLRRVEKKLEEDSRTLTRVVEEAKKKLD

SEQ ID NO: 1794 - protein, 60 aa, Artificial Sequence
  Synthetic sequence.
KEIEELDEEVRRLVEELKRLSDESRKHSKRLVEELKKLLEDSKRHSEELARRARKVLREG

SEQ ID NO: 1795 - protein, 59 aa, Artificial Sequence
  Synthetic sequence.
REDAERIIKKLEDVMKRAEETNRRDIKKLEDVLKDVEDKLREDSKRLREVLEEVKKRLE

SEQ ID NO: 1796 - protein, 59 aa, Artificial Sequence
  Synthetic sequence.
SEVEEILRDIERASEESKKTLDRILKKIEDASRRSKELSDKSLKEIRDAMEEIKKELDK

SEQ ID NO: 1797 - protein, 56 aa, Artificial Sequence
  Synthetic sequence.
SEELDRRVKELVRKSEEELKDLDREVKELVRRSEELLEDDKRLVKEVVDEARERRR

SEQ ID NO: 1798 - protein, 57 aa, Artificial Sequence
  Synthetic sequence.
DELEDVKRRVDEIVRELERLNEKLRRDVEEIVKRLKELNKRLLEEVRRTAEELKTKN

SEQ ID NO: 1799 - protein, 58 aa, Artificial Sequence
  Synthetic sequence.
EELREILKELKRVLDESRKLSKEIEEELERVLRDSERATEEILRELEKIIEEVERKVR

SEQ ID NO: 1800 - protein, 57 aa, Artificial Sequence
  Synthetic sequence.
DELEEVRKRVERIMEELKRHLEKIAKDSKKSVDELKKHLEDADRKSEESVRKLERDN

SEQ ID NO: 1801 - protein, 58 aa, Artificial Sequence
  Synthetic sequence.
RELEDILRRLEEVSERHRRSIEEILRRNEEASRRHRESIRRILEKNRRVLERVERKVE

SEQ ID NO: 1802 - protein, 60 aa, Artificial Sequence
  Synthetic sequence.
EEDERAKERVKRVVEENDKVNEDVEREVRKVVKENEDVLEEIKRTVDKIVEDLERLVREG

SEQ ID NO: 1803 - protein, 55 aa, Artificial Sequence
  Synthetic sequence.
ERILKELEDANEKSKKRSREILERLREANERIEETARRILKKLEEVLEEVERRTT

SEQ ID NO: 1804 - protein, 59 aa, Artificial Sequence
  Synthetic sequence.
KEREDVKREVEKSVEDLRRHVRDVEEKVRKIKKELEDHVRELKKRVEEIRRRLKDLADR

SEQ ID NO: 1805 - protein, 55 aa, Artificial Sequence
  Synthetic sequence.
ESVLEELKRANERHKREIERIRKELEDVSKEHEDRIRRVLEELERVLEEVKRRVD

SEQ ID NO: 1806 - protein, 60 aa, Artificial Sequence
  Synthetic sequence.
SEEERAKEEVEKHKRRLEKLVRDAERSSTEHERKLREIVERVKRELDKHEEKLRDIERKG

SEQ ID NO: 1807 - protein, 55 aa, Artificial Sequence
  Synthetic sequence.
EEVIREVEKISREVTKLLRDNLKRVEEVTERVERTLDELLERVKEVTKEVKERLR

SEQ ID NO: 1808 - protein, 60 aa, Artificial Sequence
  Synthetic sequence.
SERERAEELVRRHEDRLEKLVRELEESSDRHKKRLKRLVEEVRRLIEEHRRRLDEIKKEG

SEQ ID NO: 1809 - protein, 55 aa, Artificial Sequence
  Synthetic sequence.
EEVLRKVRTVSTEVKKRLDRNLEEVKKLTEDVTRKLRRLLEEVNKITRDVKREIK

SEQ ID NO: 1810 - protein, 57 aa, Artificial Sequence
  Synthetic sequence.
SELDEVRERLKRIVDDLRRRSEEVNKRLEEILREITERLREVNERLADIIRKIREDR

SEQ ID NO: 1811 - protein, 56 aa, Artificial Sequence
  Synthetic sequence.
EEVLKKLVEELRKRVEDMARTHDRLVEELKRKADEIVRRHEELVKDLKRKLEEVKT

SEQ ID NO: 1812 - protein, 59 aa, Artificial Sequence
  Synthetic sequence.
SEEEKAKELVKELRKEAKKIVDEMRKLVEDHAKLVEELVRDHKRLVDEHRRLIEELKDR

SEQ ID NO: 1813 - protein, 55 aa, Artificial Sequence
  Synthetic sequence.
EDVLRELEEIVRDIRKKIDDVIRKLEDISRKARKDSDDVNKRLNELTDDVRRKLT

SEQ ID NO: 1814 - protein, 59 aa, Artificial Sequence
  Synthetic sequence.
EEEERARDLVRRLEEIVRRLVKEHEDLVRRHKELVDKLVREHEKLLEDHRKLVEELKDR

SEQ ID NO: 1815 - protein, 55 aa, Artificial Sequence
  Synthetic sequence.
EEILERARKIVERLKTESDRVNKRLNEITRELEKRSDEVNTEVRRITKKVTEELK

SEQ ID NO: 1816 - protein, 59 aa, Artificial Sequence
  Synthetic sequence.
SEEERADKLVKELKKMAEDIKREMDKLVEELKRTIDELRKKHKELVDRHRRLVEELARR

SEQ ID NO: 1817 - protein, 55 aa, Artificial Sequence
  Synthetic sequence.
EEVLKTLKEIVRKIEEEIDRVEKRLRELVKELKDDSDEVNKEVNKITRKVKEELR

SEQ ID NO: 1818 - protein, 56 aa, Artificial Sequence
  Synthetic sequence.
RTEEEAERTVEDVARKVKEWREELEEVVKEVRERVKRWKEEMRKLDEDTKKKLDDA

SEQ ID NO: 1819 - protein, 55 aa, Artificial Sequence
  Synthetic sequence.
EEVIERIERILKDLHRDSERVLRELKRILDELHRESKESNERNKKLVEDAERRTK

SEQ ID NO: 1820 - protein, 56 aa, Artificial Sequence
  Synthetic sequence.
DTEKDAKRTVDDVRRKIREWEERLKKIVEEVKELVRELVERAKRLDEETEREAREA

SEQ ID NO: 1821 - protein, 55 aa, Artificial Sequence
  Synthetic sequence.
EEVIKELEDLLRRLHEESKRVLDTLRRILEELRDRVRRSNKRNEEIVKELEDRSR

SEQ ID NO: 1822 - protein, 56 aa, Artificial Sequence
  Synthetic sequence.
SEEDKAREVLKRVRDEVEKWRKELERLDEESKKKVDDLVRELEELDKKTDEELRRM

SEQ ID NO: 1823 - protein, 55 aa, Artificial Sequence
  Synthetic sequence.
EEILKKIRRILEKLHEDSRRSNETNRRILEELEKRVRESNKRNEDILREVKRKAK

SEQ ID NO: 1824 - protein, 56 aa, Artificial Sequence
  Synthetic sequence.
KTEEKVERDVERVKRDVDELIRRAEEVVKRVEDEVRKWIKELKELDDETERLVREA

SEQ ID NO: 1825 - protein, 55 aa, Artificial Sequence
  Synthetic sequence.
EEVIKRIKKILDDVRRAVKEVLDRIRRILEKVHEDSRRSNKRNKEILDKVREDTR

SEQ ID NO: 1826 - protein, 56 aa, Artificial Sequence
  Synthetic sequence.
SDEERVKEELKRILDEARRLLEESDEKLKRILDELRERLKESDERLKRILDKVRKD

SEQ ID NO: 1827 - protein, 56 aa, Artificial Sequence
  Synthetic sequence.
SEELEKEVRELKKRLKKLIDESDKNVKEAEKELRELLRRSEEHVKELKKDADRESK

SEQ ID NO: 1828 - protein, 56 aa, Artificial Sequence
  Synthetic sequence.
DDERRVKEKLKRILDESRDMLRRSDERVERSVRTLEDALRRSDEKLERILKKAEDD

SEQ ID NO: 1829 - protein, 56 aa, Artificial Sequence
  Synthetic sequence.
SKELDDAVKKNKKESKETVDRSEKNVKELHDRNEELLRRSEKNVDDAKRRLDDTSR

SEQ ID NO: 1830 - protein, 56 aa, Artificial Sequence
  Synthetic sequence.
DDEERVKKALDEILDRSRRRLEESDEKLDRSLKTLKKLLEESDRDLERILEKAERD

SEQ ID NO: 1831 - protein, 56 aa, Artificial Sequence
  Synthetic sequence.
REELEEAVRRNDEESKKTVDDSRRHVDELHRRNEKLIEESKDHVRRLEEELRKKSK

SEQ ID NO: 1832 - protein, 57 aa, Artificial Sequence
  Synthetic sequence.
DEKEELSERVERVIRTAEKLLDEIKRKLEEIHKKANEDLERSLRKLEKVVKEVRDAG

SEQ ID NO: 1833 - protein, 56 aa, Artificial Sequence
  Synthetic sequence.
EDELREDVERVKRRLEELIERLRKKVDEVKERHERMLKRSEEHVKELKDEVTEEAK

SEQ ID NO: 1834 - protein, 59 aa, Artificial Sequence
  Synthetic sequence.
SEKEELEKEVEDLERRHREELEKLNRKSKKIDEDLKRIIEELNKVSKKIKEDLEREIRK

SEQ ID NO: 1835 - protein, 55 aa, Artificial Sequence
  Synthetic sequence.
DEVRKRVEDINREVKEMLERNLRHTEEVIKKADREIEKNERHTREVIREAEERLR

SEQ ID NO: 1836 - protein, 57 aa, Artificial Sequence
  Synthetic sequence.
SEVEEVDKKLETSHRDIEKRIREVLRELEESSRKLKRDVDEVLKKLEESHRRIAESL

SEQ ID NO: 1837 - protein, 56 aa, Artificial Sequence
  Synthetic sequence.
SKRLEELVKEHKRTLEEVKRRLEELVKKHRKDLEDLVREAEELVERHKRKLDETEK

SEQ ID NO: 1838 - protein, 57 aa, Artificial Sequence
  Synthetic sequence.
SEVEEVDKEVERILDEARKALKRVEERVRKSHEDIRREIKRVEEDLERSSREIREKL

SEQ ID NO: 1839 - protein, 56 aa, Artificial Sequence
  Synthetic sequence.
AEKLKKLVEELEKEIRRLVDELDKLVRKHEEELDRLRKRMDELVKEHKKRLDDTAK

SEQ ID NO: 1840 - protein, 63 aa, Artificial Sequence
  Synthetic sequence.
DDEERAKKRVKEAEKEIKDLAKESRDIVEKHRKEVEDVVREMERIVRELAEEAKDVVRKVKDD

SEQ ID NO: 1841 - protein, 54 aa, Artificial Sequence
  Synthetic sequence.
EVKDRLRDVLKKAEEMSKEVEDRLRKSSEDLREEVERVEEELKRVLRKIEEDIR

SEQ ID NO: 1842 - protein, 63 aa, Artificial Sequence
  Synthetic sequence.
DDRERAKKTVDKVKEDLTRLVRRSEDLVRRHTEKLERVVEELERIVKELEERLKKVVDDVKDR

SEQ ID NO: 1843 - protein, 54 aa, Artificial Sequence
  Synthetic sequence.
DVKRTLREILRELEEASREVEERLKESDDRIRERVREVDEKLDRVLEELRKKMT

SEQ ID NO: 1844 - protein, 56 aa, Artificial Sequence
  Synthetic sequence.
DELEKVRKELKEILDKLKDVLEESRERTDRLLRKAEEDLRRSDEETERLVKELKDA

SEQ ID NO: 1845 - protein, 56 aa, Artificial Sequence
  Synthetic sequence.
KDELKKLVEDLDREVRKIVEELKELNKRIEDELRRIVDEARRSNEKVKELIDRLRK

SEQ ID NO: 1846 - protein, 56 aa, Artificial Sequence
  Synthetic sequence.
DEVETVEREADRILKEDEDVLRRSKKITEDILDTLREMLERSERRTEEILKRLEED

SEQ ID NO: 1847 - protein, 56 aa, Artificial Sequence
  Synthetic sequence.
KDELKKLVDELKERSKETERELKESNDRLRKKVEDIRRELKRLNDEAEEAVRRLRT

SEQ ID NO: 1848 - protein, 56 aa, Artificial Sequence
  Synthetic sequence.
SLIERIEEEIRRVIERVRRLVREIEDSDRKAKEDLERVVREDEETLRRVEKKLKDL

SEQ ID NO: 1849 - protein, 59 aa, Artificial Sequence
  Synthetic sequence.
EEEVKKLLEKVKRTARELEKVAEDMLRSNRELVKELLRTLEKSLRDSERTAEKLERAEK

SEQ ID NO: 1850 - protein, 56 aa, Artificial Sequence
  Synthetic sequence.
DKEKEISDRLKDVLRKVRDVIEKDKRTNEEARKRVEDLVRKDEETLKRVLEEVRKG

SEQ ID NO: 1851 - protein, 56 aa, Artificial Sequence
  Synthetic sequence.
LEDLLRKVEKLAREITERLKESNERSRDLVEKLKREVKKSLRKSERLMEKARETLR

SEQ ID NO: 1852 - protein, 56 aa, Artificial Sequence
  Synthetic sequence.
SEREEVKRTLTKAEEEARRLIKRDRDTNTEILKEATERSERDKDKLRKILEEVKKA

SEQ ID NO: 1853 - protein, 55 aa, Artificial Sequence
  Synthetic sequence.
KDILDRVRRLVEELRRMIEELNDKSRKLVERLRKLLEDLNRHLEELVKRLRDKAK

SEQ ID NO: 1854 - protein, 56 aa, Artificial Sequence
  Synthetic sequence.
SAKEELEDRIRDIVRRVRELITEVKKKNREILKRVEKVIKEVKETNERIEEEVRRG

SEQ ID NO: 1855 - protein, 56 aa, Artificial Sequence
  Synthetic sequence.
IDKARKEVEDLVRDAKRVIEELERSLDELVRTLDELVRRLKKSSEDLMRELRKTTE

SEQ ID NO: 1856 - protein, 56 aa, Artificial Sequence
  Synthetic sequence.
DEKKEVEKRLKEIEDEVRKMIKEVKETNRRILKKARDLIKKVEDTNKRILEEVRRG

SEQ ID NO: 1857 - protein, 56 aa, Artificial Sequence
  Synthetic sequence.
IKKLEDEVRKLKDELRRELERLKRSSTDLARRLEEIIRRLERSSEDLERRLRERER

SEQ ID NO: 1858 - protein, 56 aa, Artificial Sequence
  Synthetic sequence.
DEKEEVRKRLTDILRELEDLSRENERSNRRILDRVRELIERVKKTNKDILEEVERG

SEQ ID NO: 1859 - protein, 56 aa, Artificial Sequence
  Synthetic sequence.
IDKLRREVEELVRDLRRLIEELSRSSEELVKELEKLLRELEESSKKLAEELRKAVE

SEQ ID NO: 1860 - protein, 60 aa, Artificial Sequence
  Synthetic sequence.
SSKERIKEKVDRIEERIREVVKEVEEELRRSTEEARRMVREVKRRLEDSNRKIKKFIDEK

SEQ ID NO: 1861 - protein, 56 aa, Artificial Sequence
  Synthetic sequence.
SEELKRLLEDLRRKIEELAKELKKLLEEHKRRVDDVVRRMEELLKRHEELVRRIAK

SEQ ID NO: 1862 - protein, 58 aa, Artificial Sequence
  Synthetic sequence.
SEAEEAKKTVEEISERLREALRRSEEETERILRENEKASERHKTEIEKITKELEDKLG

SEQ ID NO: 1863 - protein, 56 aa, Artificial Sequence
  Synthetic sequence.
KDELKKVLKEIEDTVRRIVKELEDLNTEAEKASRKSVKELEEHLKRVEERVREEAK

SEQ ID NO: 1864 - protein, 59 aa, Artificial Sequence
  Synthetic sequence.
ELKERLEKLLKDWADDSKRMRDELARLLKEWEDRSRKAKRDLEKILEENDDKVKKLDKV

SEQ ID NO: 1865 - protein, 59 aa, Artificial Sequence
  Synthetic sequence.
EKVLREVKESAKKISRHSEKVLDEARKELERISEHSRRVLDRVRRESKKIVEDLRERKR

SEQ ID NO: 1866 - protein, 60 aa, Artificial Sequence
  Synthetic sequence.
DIERELEEIVRRIKELIRRHKKRLEELVRELEELLRRHREELKKLVKRAAELVEELRRRN

SEQ ID NO: 1867 - protein, 55 aa, Artificial Sequence
  Synthetic sequence.
DTVKDMLRKLLEEVKEASDRAREKLTDILRKIKKISEEVKREIDDIRKKIEDTAK

SEQ ID NO: 1868 - protein, 60 aa, Artificial Sequence
  Synthetic sequence.
SIEEEAARIVEELRREVEEWERTLREIVERLRRLVEEHKRRLDELVAELKRLVDELRKEN

SEQ ID NO: 1869 - protein, 54 aa, Artificial Sequence
  Synthetic sequence.
DIRRKLKEILDELDTITEKLKKELERIKREMKEASRRVREKIDRIRKEIEEVAR

SEQ ID NO: 1870 - protein, 56 aa, Artificial Sequence
  Synthetic sequence.
DEIRELLKRIRDVAKRIKDKADRLNEKSRRKVEKLVRDVEKINEDTKRLLDRLRDS

SEQ ID NO: 1871 - protein, 59 aa, Artificial Sequence
  Synthetic sequence.
EDVLRELERLLKEIEDLVRELNKTNKKIVDKARKDVKDVHRTNERLLREIERVVREKLK

SEQ ID NO: 1872 - protein, 56 aa, Artificial Sequence
  Synthetic sequence.
SEAEELLRRLEKIIEDLERNARALLEKLKEEIRRLDKNLRDLLRRIEKIMRDLTRS

SEQ ID NO: 1873 - protein, 59 aa, Artificial Sequence
  Synthetic sequence.
EEVLKEIKRVLEEAEKVSEDLLREIKEVLDRAEELSRRLLKTLEDLLRDIERSVKERED

SEQ ID NO: 1874 - protein, 57 aa, Artificial Sequence
  Synthetic sequence.
SSKEKVEELVKEIEEEDRRVLEDTRRLLEEIMRRDEDVLRKTDERIKEIEKELRDRV

SEQ ID NO: 1875 - protein, 56 aa, Artificial Sequence
  Synthetic sequence.
SKEAEDRLRDLVRRSREIAKRSRDHLRDLLRESEERVRASLEHVERLVKKLRKDAN

SEQ ID NO: 1876 - protein, 56 aa, Artificial Sequence
  Synthetic sequence.
SEAEDLLRRLEEEIRRIKKRHKEVLDELRKLIKEVEDRHKELLDRLREEIRELEER

SEQ ID NO: 1877 - protein, 59 aa, Artificial Sequence
  Synthetic sequence.
DRVKEELRRIVKEVRDEIRKANEKIKRLLDEVRERSKDMNRRLKEIVDRVTESLRRKAE

SEQ ID NO: 1878 - protein, 61 aa, Artificial Sequence
  Synthetic sequence.
SEVDEALERIKRLIEDLERHVREWLKELREIIEDLRERVRKLLEDLERRIKELEEKARRTG

SEQ ID NO: 1879 - protein, 59 aa, Artificial Sequence
  Synthetic sequence.
SKAVEDLERLVEELRKLSEEASRRSRKILEELRETVERVIKRLKELLKKLKEVVDELRR

SEQ ID NO: 1880 - protein, 61 aa, Artificial Sequence
  Synthetic sequence.
DRAEKVLEDIRKLIEEMRKHAEEWERRAREAVKELRKEVTDWRRRLRKLLEDLEEKVRREG

SEQ ID NO: 1881 - protein, 59 aa, Artificial Sequence
  Synthetic sequence.
SEVVRRLEKLVEDLRKINEDVNRRSRELVETLRDDVRKVNEESKRILEEVKKILDDSKR

SEQ ID NO: 1882 - protein, 59 aa, Artificial Sequence
  Synthetic sequence.
DLRRELRRVLEESKKHVKELVRELDEDLTRWERRVEELVKRLRDVLRKLEKEVDELEKK

SEQ ID NO: 1883 - protein, 58 aa, Artificial Sequence
  Synthetic sequence.
RVKEELRELVRESDKIAEEIIEKLDRDVKKVKKDHERIDEELKRKLKEVEERVERIRT

SEQ ID NO: 1884 - protein, 61 aa, Artificial Sequence
  Synthetic sequence.
SEVEETLREIKEDIKRSKKEWDDLLKTIKELIEDSKRKWDKLLRDVEELIRELLERLRRDG

SEQ ID NO: 1885 - protein, 59 aa, Artificial Sequence
  Synthetic sequence.
DRAERDVERIIREAKKLTDKVREDVERLREEWERLVREVKERIKRLLEDLRRLVEETRR

SEQ ID NO: 1886 - protein, 61 aa, Artificial Sequence
  Synthetic sequence.
DEAERLLEEAERIIEKSREEWERLLERIKRLIETLRKRYEDDLRESEKRIEELLRKARRDG

SEQ ID NO: 1887 - protein, 59 aa, Artificial Sequence
  Synthetic sequence.
DRVAREVERILRELKKLTDDMKKRAKELIDELKRLSEEMHRRIEKSNEDLKRLVDDVDR

SEQ ID NO: 1888 - protein, 61 aa, Artificial Sequence
  Synthetic sequence.
DEAEDILRRIRELIERSKRKWDELLREIKKLIEESRREWEELLRRIREIIERLKRLAERDV

SEQ ID NO: 1889 - protein, 59 aa, Artificial Sequence
  Synthetic sequence.
ERVKEEMKRLIEDLKRVSEEVKRELDKLIEELKEVSERASKRLKELIDDLDRLVKEVEK

SEQ ID NO: 1890 - protein, 59 aa, Artificial Sequence
  Synthetic sequence.
SEDEKAIEELKKEIERLRRLLEELRKHVRRLIEEIKRLVEESKRHVEELIREIDDLRRR

SEQ ID NO: 1891 - protein, 55 aa, Artificial Sequence
  Synthetic sequence.
KEVTDIIRELKEVLDEIKRTSEELLRTIEEIVRDAERKNRELLKELKKVLDEVEK

SEQ ID NO: 1892 - protein, 58 aa, Artificial Sequence
  Synthetic sequence.
DEDEELIKRLRDRIREIRKLVEDSARNVKRLIDEDERLARRSLRHLEETLKEIERKAR

SEQ ID NO: 1893 - protein, 55 aa, Artificial Sequence
  Synthetic sequence.
DEVREVLKEIRELVKELKERNDELLTRWKESIKRVEEEDERILREIERRVEEVER

SEQ ID NO: 1894 - protein, 60 aa, Artificial Sequence
  Synthetic sequence.
RAEEEVKRLLKEDNETLKRIEDDVRRLLRKNNESIREAEKTNRELVKRVEDIIRRARERG

SEQ ID NO: 1895 - protein, 56 aa, Artificial Sequence
  Synthetic sequence.
LEELLERIKELNERTKKKVADLRRVAKRLDEETERKVRETERRWRDVLDKVRKKVK

SEQ ID NO: 1896 - protein, 55 aa, Artificial Sequence
  Synthetic sequence.
REVEEVLERLKELLREHEKHAKEVEDRLRELIRENKEHAREMLERLEKILDELKK

SEQ ID NO: 1897 - protein, 59 aa, Artificial Sequence
  Synthetic sequence.
EEALRELRRLLDEIRRVNRKVEERIKEVLKKIDEDNKEVVRRLEEALEKIREVIERTAT

SEQ ID NO: 1898 - protein, 59 aa, Artificial Sequence
  Synthetic sequence.
KAKEDVKRALDEWKEVNDRVNEELKKAIDTWREVNRKVKEDVDRLVKEIEELIRRVREN

SEQ ID NO: 1899 - protein, 56 aa, Artificial Sequence
  Synthetic sequence.
REDVKRELKRVIEETRERAKRLLEDLRRLIEETKKLAEELLARAKEIIDRIREAAR

SEQ ID NO: 1900 - protein, 61 aa, Artificial Sequence
  Synthetic sequence.
RAEEELDRLSREVEKVSKKAREDLEEMRKALEDVSRRVKEKLRRILEEIKEAIKDVKRRTN

SEQ ID NO: 1901 - protein, 56 aa, Artificial Sequence
  Synthetic sequence.
RELIREVEKLIEDHRRRLEEIVETVRRLVDEHRRRLERIVREAAKLVKDIKRELEK

SEQ ID NO: 1902 - protein, 61 aa, Artificial Sequence
  Synthetic sequence.
SVKEKLRRISKELEKASRDDERENRRILKEARDVIREAADKIRRIEEELRKIIDRVRKETN

SEQ ID NO: 1903 - protein, 56 aa, Artificial Sequence
  Synthetic sequence.
EEIIEEVKRLVDEHKKRLDENVKRLKELVDRLRETLERLVDRLRKLVETLKRESDR

SEQ ID NO: 1904 - protein, 61 aa, Artificial Sequence
  Synthetic sequence.
KVEEDLKRIKKEIKDAADEDREKNREIMKRLNDVTREVEERLRKILEDLERLVRRVKEEVN

SEQ ID NO: 1905 - protein, 56 aa, Artificial Sequence
  Synthetic sequence.
EELIKRVKELVREAKERLKDNVRRLEELVKEWKRKLKEIVDRVRELVKDLERRLKE

SEQ ID NO: 1906 - protein, 61 aa, Artificial Sequence
  Synthetic sequence.
SEKEKIVKDVEELIREAEELVRRLLKRLKELNDESEKTARDLVRKNEETLKELKDVVDRRV

SEQ ID NO: 1907 - protein, 55 aa, Artificial Sequence
  Synthetic sequence.
RELDELIKKLDEVLRRAEKEAEELIRDHRRISREVKERIKDLNRRIERILREAEK

SEQ ID NO: 1908 - protein, 61 aa, Artificial Sequence
  Synthetic sequence.
SLEEIVKRVEEDIRRIIEELRRRIEEADRKIAEIIDRLRKTVEKVNKEIEDLIRELKKKEG

SEQ ID NO: 1909 - protein, 56 aa, Artificial Sequence
  Synthetic sequence.
DKRVRELVEEVKKKLRDLVEEVRESVKRLEDTLRRVEEEIRTTARELLRRLREELE

SEQ ID NO: 1910 - protein, 59 aa, Artificial Sequence
  Synthetic sequence.
SLEEEVRETVKRLRKEVEDWLREVEKVLEDLLRELKKSIEETKKVAKELEDKLRDVKRR

SEQ ID NO: 1911 - protein, 59 aa, Artificial Sequence
  Synthetic sequence.
ERIRRTLEKAREEVKRLSAETKRLIEEVKRRLDELLKRDNDIIDDARRRVKKVLDEIET

SEQ ID NO: 1912 - protein, 59 aa, Artificial Sequence
  Synthetic sequence.
DLEEELRKVVEDLERKLRESIRETEEVMRRLEESVEESIRKTEEVVKRLREKLEDVKRR

SEQ ID NO: 1913 - protein, 59 aa, Artificial Sequence
  Synthetic sequence.
DEIRDTVRKAKEDVERLLEEDNRRIKEVLDRVAKLNKRDNETIERAEEEARKVLREIEK

SEQ ID NO: 1914 - protein, 59 aa, Artificial Sequence
  Synthetic sequence.
DIEEEIREEVERLRRTLKELADRIKKLVDELREKLRRWLEEVEEVLRRLIEDLRRVKEE

SEQ ID NO: 1915 - protein, 59 aa, Artificial Sequence
  Synthetic sequence.
EELEKRVREAEEEVRRVNKKLKDDLDKAREDLKEFSDRTRRMIKAVERDVKRVLDEIRR

SEQ ID NO: 1916 - protein, 58 aa, Artificial Sequence
  Synthetic sequence.
SVEETIKRILEEVEELIREVKERNERIERRAERLIEEVKRSNDEIKKEVRTAIEKVIR

SEQ ID NO: 1917 - protein, 56 aa, Artificial Sequence
  Synthetic sequence.
KEKVDKLVKDLRRVIEELRKSLEDLERRLDDILRRLKESSDELVRELRRLLKEMEK

SEQ ID NO: 1918 - protein, 60 aa, Artificial Sequence
  Synthetic sequence.
SVEEALDEIEKKVEEMIREVKETNDRVRRKVKELSEKSKTENERVVREARELIREVERER

SEQ ID NO: 1919 - protein, 56 aa, Artificial Sequence
  Synthetic sequence.
KKDVDDLDRDLEKKLRDLKDSSRKLVKRVEDLVRESEDTVRKLIERLERLIRETKR

SEQ ID NO: 1920 - protein, 58 aa, Artificial Sequence
  Synthetic sequence.
KVEEELDKILKEVEDLVRRDEEEIKRILEEVKELIRKVKETNDKVEREMRKLVEEVKK

SEQ ID NO: 1921 - protein, 56 aa, Artificial Sequence
  Synthetic sequence.
EDSVRELVKRLRERAEESKKRTKDLEDKIRTKIEELERSSKELTDELRTLIREAER

SEQ ID NO: 1922 - protein, 59 aa, Artificial Sequence
  Synthetic sequence.
SVEEAIKEILRELEKVNEDSKRLSDRNLKELEKALRDAKKSVEEILRELEKALDEVRKN

SEQ ID NO: 1923 - protein, 60 aa, Artificial Sequence
  Synthetic sequence.
REDVERILKEIKDEVDRVRKENERVNRESEDESRKLVEELKKVLRRLKEEVRRIVEELRT

SEQ ID NO: 1924 - protein, 61 aa, Artificial Sequence
  Synthetic sequence.
EVEERLEEILRRLERAVEDWKRKNEKILKELRDVVRESKKRTREIEKKIEDAARDVLREVN

SEQ ID NO: 1925 - protein, 56 aa, Artificial Sequence
  Synthetic sequence.
KEVVKELEKDVRRIVEELKDSLRRLKEKVEEVARTVKKLNEELDDSVREIVERLRK

SEQ ID NO: 1926 - protein, 61 aa, Artificial Sequence
  Synthetic sequence.
NVEEELDRIRREAEKVVKESRELTREILERAREAVEKSEEDTRRILERLERVVKRVKKDVN

SEQ ID NO: 1927 - protein, 56 aa, Artificial Sequence
  Synthetic sequence.
EEVLDELRKKVKKLVDELRTEDRRLEEEVKKIVRDAEKRNKELEDEIRRLAEELEK

SEQ ID NO: 1928 - protein, 60 aa, Artificial Sequence
  Synthetic sequence.
SETETAVKKLKKLVDDLKREVERLVERLRELVRENSEKSRELVKRSDDLVRELLEKVKRR

SEQ ID NO: 1929 - protein, 56 aa, Artificial Sequence
  Synthetic sequence.
SELVKTVEEELKKVLEEVDRLVRKILEDLRRSLEESKRLSEESKKKLEDVLDRARR

SEQ ID NO: 1930 - protein, 60 aa, Artificial Sequence
  Synthetic sequence.
RELEEAVKKLKKKVEDNTRTSRKLVTDLEREVEELKKEVEEVVRKSKELVRELKKKVDRR

SEQ ID NO: 1931 - protein, 56 aa, Artificial Sequence
  Synthetic sequence.
SELVERVKEELKRSLEESDKLVEDVRRKLKEVLDDIRRLSEESKRELRDVLREADK

SEQ ID NO: 1932 - protein, 60 aa, Artificial Sequence
  Synthetic sequence.
ELEEIVKDARRRIKELIDEARRTSEEVVERIKELLKRAEEISREARKRLTELLEELKKTV

SEQ ID NO: 1933 - protein, 56 aa, Artificial Sequence
  Synthetic sequence.
KEELRKIVEDILRTIKKLLEELRDDARRLLEEIKRLLEELERHVRKLLKEIDERIK

SEQ ID NO: 1934 - protein, 60 aa, Artificial Sequence
  Synthetic sequence.
ELEEIARKAKEDIERLVEEARRISEEVKRELTELVERLRRISEEVRKRIEDLADELRKKV

SEQ ID NO: 1935 - protein, 56 aa, Artificial Sequence
  Synthetic sequence.
KKTLKEKVEDILRRIRELLRELRENARELVKEIERLIRELEKDAKRILKKIEDAIR

SEQ ID NO: 1936 - protein, 60 aa, Artificial Sequence
  Synthetic sequence.
SVEELVKEIEKRLDELVREIEKTNKKVEDDIRKMLEDIKRVHDKSNEDLEKLVKELREKL

SEQ ID NO: 1937 - protein, 56 aa, Artificial Sequence
  Synthetic sequence.
LKDIEKVARDILRRVKKILEENRKHAEKARRELEKLLRESKRLVDELLRRAEEEKR

SEQ ID NO: 1938 - protein, 60 aa, Artificial Sequence
  Synthetic sequence.
SREDRARELVKRILDEHKKILEDVEELAKELLRRHEELLKTLRELMRRIEEDLKRLEDED

SEQ ID NO: 1939 - protein, 56 aa, Artificial Sequence
  Synthetic sequence.
SEILKTVTRLSEELNRRIREVVRKVEEDLEDLNRRLKKIADEIEERIKEILRRIEK

SEQ ID NO: 1940 - protein, 60 aa, Artificial Sequence
  Synthetic sequence.
SIEDVVRRIREEDRRLHEEIRKVVDEIRKRLEDALRSHEERVREVLERIKKLLEELKRRG

SEQ ID NO: 1941 - protein, 56 aa, Artificial Sequence
  Synthetic sequence.
EKDLRKKLREIEEKNERLLRELERLLEEIRRTLEDLNRKLDEEIKKLERRLKERDR

SEQ ID NO: 1942 - protein, 58 aa, Artificial Sequence
  Synthetic sequence.
SLKELIDEVERRLREVNRRARELVEEVKERLRRVNEESRELLREIEERLEDVLRELEE

SEQ ID NO: 1943 - protein, 59 aa, Artificial Sequence
  Synthetic sequence.
EEEIKELVKRARELVKRSKEHVDELMETAKRLVDESRKHAEELFRELKKLIEELREKIR

SEQ ID NO: 1944 - protein, 60 aa, Artificial Sequence
  Synthetic sequence.
SEVEKLVEDLRREVKRHSEKVERLVKELRDDLERWKERLEEIMRRLEKLVRDLEELLRRG

SEQ ID NO: 1945 - protein, 56 aa, Artificial Sequence
  Synthetic sequence.
EELVREVKERLERSRERVDKLLRDNHKRLKEVLDEAKKLIDRVRKLLRRVLEEAKK

SEQ ID NO: 1946 - protein, 60 aa, Artificial Sequence
  Synthetic sequence.
SDVERLITELADSVRDHSRDVRRVVEELEKLLRDWERDIEDIVEKLDRLVRTLEELLRRG

SEQ ID NO: 1947 - protein, 56 aa, Artificial Sequence
  Synthetic sequence.
EDLVRTVEKLNTESLDEVRKLVKKNHEDLKRVLDKAKKLIEEVRKKLEEVLDEARK

SEQ ID NO: 1948 - protein, 59 aa, Artificial Sequence
  Synthetic sequence.
TLEEILKEVAERVKKANEDSRRILEKVKRDVETVNRENEKILKKAAEDVKRVLDEARKR

SEQ ID NO: 1949 - protein, 56 aa, Artificial Sequence
  Synthetic sequence.
EKELREMIEKLKRDNERMLRELERRIEELKRDNDRVNEESKRLVDELKRDAEEKLK

SEQ ID NO: 1950 - protein, 59 aa, Artificial Sequence
  Synthetic sequence.
TLEEILREVEKRVKEANERNRKISEELADLVRRVNEENKKILEDVAEEVRRALERARRR

SEQ ID NO: 1951 - protein, 56 aa, Artificial Sequence
  Synthetic sequence.
EEELRRMIEELEKRNRDVDRESKKLAEELEKTNRDVNRKSRELVRRLRRKLEEELR

SEQ ID NO: 1952 - protein, 59 aa, Artificial Sequence
  Synthetic sequence.
ELEDILREVRKRVEDVNRRNKEILERVAEEVRRLNEENKRILEEARKRVEKVLEDLKRR

SEQ ID NO: 1953 - protein, 56 aa, Artificial Sequence
  Synthetic sequence.
EEELRRAIKELKDRNEDVDRRTKELIKRLEDKNRELNRESRERVEELKKRAEELAR

SEQ ID NO: 1954 - protein, 59 aa, Artificial Sequence
  Synthetic sequence.
DLEEILKDVKRRVEEANRRNEKILEEAKEKVDRVNRSNEKILEEVKETVKEVLRRAREE

SEQ ID NO: 1955 - protein, 56 aa, Artificial Sequence
  Synthetic sequence.
EEELKEMIRRLEETNRRVDKETRKLIEELERRNREVDRESERLIRELKKKAKDDLD

SEQ ID NO: 1956 - protein, 59 aa, Artificial Sequence
  Synthetic sequence.
TLEDILREIAKVVKEANKRNKRILEKVARDVEEVNKENKKILDEVKRDVERVLREAEKR

SEQ ID NO: 1957 - protein, 56 aa, Artificial Sequence
  Synthetic sequence.
EDELRRMLEELERTLREVDRESDELVKKLKRDAERVNEETRRLIKELKEIADRLLD

SEQ ID NO: 1958 - protein, 60 aa, Artificial Sequence
  Synthetic sequence.
SIEELVREIEKTNEDMRREIERLSDENRRRLDKALEDIERRAREIKEKLERVMKRLREKG

SEQ ID NO: 1959 - protein, 60 aa, Artificial Sequence
  Synthetic sequence.
EKRVLDELRKLLEDSKDELRRLLEELRRHIKETDDTVRELLDRIRKIREELDDEVRRLEK

SEQ ID NO: 1960 - protein, 60 aa, Artificial Sequence
  Synthetic sequence.
KEEEDARRALKRVEEEVRRNKEEMRKLLEDNEKRIRENKKRAEDSSRKVKKRIDELRRDG

SEQ ID NO: 1961 - protein, 55 aa, Artificial Sequence
  Synthetic sequence.
EEVLREIEKILRDLERDHRRVLEEIRKRNDELRETHERVLRENEKILEKVERELR

SEQ ID NO: 1962 - protein, 56 aa, Artificial Sequence
  Synthetic sequence.
SVDDKVRRRIREIKEELERVLTRSERESDDIKRELEEVLKRSEERTKKIKDDAERG

SEQ ID NO: 1963 - protein, 60 aa, Artificial Sequence
  Synthetic sequence.
DERVMRDLERELEKLERKVREIKRELEEHNARLREKVRRIDEDLKRDNKELEDTIREDTR

SEQ ID NO: 1964 - protein, 59 aa, Artificial Sequence
  Synthetic sequence.
KEEEELEERIRRLEKLVEDYKRELDRSIKELEDEVDRARRELEKSIEEMKKKVKKAEDD

SEQ ID NO: 1965 - protein, 59 aa, Artificial Sequence
  Synthetic sequence.
DRVIRKIKKLLDEVRERLERINRTHRELLKEVEERLKKILKDITDANRRIEERLEEITR

SEQ ID NO: 1966 - protein, 60 aa, Artificial Sequence
  Synthetic sequence.
SLKEELKRINDENKEELDRLREELKKLLKEVEEELRRAAEELERINRRIKEELDKVADRV

SEQ ID NO: 1967 - protein, 59 aa, Artificial Sequence
  Synthetic sequence.
EEVAERLLEELREDVKRTKEKMKEMLDRVKKKIDDIKRKLEKLLRDNERRIEELKRDAD

SEQ ID NO: 1968 - protein, 58 aa, Artificial Sequence
  Synthetic sequence.
SVEEKLKKALEESKRKSKRIKDDDERANREVKKRIEDIVRRLEEVLRKVLKDVTKDIK

SEQ ID NO: 1969 - protein, 56 aa, Artificial Sequence
  Synthetic sequence.
EDEVTRDVKRLEDHNTRLEKKVKESVERLKEKLEELRKRVEKIERDLEKLLEDVRT

SEQ ID NO: 1970 - protein, 60 aa, Artificial Sequence
  Synthetic sequence.
KAEDVLRRVKEEHERIRREIKRVIDDVRRKHKEILDRLREEIKRVEELLRKILEDVERDG

SEQ ID NO: 1971 - protein, 56 aa, Artificial Sequence
  Synthetic sequence.
EEVVKELEDNVKRNEEDAKRTVEKLRKNLEDNRREVEKIVRDLRRLVEKAREDVKR

SEQ ID NO: 1972 - protein, 56 aa, Artificial Sequence
  Synthetic sequence.
DLKEILDEARKLIEDLRKKAEEILEESKRLLDDLKRKADEILTRYDELTKRLSTKV

SEQ ID NO: 1973 - protein, 56 aa, Artificial Sequence
  Synthetic sequence.
LEELKKRLEELIREVEKDLRRIKKESEDRVEEIERRLRRIAEELDKDVRRVEEEAK

SEQ ID NO: 1974 - protein, 63 aa, Artificial Sequence
  Synthetic sequence.
SKEETVARRVDEIARELEEKNKKWEDDSRKAVDELRRKLEEWEKRSRDLREKVKDLLRKLKDQ

SEQ ID NO: 1975 - protein, 55 aa, Artificial Sequence
  Synthetic sequence.
EELKKKVEKLLEDHRKKSEELLRKDEKLIRDMEREVERLLREDEKVIEDVERATK

SEQ ID NO: 1976 - protein, 63 aa, Artificial Sequence
  Synthetic sequence.
SKEETVERDVERIVRRLRELNKEWKKRSEEVKREVDESDKRTAEAVKKLVRDLEETLKDLKDR

SEQ ID NO: 1977 - protein, 55 aa, Artificial Sequence
  Synthetic sequence.
EEIKKKLEKLLKEHEDLSRKLLKEDEEEIDRHRRKVREWAEDLRKKLEEAERAST

SEQ ID NO: 1978 - protein, 60 aa, Artificial Sequence
  Synthetic sequence.
SEKERAEEELKRIEDELREAIKRSEDRLRRIEKELRDREKRSEEELRRLEEELRRLAEER

SEQ ID NO: 1979 - protein, 55 aa, Artificial Sequence
  Synthetic sequence.
RKIIEDLKRLLREFERAVEESNERLRRLLEEFKEKVKESNKRSRELLRRMEEEVR

SEQ ID NO: 1980 - protein, 57 aa, Artificial Sequence
  Synthetic sequence.
DDLERLEKEAREILERHKRALDELEKRLRRVLEKHEEDLRRLEETLRELLKKVRKDG

SEQ ID NO: 1981 - protein, 56 aa, Artificial Sequence
  Synthetic sequence.
REELEKEVRKLEKKSRDDIRRLEKELRELEKRSRDNIRELEKRVRRVARELDKTAK

SEQ ID NO: 1982 - protein, 59 aa, Artificial Sequence
  Synthetic sequence.
DEKEEAEKALREIKKRIEDNVREVRRLNRELREKLRKLIEDYDRLLKELEKRVEDIVRK

SEQ ID NO: 1983 - protein, 56 aa, Artificial Sequence
  Synthetic sequence.
ERDLRREEKKLRDELRDLHREHRKSIEDLDREIKKMEDELRRSIEENRKRVEELEK

SEQ ID NO: 1984 - protein, 56 aa, Artificial Sequence
  Synthetic sequence.
REKERVKRVVRRVEEELKRNLEEVEEESRRDLRRLEENLERVEEAVRRILKRLDDS

SEQ ID NO: 1985 - protein, 56 aa, Artificial Sequence
  Synthetic sequence.
REELEKLIEKIERELKKTHDDSRREIERLRRETKKLHEKSEELIRELEKRLRDAER

SEQ ID NO: 1986 - protein, 60 aa, Artificial Sequence
  Synthetic sequence.
SEVEEILDRIRRELERLAREARKTVERNKKELDRIREEVDRSLRRNKEELDRLRREKKDV

SEQ ID NO: 1987 - protein, 59 aa, Artificial Sequence
  Synthetic sequence.
EDARRAARELLKRLEDLLREHHDRLRKSDEEIRKLIEDHHRALEESNREIKELIDRMAK

SEQ ID NO: 1988 - protein, 60 aa, Artificial Sequence
  Synthetic sequence.
DEAEKLIKDIEDKDEELKEKARELKEKLEERDERTKKLIEELKREADRTLEELKKKVEKA

SEQ ID NO: 1989 - protein, 58 aa, Artificial Sequence
  Synthetic sequence.
EVVKRVRDLLKRHEDLTREIKKEVKKMNEKNRELVRRVEETLKKLLEDLKRLLDESRK

SEQ ID NO: 1990 - protein, 60 aa, Artificial Sequence
  Synthetic sequence.
SEEEEKVKDIERKLRKHNKEVKDTERENEKRLRELRRTVEEDRKDAERELERIKRVVERG

SEQ ID NO: 1991 - protein, 55 aa, Artificial Sequence
  Synthetic sequence.
EELDRLEKELRESIRRAEELLKDSKRRADELIERIKDVLRKVKEKIEKLIEDTRR

SEQ ID NO: 1992 - protein, 57 aa, Artificial Sequence
  Synthetic sequence.
SEKEVVEELKKTVDDLKRKSEEAIKKAKEAVDKIRRDSERAIRKNEDTLRKIEEEIK

SEQ ID NO: 1993 - protein, 56 aa, Artificial Sequence
  Synthetic sequence.
EDILREIAKRIKDLIEDHKRASKEIERDIRKILEDHKRAAEKIRRDLRRLLEDVER

SEQ ID NO: 1994 - protein, 60 aa, Artificial Sequence
  Synthetic sequence.
SLEKMVTDIIRKLEEIARRHKTRSDEIVRRLEEIIKTHEKRSKELMDDLKRLVDEVRKKK

SEQ ID NO: 1995 - protein, 56 aa, Artificial Sequence
  Synthetic sequence.
EEDIRRLDEEVKDLERRSREEEERLEREVRELEKRSEETIRRVEKKVRDLADELRK

SEQ ID NO: 1996 - protein, 59 aa, Artificial Sequence
  Synthetic sequence.
SEEDVVKKVRKKLEDVHRDTRREIRRLEEETKKLHDETRKTIETIERRLRDLRDRLTKE

SEQ ID NO: 1997 - protein, 56 aa, Artificial Sequence
  Synthetic sequence.
SEEVRDVKEKLKRNLEEARKASREDLERLKRNLEKADEDVRRLLEELKRLLDEVRR

SEQ ID NO: 1998 - protein, 60 aa, Artificial Sequence
  Synthetic sequence.
SLEEAIEDLRRKLEKLLKDYADLSKEIEDKLRKIHEDSRRLVEKLEEEARRILKEVRERG

SEQ ID NO: 1999 - protein, 60 aa, Artificial Sequence
  Synthetic sequence.
EEEVRKEIEDADKRVKDLKRELERDIDELRKRVEELRRRHEEKIKKVAEDVKRREDEARK

SEQ ID NO: 2000 - protein, 61 aa, Artificial Sequence
  Synthetic sequence.
SRLEKIKRELDKKLKDHEDDSRDKVRKLRESLKRHEDKSRKEEEEVKKTLKELEDKLRRDG

SEQ ID NO: 2001 - protein, 56 aa, Artificial Sequence
  Synthetic sequence.
KRLVDDAKRKIKELEEENERLVKEVEDRNRELDERNKRIIDRIRRLNERVKEEAEK

SEQ ID NO: 2002 - protein, 57 aa, Artificial Sequence
  Synthetic sequence.
DEVETVIERDKKLLEDWVDRARKVVKRDEDSLRRDEEENRRVVEENSRTVKELKERI

SEQ ID NO: 2003 - protein, 58 aa, Artificial Sequence
  Synthetic sequence.
EVVKRVEEEVKRLNERADELLKRVEKRAEELNEESRRLSEEVERKVRELNREADERVK

SEQ ID NO: 2004 - protein, 57 aa, Artificial Sequence
  Synthetic sequence.
SEVEEVVKRNSDTAKEDMDRNEKVVEDNSKRLREWEKAIEEVEKEVDKAMKDLKRRI

SEQ ID NO: 2005 - protein, 58 aa, Artificial Sequence
  Synthetic sequence.
KLVEDVRREVEKLNRESEERSKRVKEEVDDLNRKLEKLLRDVKEEVKKLLEEAERETK

SEQ ID NO: 2006 - protein, 57 aa, Artificial Sequence
  Synthetic sequence.
DEVRKVVEDNERSVREIKEELKRVVEEDKELVDRWRERLEKVVKDNERSAKKIKDDV

SEQ ID NO: 2007 - protein, 59 aa, Artificial Sequence
  Synthetic sequence.
DEMLRRIEETIRRLDEELRRLVEEVKRRIDELNREVEKRIREVEERIKEMDKRLREAVK

SEQ ID NO: 2008 - protein, 57 aa, Artificial Sequence
  Synthetic sequence.
DEAEKVVEKDRRLIEKWKEDLKELVRRVREKVKEIKKRVADVVKENEDSVRRIEKEV

SEQ ID NO: 2009 - protein, 59 aa, Artificial Sequence
  Synthetic sequence.
DEMLRRIDRRAERLNEDVARVIDEVAKRVTRLLERLEEKLKKIRDDIKKLDEELEEAAR

SEQ ID NO: 2010 - protein, 57 aa, Artificial Sequence
  Synthetic sequence.
DEVRELVKENRRSVKENEEELKRILDEDERLIRDWKKKLEEVVRKVAELVREIEERV

SEQ ID NO: 2011 - protein, 59 aa, Artificial Sequence
  Synthetic sequence.
DELLRRVAETVKRMDEDLNRTTEEIADTIRRLNEEVAKRIREVERTVERLIEELEEAVR

SEQ ID NO: 2012 - protein, 55 aa, Artificial Sequence
  Synthetic sequence.
DEEEELEKDARRVLEELRRELERVVREAKDINRRVEELIREVRERAKRVDDELRK

SEQ ID NO: 2013 - protein, 55 aa, Artificial Sequence
  Synthetic sequence.
ERVLREVERVLRELEREADEVLKEDRELLERWKKTVKDVVKENRDSLDELAKEMK

SEQ ID NO: 2014 - protein, 55 aa, Artificial Sequence
  Synthetic sequence.
SEEERLREEAKEVLKRLREDLKRVEEDVERVDKRLRELNEDVARKLEEVLKRLRE

SEQ ID NO: 2015 - protein, 55 aa, Artificial Sequence
  Synthetic sequence.
EKVLREVKRALDDLRRRVEEVLRKNEKSLRELEEENRRVLKKVEDLLEDIIRRLK

SEQ ID NO: 2016 - protein, 60 aa, Artificial Sequence
  Synthetic sequence.
REEDEVRKELERVERRIEDLLREVERTNREVIETSERLTKTVEDDVRRVNTEIDRLLKEK

SEQ ID NO: 2017 - protein, 55 aa, Artificial Sequence
  Synthetic sequence.
EELLRELEEVLRRIEEKLKKIDDESKKLAKEDTDRNKRIVDENTRLVEEWDKRAK

SEQ ID NO: 2018 - protein, 60 aa, Artificial Sequence
  Synthetic sequence.
SVLEEVRKKVERVIRESRELSERVREHIKRTIDEVKKLTEEVRKIVETLIRRLKELLDRV

SEQ ID NO: 2019 - protein, 59 aa, Artificial Sequence
  Synthetic sequence.
DEEVRKILTDLRKAVDEDRRRNEKLLKDSEDAVRRDEKENRDILRELRKAIEEIERRLR

SEQ ID NO: 2020 - protein, 60 aa, Artificial Sequence
  Synthetic sequence.
SMVDKVREEARKLIEEARRLSEEVKKIIDELTKRVKDLTRTSHELSKRLEDTIRELLKRV

SEQ ID NO: 2021 - protein, 59 aa, Artificial Sequence
  Synthetic sequence.
DEKLREILKRLREELKRDEDRNRELLKRVRDRVKKDEEENRENTKRVREAVEKIERELE

SEQ ID NO: 2022 - protein, 60 aa, Artificial Sequence
  Synthetic sequence.
DVLEEVRRRAEEVIREARELSKRSHDRSRELIERVKKLTEESHRLSRKLIRELEERLEKV

SEQ ID NO: 2023 - protein, 59 aa, Artificial Sequence
  Synthetic sequence.
DEEVRRILKELRDEVKRDEERNRKNTKDVKDEVDKDRRTNEKNTEDAEREIRRIKEDAR

SEQ ID NO: 2024 - protein, 60 aa, Artificial Sequence
  Synthetic sequence.
SVLEDVRRDVERLRREIEELSKRSHERSRRIIERLEELLKRSHDLSKRLRERLEELLKRV

SEQ ID NO: 2025 - protein, 59 aa, Artificial Sequence
  Synthetic sequence.
DEEVRRILKKLRDDVKKDEDDNRRNTEEVRKLAKDIERKLKKNTDDVRKDIKAIEDRLR

SEQ ID NO: 2026 - protein, 60 aa, Artificial Sequence
  Synthetic sequence.
SVLEKVKELLDRLIRELEELVKTVEEIARRLITEVRELTERSHELSRRLIKELKRLLDDV

SEQ ID NO: 2027 - protein, 59 aa, Artificial Sequence
  Synthetic sequence.
DEEVRRILEEITRVLEEIATRLKRILDELRKAVDKDRKDNERNTEEVRKLIEEIKRRLK

SEQ ID NO: 2028 - protein, 59 aa, Artificial Sequence
  Synthetic sequence.
SLLDEVRRKVKEVEDRLRKLVKDSHELSRRLIEEVERLTKTSHELSRRLIEELRELLKR

SEQ ID NO: 2029 - protein, 59 aa, Artificial Sequence
  Synthetic sequence.
DKDLRDILRKLREVLEEIERRLRKNTEDVKKVVDDDRKRNKDNTDEVRKAIREIEERLR

SEQ ID NO: 2030 - protein, 57 aa, Artificial Sequence
  Synthetic sequence.
SEIERLLEEDTKRLRDWEEAIRKNLEDSEREAKKLKDRVKKLLDDARRDIDRLKKER

SEQ ID NO: 2031 - protein, 59 aa, Artificial Sequence
  Synthetic sequence.
EEILDEVRRRLKTLNDDVERLLREVHERSKKLRETVRKIVEEVEKRITELRDRVRRAAK

SEQ ID NO: 2032 - protein, 57 aa, Artificial Sequence
  Synthetic sequence.
SDIDRLLEEDKKKLDDWRRAIEKNLEDSERRAREIKERLKKLLDEVRREAERLKEER

SEQ ID NO: 2033 - protein, 59 aa, Artificial Sequence
  Synthetic sequence.
EDILREIAKRIEDLNKEVEDLLRTVHKESRRLDREVEEIVRRVKEEIDRLIREVREAAK

SEQ ID NO: 2034 - protein, 57 aa, Artificial Sequence
  Synthetic sequence.
SEVDKLLEDDRKALEEWERRITKNLEDSKREIDDIRRRLRKNLEDSRRAIKEMKDRR

SEQ ID NO: 2035 - protein, 59 aa, Artificial Sequence
  Synthetic sequence.
EEILKRIADEIKRLNDEVKKLLEEVHERSRRLIEELRRLLEEVHRRSRKLIREVEEAAR

SEQ ID NO: 2036 - protein, 60 aa, Artificial Sequence
  Synthetic sequence.
SAEEEIEERLKRAIDRDEESVKRSAEEIKRLIEELKKSVDDSARELKELIERLKKLKKDG

SEQ ID NO: 2037 - protein, 58 aa, Artificial Sequence
  Synthetic sequence.
KEIKDLLDRVKKEVERSKRKSAKLLKELEDAIKEIEDRSRELLERAREELKRVKDDKR

SEQ ID NO: 2038 - protein, 59 aa, Artificial Sequence
  Synthetic sequence.
DETKRVRDLIRELIKRDEESVRRSARTLEELIRRLEESVKRSKKLVEDVIRKLKKLVKD

SEQ ID NO: 2039 - protein, 58 aa, Artificial Sequence
  Synthetic sequence.
EEAKKLLEDVEEAVERSKRKSRKLLEDARRALEKVKRDSDKLLEDVREEVERVLRTVK

SEQ ID NO: 2040 - protein, 60 aa, Artificial Sequence
  Synthetic sequence.
DELEKIAEELDKLIRDDKKSVDESKRLLEDLIRRDRESVEESERELTELRRRLDELRRRG

SEQ ID NO: 2041 - protein, 58 aa, Artificial Sequence
  Synthetic sequence.
REIKELLKRVRELVRESKERSRAVKERLKEEVKESERRSRELLERVRRDLEKIERDTR

SEQ ID NO: 2042 - protein, 59 aa, Artificial Sequence
  Synthetic sequence.
SELERIKKELEELIERDKKSVKDTARRLEEMERRLRESVRKSEEDLRRMIEKLEKLVTD

SEQ ID NO: 2043 - protein, 58 aa, Artificial Sequence
  Synthetic sequence.
DEARKLLEDVKRLVEESKRESKRLLDEVKKVIDRLRERSEKLLRDVERALREAEERTR

SEQ ID NO: 2044 - protein, 60 aa, Artificial Sequence
  Synthetic sequence.
EEDERIRRDLEEAIRRDRKSVEDTREELRKMIEDDERSVRDSEEKLKELIKRLEELVREG

SEQ ID NO: 2045 - protein, 58 aa, Artificial Sequence
  Synthetic sequence.
DEIRELLRRVRELVKKSKDDSRKLLEDVKRELERSKEESKRLLDEVKRAIDEIRERDK

SEQ ID NO: 2046 - protein, 60 aa, Artificial Sequence
  Synthetic sequence.
SELERIEEELKKLIEDDKKSVDDTRKELDRAIEEDKRSVERSERDLRRMIKKLEDLVRRG

SEQ ID NO: 2047 - protein, 58 aa, Artificial Sequence
  Synthetic sequence.
DEIRKLLEEVKKLVEESKRTSEELLKEVDRRLRRSEDESRKLLEEAKKAVKRIEEETR

SEQ ID NO: 2048 - protein, 59 aa, Artificial Sequence
  Synthetic sequence.
DELEEIKRRLKELIDRDRESVKRTEDELRELIKRLRKSVDDSRKEAERLIRELERLVKE

SEQ ID NO: 2049 - protein, 58 aa, Artificial Sequence
  Synthetic sequence.
DEIRELLERVERALRESKERSRKLLEDVRRAIEKVERDSEKLLKDVEEALERVKRERD

SEQ ID NO: 2050 - protein, 60 aa, Artificial Sequence
  Synthetic sequence.
REEDEIRRELKELIERDERSVEETRKELEELIRELEELVKRVEDDLRRLIEKLEDLRRKG

SEQ ID NO: 2051 - protein, 58 aa, Artificial Sequence
  Synthetic sequence.
DEARKLLKEVEELLRRSKRKSEELLKRVEELLRKAREDIRRLLEEVKRVIDKVKKDTD

SEQ ID NO: 2052 - protein, 57 aa, Artificial Sequence
  Synthetic sequence.
SDVERIIRENERKAKEIKDKVRKVIEDNERSVEEIKEKAERIVREVRKTLEEIRKRI

SEQ ID NO: 2053 - protein, 59 aa, Artificial Sequence
  Synthetic sequence.
KEMVERVERLIEEVARRSEELLRRIAKLVEDVNRESERLIREIKELAREVEKELKERAD

SEQ ID NO: 2054 - protein, 57 aa, Artificial Sequence
  Synthetic sequence.
SEVDDIIRKNEELLKKIEDDARKILKENEERVEEIKERIKKLIEDDRRKLEEIKRRI

SEQ ID NO: 2055 - protein, 59 aa, Artificial Sequence
  Synthetic sequence.
EEALDRIRKLIEKVKRESEKLLEDIKRLIDKVDKDSERLLRTVKKLSEDVEKELKDTTK

SEQ ID NO: 2056 - protein, 57 aa, Artificial Sequence
  Synthetic sequence.
SEVDEIIKDNERELDEVRREVEEIDKENKERLKEWVEEAREILDRLRKDLEEIRKRV

SEQ ID NO: 2057 - protein, 59 aa, Artificial Sequence
  Synthetic sequence.
REALDRLRRLIEKVVEDSRRLIKKVDELLKKVNKEIEDLVREVKDLVRRVKEELDRRVK

SEQ ID NO: 2058 - protein, 57 aa, Artificial Sequence
  Synthetic sequence.
EEAERILKKDDDSVRKIKKEADRIVRENERLAEEIKKEVRKIIEDDKRTLEEIEKRI

SEQ ID NO: 2059 - protein, 59 aa, Artificial Sequence
  Synthetic sequence.
EEMLRRVEEDLRRVNEESERLIRRIAKEVKRVTDESKKLLEEVKRISETVIEKMKEDAR

SEQ ID NO: 2060 - protein, 57 aa, Artificial Sequence
  Synthetic sequence.
DEVEEILKRDEEALRDIEKKVREVDERNRREVEKIKEKVKEIIKRDKDELDEIRKRI

SEQ ID NO: 2061 - protein, 59 aa, Artificial Sequence
  Synthetic sequence.
EEVLKRLEEEARRVNKTSKDLLKEVEDKIRKVNRKSEELLKKVEELSRRVIEEMRRRVK

SEQ ID NO: 2062 - protein, 60 aa, Artificial Sequence
  Synthetic sequence.
RELEELIEDLRRALERSREEVTRLLKDLEDANRRSHRHNEELIKRLRKILKEARDRVKRD

SEQ ID NO: 2063 - protein, 59 aa, Artificial Sequence
  Synthetic sequence.
EEALKDLRRVVEEVKKRSTDLNREVAKVIEEVKKRSEDLNRELEKLNRDIEERIDRETR

SEQ ID NO: 2064 - protein, 61 aa, Artificial Sequence
  Synthetic sequence.
REEEEARKILERLEEELKRSLDEVRDLIEKATKESKDVNEKIRKLLEELKEELRKVVEDTG

SEQ ID NO: 2065 - protein, 55 aa, Artificial Sequence
  Synthetic sequence.
EELVKDVERKLKRVAEESRKLVEDLRRRIKESREEIKRLVEDLERVLKEIKEEAK

SEQ ID NO: 2066 - protein, 61 aa, Artificial Sequence
  Synthetic sequence.
REEEEALKRIRETSERIKRVVDDLHRRNKKSTDDIKRRVDELHKRNEKIVREVLDVIRRRG

SEQ ID NO: 2067 - protein, 56 aa, Artificial Sequence
  Synthetic sequence.
SEVLRELDRRTKELKRRADELVTENRKLSKELEDEIRRLAERNRDAIRKIDKAVKE

SEQ ID NO: 2068 - protein, 61 aa, Artificial Sequence
  Synthetic sequence.
DEEERALETIRDTSRRIEERIDDLRRRVEKIVRDIEETIRRLHEENRKIAERVKEVIERRG

SEQ ID NO: 2069 - protein, 56 aa, Artificial Sequence
  Synthetic sequence.
SEVLKELEDETRRVKERVDKIIKELEERVEDVERKVRELVKRNEELLKKIKDDADK

SEQ ID NO: 2070 - protein, 61 aa, Artificial Sequence
  Synthetic sequence.
SREEDAVRKIRKLVEDVTRETKKMLEDVRRLVETVEKLTDDLLEEVRRLVEEVEDEIRRAG

SEQ ID NO: 2071 - protein, 56 aa, Artificial Sequence
  Synthetic sequence.
SELLREVEDLLRRHHETVRRILDEIRRLIERHHRRVREILKELDKLVKDAADEVRR

SEQ ID NO: 2072 - protein, 60 aa, Artificial Sequence
  Synthetic sequence.
SEVERVEEEVKRLATEVEKSNRDSLREIEDLNRRDRDISRRVKEEIERLIREVKKLIDDR

SEQ ID NO: 2073 - protein, 60 aa, Artificial Sequence
  Synthetic sequence.
EKKVKELLERAKKIADELRKHIKRTLKKVEEEVEKNKRDNDKLLEEARELIKRLDDEVRR

SEQ ID NO: 2074 - protein, 60 aa, Artificial Sequence
  Synthetic sequence.
DDLERVRKEIEDLNREDKRRSEEVRREVKKLIEDLEDSNRRSLEEVDRLVETVRELIDRE

SEQ ID NO: 2075 - protein, 60 aa, Artificial Sequence
  Synthetic sequence.
KEKVKRLLRTVRELMKKNKRDNDRLLKEAEDEARRVKRHIKESLKRIEEEIRRLKERLER

SEQ ID NO: 2076 - protein, 60 aa, Artificial Sequence
  Synthetic sequence.
DELEKVAEDIKKLNKEDRDRSDEVRRAVKELVKEVEKKDKDIKRRAEELIREIKEDIERR

SEQ ID NO: 2077 - protein, 60 aa, Artificial Sequence
  Synthetic sequence.
REKVRKLLEDVEREARKNEEDNRKLLKDIREEIRRLADRSRKTLEDAKRLIEKIERDLEK

SEQ ID NO: 2078 - protein, 57 aa, Artificial Sequence
  Synthetic sequence.
SEVEEVLKEIEEMLRDLERRVKESDEENRDSLRKIREDVERVDEENRDTLRRIKEKV

SEQ ID NO: 2079 - protein, 55 aa, Artificial Sequence
  Synthetic sequence.
EKVMKEVRDVIARLRDELEKVTEDSRRVNKELKKRLEDVVREIRRANEELDERVR

SEQ ID NO: 2080 - protein, 57 aa, Artificial Sequence
  Synthetic sequence.
DEVEKVLEEIKRALDDLRKKVEESKREIKEALKRVEKHTRDSDTDNKRTLREIEERV

SEQ ID NO: 2081 - protein, 55 aa, Artificial Sequence
  Synthetic sequence.
ERVVEEVRRVLEELRRRLEKVTEDSRRAIERLEREDRRVSKKSKDVNKKLDDDVR

SEQ ID NO: 2082 - protein, 55 aa, Artificial Sequence
  Synthetic sequence.
DSARKVEREVEEAARRVERTLEDVTRKVRELHDEVRRRLEEVKRRIEDLHRRVDE

SEQ ID NO: 2083 - protein, 59 aa, Artificial Sequence
  Synthetic sequence.
KDTVKRVLDDVARIVKRIEEDIKRVLEESKKLVRDIEKEIRDVKKESRDLVREIREKIR

SEQ ID NO: 2084 - protein, 56 aa, Artificial Sequence
  Synthetic sequence.
SSAEEVKRELEERHRDLRRTDEELRKDLDRVHDRARKILEEIEKKIRDMHRKVKER

SEQ ID NO: 2085 - protein, 59 aa, Artificial Sequence
  Synthetic sequence.
ERKVKKVRDESNKVVEEIMRHSDKVLERSRRLVEEIRRRLEEVLRTSREVVRRIRDEVR

SEQ ID NO: 2086 - protein, 55 aa, Artificial Sequence
  Synthetic sequence.
REVEEVLKEIEEMLKRIEDDVRRVLEEIKDVARRNEDEVRKLLRENEESVEEIKR

SEQ ID NO: 2087 - protein, 55 aa, Artificial Sequence
  Synthetic sequence.
RKVVEEVRKLLTDLKRLLEEVVKEVRKRLKELHDRTRTVAEEIRDINKKLKEEVN

SEQ ID NO: 2088 - protein, 60 aa, Artificial Sequence
  Synthetic sequence.
SSVDEVRRTIEELIRRVEELVKRSKDHVDETERRVKELVRRSHELTKEVIERVEELLRRL

SEQ ID NO: 2089 - protein, 59 aa, Artificial Sequence
  Synthetic sequence.
EDKVRKLVEDLRRALEKIRREIEKSTEESDRVLRRIEEEIRRDSEELKRALREAEEEVR

SEQ ID NO: 2090 - protein, 58 aa, Artificial Sequence
  Synthetic sequence.
SEVEELLKEVERLVREVEERVRRLHETDRKLLEDVKRKVEELHREDKKLADEVREAVK

SEQ ID NO: 2091 - protein, 58 aa, Artificial Sequence
  Synthetic sequence.
EDVERLRRELEKVAEKIRRLVEANRKTVEDARREIEKLLEENRRELDKVRRDVEREAK

SEQ ID NO: 2092 - protein, 62 aa, Artificial Sequence
  Synthetic sequence.
KEVDDLLKEVRRLVREVEKELKRLHDENRKSSEEIARRLEELHKESKELVERVKETLRDLRK

SEQ ID NO: 2093 - protein, 59 aa, Artificial Sequence
  Synthetic sequence.
EKVVRDLEREVREALRRLEEILRRDEDDVRRSREELKRIIDENREEVKRVLRELEETLR

SEQ ID NO: 2094 - protein, 60 aa, Artificial Sequence
  Synthetic sequence.
SEVDELVERNERLVDEVRRRVEDVARKLEKVSRDSDDLVRRSNEELEDRLRKVEKRVREE

SEQ ID NO: 2095 - protein, 59 aa, Artificial Sequence
  Synthetic sequence.
KKKLDEIRERSKRANDTLRKLLEDIRKRVEDSIRRLDELLKRSETRVRDIIKKLEDELR

SEQ ID NO: 2096 - protein, 60 aa, Artificial Sequence
  Synthetic sequence.
DEVDELERRNERLAEDVRRKVREVEERLKELSKRSMDIVKDVLRRLKELVDRVEKKVREK

SEQ ID NO: 2097 - protein, 59 aa, Artificial Sequence
  Synthetic sequence.
EKKVEEIREKSERVNRDLEDKLRKIEEKVKESEKRLRDLLREIEERIKRAIEKLERDLK

SEQ ID NO: 2098 - protein, 60 aa, Artificial Sequence
  Synthetic sequence.
SKVEELTERLRRLSKRSEEEVEKSNKDNDELVRRVLKRVKEVMRELEKLVEKVKEDVRRE

SEQ ID NO: 2099 - protein, 59 aa, Artificial Sequence
  Synthetic sequence.
KETLDRIRKEVEDSIERLKKLLDDSRRRSKEANDALRKLLKEIEDTIRRAIEELERARR

SEQ ID NO: 2100 - protein, 60 aa, Artificial Sequence
  Synthetic sequence.
SRVEELTEENRRLAKRLKEVVKKVLDELRRRVEEVKERVERSNKKLRDLVREVDERVATK

SEQ ID NO: 2101 - protein, 59 aa, Artificial Sequence
  Synthetic sequence.
EEIVRRIEEESKKVNRELEELLRKIEDDIRKAEEELRELVERSKREVDKALDDIDRRTR

SEQ ID NO: 2102 - protein, 61 aa, Artificial Sequence
  Synthetic sequence.
KEVDDVKKELDDVDREVKELIKRAHDKNRKVVKEVEDELRRLTEDDKRVADKVRELLKKVR

SEQ ID NO: 2103 - protein, 59 aa, Artificial Sequence
  Synthetic sequence.
KDKMKEVEDEVRKVLDTIRKLLKRDEEAVKEALDKVKKMLDDARRHSEKVLREVEDTLR

SEQ ID NO: 2104 - protein, 56 aa, Artificial Sequence
  Synthetic sequence.
SEVEELLKEVRELARRIEEEIKKLHRRNEELARRIKETIKRLIDENRKLAEDVRRD

SEQ ID NO: 2105 - protein, 58 aa, Artificial Sequence
  Synthetic sequence.
EDAKRIRDELERVRKSIEKLIRDNERFLEKVERDIRKLIEENEDLLRKIKEDVERKEK

SEQ ID NO: 2106 - protein, 56 aa, Artificial Sequence
  Synthetic sequence.
DEVRELLETVRKLAEDVERRIRELIKENERLAREVERRIKELHDRNRELAREVEEK

SEQ ID NO: 2107 - protein, 58 aa, Artificial Sequence
  Synthetic sequence.
KEAREIERELEKVKDTIRRLLERNEELLEEIARRITKLLEEDKELLERIERRIAEKLK

SEQ ID NO: 2108 - protein, 60 aa, Artificial Sequence
  Synthetic sequence.
SEVETLLRELKRLAEEVKKRIEELDRELKKLSDDVRREIERLIRENERLAREVLKEIRDL

SEQ ID NO: 2109 - protein, 59 aa, Artificial Sequence
  Synthetic sequence.
EEALREIEKLLRKVEEDVRRLIEKLKKSLEDSARDVDRLVKENERILEEVAREVEKLLR

SEQ ID NO: 2110 - protein, 60 aa, Artificial Sequence
  Synthetic sequence.
KEVEDLLRDLKRIVDEVEKRIRKLIEDNKRLADEVRERIERLHKRNKDLAEEVLKRVREL

SEQ ID NO: 2111 - protein, 59 aa, Artificial Sequence
  Synthetic sequence.
KEVVKRIKEELDRVREEVKKLIKRNEELLKKVAEDVRRLLEKDKKALEEIKRRVEDELR

SEQ ID NO: 2112 - protein, 56 aa, Artificial Sequence
  Synthetic sequence.
DELEELRKRVKENEDEVEKVLRELHKLNEENKEEVDRALEELRKRVRDIEEEIKKE

SEQ ID NO: 2113 - protein, 60 aa, Artificial Sequence
  Synthetic sequence.
RKDVVDKVRKVIEEVHKRSRDLAKEAREVNRRVHETTKKLVEDVRRVIEKVEEDVRRKVK

SEQ ID NO: 2114 - protein, 56 aa, Artificial Sequence
  Synthetic sequence.
SSLEEADKKVDKNRRDVDRALEELHRRNKRNEEEIRKALKENRETNKRLLEEIRKN

SEQ ID NO: 2115 - protein, 60 aa, Artificial Sequence
  Synthetic sequence.
REDAVRRVDKVIKEVHDESKRLVDELRDRNRRVHDETRRLDEESKKINRTVEELIRRKET

SEQ ID NO: 2116 - protein, 61 aa, Artificial Sequence
  Synthetic sequence.
DKVEELLKRLEESTRRILKRVEELLRENERLAREVRKTVERLLEENRRLIEEVERRVRRDK

SEQ ID NO: 2117 - protein, 59 aa, Artificial Sequence
  Synthetic sequence.
EKLRRELRRLLRESEKKIKEMLDRNKELLDEIERTIRELLKRNEDLLREVRERAKEADK

SEQ ID NO: 2118 - protein, 60 aa, Artificial Sequence
  Synthetic sequence.
DEAEDLLRKLKRSTDEIKKTVEKLLRENEKTSRDIEREVRELLRRNKELAERVEEVARRE

SEQ ID NO: 2119 - protein, 59 aa, Artificial Sequence
  Synthetic sequence.
EKVRRELERLLRESEKEIRKLLKRNKELLDESRDTIREMLERNKRLLEEVRKKIEKMKE

SEQ ID NO: 2120 - protein, 61 aa, Artificial Sequence
  Synthetic sequence.
SEAERLLEELKRSTDEIKKRVEKLLEDNKRTSEEIEEEVRRLLETNRKLIEDVKRKVERDR

SEQ ID NO: 2121 - protein, 59 aa, Artificial Sequence
  Synthetic sequence.
ERVRRELEKLLRDSERKIKEMLERNEKLARDSEERIRRMDDKNKDLLRRVKETIERKLK

SEQ ID NO: 2122 - protein, 61 aa, Artificial Sequence
  Synthetic sequence.
DEVEDLLRKLEESTRRILERVKKLLEDNKRLIDRVRKEVERLLRDLKRLAKEIDEEVRRDN

SEQ ID NO: 2123 - protein, 59 aa, Artificial Sequence
  Synthetic sequence.
ERVIRELEELLKESKKRIDDALRENEKLLREVKRRIEEAERTIKELLEEIKRKIAEEEK

SEQ ID NO: 2124 - protein, 60 aa, Artificial Sequence
  Synthetic sequence.
KEAEELKRRLEDLVRRVEEDNRRLLEEHKKLVKDVRKRAKELLETHKKLVEDVTREVRKS

SEQ ID NO: 2125 - protein, 59 aa, Artificial Sequence
  Synthetic sequence.
REVLEDLKRDLERARKINEESEKRIKDSDKRVHEEIRRVLEEVKKSDEEVRRRADRERE

SEQ ID NO: 2126 - protein, 60 aa, Artificial Sequence
  Synthetic sequence.
REVDELRKELERIVKEVEDVIRDLNKKLKDILKDVKDKSDELNERLKKIVEDVRRLIRDV

SEQ ID NO: 2127 - protein, 59 aa, Artificial Sequence
  Synthetic sequence.
DKMVEELERLLDEARRRVEEAIRSNEELLKRIEEESERTVRSNEKLLKEAEEEVRRAEE

SEQ ID NO: 2128 - protein, 61 aa, Artificial Sequence
  Synthetic sequence.
DEVEDVERDLKRILKEVKDRSDELIERNRKSTEDMKRRSKELNEELRRIIEDIRRLIRDTK

SEQ ID NO: 2129 - protein, 59 aa, Artificial Sequence
  Synthetic sequence.
SKMVERLERLLEEAERTSRETLKRLEDTLRESEKRSRETVRSNEELVKEVTKEVEDAKK

SEQ ID NO: 2130 - protein, 60 aa, Artificial Sequence
  Synthetic sequence.
DEVETVLRDNERTTKEAEDDVRRLNEELKEIIKRVREVSKRLIDELRRILEDVERRAREV

SEQ ID NO: 2131 - protein, 59 aa, Artificial Sequence
  Synthetic sequence.
SDFVERLRRTLEESKDKARRNVESNRELLERARKDSKRTLEELERLLETVRKSVDEMKK

SEQ ID NO: 2132 - protein, 61 aa, Artificial Sequence
  Synthetic sequence.
EREERLEEKLKKSVDDSRELIERVLRKHEKVSDKVRRELERILEDHKRVLEEIKRVLKDRR

SEQ ID NO: 2133 - protein, 55 aa, Artificial Sequence
  Synthetic sequence.
ERLKDLLDKAHEEDRRAKEEVKRLLEDTTKKIKEFLDRVERSNEEVERELEKAER

SEQ ID NO: 2134 - protein, 60 aa, Artificial Sequence
  Synthetic sequence.
DKDRKIKRIIEEVKKTIRKLLDDVRRINEEVLKELRKLLREVEEINKEILRRLKELVKTS

SEQ ID NO: 2135 - protein, 59 aa, Artificial Sequence
  Synthetic sequence.
EKVKKELDDEIRDAERELREAKKDMDRSNEELREEIKRAEERLRRLDEKLREEVEKDRK

SEQ ID NO: 2136 - protein, 60 aa, Artificial Sequence
  Synthetic sequence.
SVKEEIKEMLKKIKRHSDEALKKNKETLDRDRKRVEDVIRELKKLLDEIRKRVEDVRRRV

SEQ ID NO: 2137 - protein, 59 aa, Artificial Sequence
  Synthetic sequence.
EEIARKVRELLERVLRDDRRVVREVEELNRRMHKKNEEVAKKVRDLLREVRKELEDVDR

SEQ ID NO: 2138 - protein, 63 aa, Artificial Sequence
  Synthetic sequence.
REAEELLKELDEIIRRVEEEVKRLLDKVRETTKRIEEEIRKLDEDLKEIIREVEERIRKLKSD

SEQ ID NO: 2139 - protein, 59 aa, Artificial Sequence
  Synthetic sequence.
EEVERRIKRLREKVKKKIDELKERVRRLLEESRRKAERVEESNRDLLRELKERLEERRR

SEQ ID NO: 2140 - protein, 60 aa, Artificial Sequence
  Synthetic sequence.
SFEEEIKKIADEVEKRIRDAEKRSKDILEKSREVVERAKRRSEKLLRDAEREIKRVMEEK

SEQ ID NO: 2141 - protein, 55 aa, Artificial Sequence
  Synthetic sequence.
DEMLRRLKKVTDDVRKRLEDSHRRLEKVTEESRKRADESHEELRKLIEEVREKLK

SEQ ID NO: 2142 - protein, 58 aa, Artificial Sequence
  Synthetic sequence.
SSKERIEKILREVKREIEEAEKRSRDILKDSERIMRDVKRTTDDLLRKAEEIIREVAK

SEQ ID NO: 2143 - protein, 55 aa, Artificial Sequence
  Synthetic sequence.
EEVLKRLRELIDTVRRVLEESHKRLRELTKRSEEEARRVNEELRELIDRVRREAE

SEQ ID NO: 2144 - protein, 60 aa, Artificial Sequence
  Synthetic sequence.
DVEKRIEELRERSDRIIDEARKRSEKLLRESEKMMRDVDKTTEDILREAEEEIKRVLDEK

SEQ ID NO: 2145 - protein, 55 aa, Artificial Sequence
  Synthetic sequence.
ERVLKDLERLSKESEDELRRSHEELKRLTEESRETIEDVNRKIKEKIEDVKRKLK

SEQ ID NO: 2146 - protein, 60 aa, Artificial Sequence
  Synthetic sequence.
SAEDSIRELLERDERLLEEARKEAKRLNEENERLLERIEETVRRLLEEIKRLLDDIRKKI

SEQ ID NO: 2147 - protein, 59 aa, Artificial Sequence
  Synthetic sequence.
EELVKRVEERIKRLHDENRRLVKEVIEEVEKLIRDNEKLAEDIEREIRRLLKELDEAAK

SEQ ID NO: 2148 - protein, 60 aa, Artificial Sequence
  Synthetic sequence.
SEVEEIVKEIEKLIKENEEVVREVEKEIRELIKRNREVVERIRKELEKMLRELERLAREG

SEQ ID NO: 2149 - protein, 58 aa, Artificial Sequence
  Synthetic sequence.
EARERIKELVRRNERLLREVEKRLKTLSEENKKLLEDAKRELDRILKEVRDLLRETER

SEQ ID NO: 2150 - protein, 59 aa, Artificial Sequence
  Synthetic sequence.
SRVERLSAEIKKLIDENRRVAEELLRELEKLLKDNEDVVREVERRIRDSSRKLEELARA

SEQ ID NO: 2151 - protein, 58 aa, Artificial Sequence
  Synthetic sequence.
EAREDMDRLVRENERLLKKVEDDLRKLSEENKRLVDRARERLARLLEENERLVDERRK

SEQ ID NO: 2152 - protein, 56 aa, Artificial Sequence
  Synthetic sequence.
REAEEALKRVKEILKRIAEEVERVLTEVKKLSEDVKRRVEEVLTRLKRSTEEIERK

SEQ ID NO: 2153 - protein, 56 aa, Artificial Sequence
  Synthetic sequence.
KKLVEDVDREIKKLLEEVTKKAKRLNDENKRLLDDVRDKARRVIEESREVLERARK

SEQ ID NO: 2154 - protein, 59 aa, Artificial Sequence
  Synthetic sequence.
SSEEEVEKLERKVRAVIRKAEEDLEDSLRKSEKMAKEVTDEIEKSRRKAKAVIDDARRR

SEQ ID NO: 2155 - protein, 55 aa, Artificial Sequence
  Synthetic sequence.
EEVLKKVEELIRKVEKVIRTVLEEDRKVSEDSLRKMRKVLKEDEDVIKEVRDRAQ

SEQ ID NO: 2156 - protein, 59 aa, Artificial Sequence
  Synthetic sequence.
SMKEEVDRLLKEVKDVIREVRERIKKSEEDVRRVIDDARRKLEELSKRAREVVEEVRRR

SEQ ID NO: 2157 - protein, 55 aa, Artificial Sequence
  Synthetic sequence.
EEVLKRVKELIDEVRERIEKVLTDDRRLIERVKREIERVIRENEKVIRDARERLR

SEQ ID NO: 2158 - protein, 60 aa, Artificial Sequence
  Synthetic sequence.
DEVEKLLRDLEELDRDIERKVRELLKRNKEVLDDIEREVRRLEKELRRIIKEVADVIRKT

SEQ ID NO: 2159 - protein, 56 aa, Artificial Sequence
  Synthetic sequence.
KKEVDKIEKHSRDLIERAKRETDRLLEEAERLMREVVDRVRKILEEAKRLIDEARR

SEQ ID NO: 2160 - protein, 60 aa, Artificial Sequence
  Synthetic sequence.
DVEDEARRLEKELRDILREIADDIRKLLEENKELLKESEKDIRRAEKAIEDILDDVRKRI

SEQ ID NO: 2161 - protein, 59 aa, Artificial Sequence
  Synthetic sequence.
EKLLTEVSEEVKRLADELRELARRVKEEVKKLLDDNRETTDRIRRTVTELLEELKRKTK

SEQ ID NO: 2162 - protein, 60 aa, Artificial Sequence
  Synthetic sequence.
SVDETITEVIKRIEDTLRKVKEDADRLDERNKALLEDSKKKIKEVEEELRRILEEVRRKV

SEQ ID NO: 2163 - protein, 59 aa, Artificial Sequence
  Synthetic sequence.
RELVEEVKERAERLLKELEDLIKKVKEEVERLLEENRKTTEDILKRAKDLARELRKRTK

SEQ ID NO: 2164 - protein, 60 aa, Artificial Sequence
  Synthetic sequence.
DAKESIEEVKKRLEKSLEDSERESRKTLEENKDLLRRSREEIKKALDRLKDLLRRAEERI

SEQ ID NO: 2165 - protein, 59 aa, Artificial Sequence
  Synthetic sequence.
EKLVEEVEREVERLLRENEKTSDEIKKTSEELLKRNEETTRRILEEVERLLKRVKEATD

SEQ ID NO: 2166 - protein, 60 aa, Artificial Sequence
  Synthetic sequence.
KVEETATRLREEVKRSDTEVHRENRESEDRNKKSDEEVHKTIRDALKRVKDKLDDVRRRR

SEQ ID NO: 2167 - protein, 59 aa, Artificial Sequence
  Synthetic sequence.
DEIVRRVKEEVERLLEEHRRLAKRVRDENRRSTEEHRDLVRKVKREIERLEEELDRAEK

SEQ ID NO: 2168 - protein, 60 aa, Artificial Sequence
  Synthetic sequence.
KVEESADRARREVKRSDEEVRKRNTDSREEIKKSDKEVHERIRELLERIRRILDEVRKKR

SEQ ID NO: 2169 - protein, 59 aa, Artificial Sequence
  Synthetic sequence.
DEIVRRVEDEIEKLLREHRELVKDVERENRRLLEEHKKLVEEVEREVRRMMKKLRDATK

SEQ ID NO: 2170 - protein, 60 aa, Artificial Sequence
  Synthetic sequence.
KVEEEIEKLLRHNDELLKEVEKRAREVEERIKRSDEAVHDSIRKLLEDVKRILDEARRRR

SEQ ID NO: 2171 - protein, 59 aa, Artificial Sequence
  Synthetic sequence.
DEIVERVEREVRKLDDDDRRLAERVLRRAEELLKRHKELVERVEREVERLLKELEDAVK

SEQ ID NO: 2172 - protein, 60 aa, Artificial Sequence
  Synthetic sequence.
KAEDEARRLERHNKELLKEVRKDNTRSEREIEESDKRAHDEIKRLEEEVEEILKDIERRR

SEQ ID NO: 2173 - protein, 59 aa, Artificial Sequence
  Synthetic sequence.
DEIVERVRRTVKKLDEDDDKLVKDVRKENKDLLRRHEELVREVTERVKKLLRDLREASR

SEQ ID NO: 2174 - protein, 60 aa, Artificial Sequence
  Synthetic sequence.
DVEDEVRRAEESNRDSDRKVHEEVRRVLKSNRDSDTKAHRDVEEAKRRLKTELKDIERKR

SEQ ID NO: 2175 - protein, 59 aa, Artificial Sequence
  Synthetic sequence.
KRLVDKVRTEIKRLNDEHRKVLKKVRDLVRKLNEDHERVVRDVRREIKRLRDELRETAR

SEQ ID NO: 2176 - protein, 60 aa, Artificial Sequence
  Synthetic sequence.
DVEDEVRKMKKELDELLKRAEEEVKRVLESNEKSDDEVHKRAREAEEELRRLLDDVRRRR

SEQ ID NO: 2177 - protein, 59 aa, Artificial Sequence
  Synthetic sequence.
KKVVKDVEKKIRDLLTKLREVLRRVRREVKKLNERHEDILREVERLIEELRKRLEDTTK

SEQ ID NO: 2178 - protein, 60 aa, Artificial Sequence
  Synthetic sequence.
DIEDEVREAIERLKKLLEDSEREVRESIKRLRDLLREIARESEEANERIKRLLEEIERKV

SEQ ID NO: 2179 - protein, 59 aa, Artificial Sequence
  Synthetic sequence.
EDVRRRLRELVEKVMREIEDSNRKLRKLSKDSEKAVRDAERRNRKLVREIEDRIRKSLK

SEQ ID NO: 2180 - protein, 60 aa, Artificial Sequence
  Synthetic sequence.
EVDKEVRKVLKDIERLLEEIERRVRKSIEDLKTELKKIEDESEKANRELERLLREIKDRV

SEQ ID NO: 2181 - protein, 59 aa, Artificial Sequence
  Synthetic sequence.
EDVRRELRELVDKVRKDVERVMKALEDLSRESRREVRRVKEKNRRLVEEVKKRVEDKAK

SEQ ID NO: 2182 - protein, 59 aa, Artificial Sequence
  Synthetic sequence.
SEDEDMVRDVKRLIDEVRKLIERVKREVEDLIRRLNELDERVVRTSEELARDVKRLVDA

SEQ ID NO: 2183 - protein, 56 aa, Artificial Sequence
  Synthetic sequence.
SEDVERLKEEIKELLDRARRTIEELERRIRENVKRSRKKIEDLVRRHKKILDEARK

SEQ ID NO: 2184 - protein, 59 aa, Artificial Sequence
  Synthetic sequence.
REKEEAVKTVKELIKEVREMVERLHRKNEEMIRTVREVVKELNERNKELIKTVRDLRRR

SEQ ID NO: 2185 - protein, 56 aa, Artificial Sequence
  Synthetic sequence.
SEDARRLEREVRELLRDVREKVERNKEKVERLKREVRKRVRDDLERVKRLKEEVDT

SEQ ID NO: 2186 - protein, 59 aa, Artificial Sequence
  Synthetic sequence.
SEDERAVREVEKLIKRVEEVVRRLNERNRRLIEEVRRIVEELHRRNEDLIRKVRELAER

SEQ ID NO: 2187 - protein, 56 aa, Artificial Sequence
  Synthetic sequence.
SREMERLEREVERLLREVERRVKEDEERVRKLLEEVERLVRRNARKVEELLKEVEK

SEQ ID NO: 2188 - protein, 63 aa, Artificial Sequence
  Synthetic sequence.
SEKEKLTEDIERIIDKVRREVERLNEENERLIREVRKRVEKLNRENKEAIKRVEEEVRRLRDR

SEQ ID NO: 2189 - protein, 56 aa, Artificial Sequence
  Synthetic sequence.
EELVKRLEEKIRELLKRARDLVKEDEDRIRKLLEEIERVNRDDKRKIDKLLEEVRR

SEQ ID NO: 2190 - protein, 60 aa, Artificial Sequence
  Synthetic sequence.
KSDEEVRERVERLLREVRRLTREVRRHAKETLDTVAELVDRVRREAERLLREVEELLRRL

SEQ ID NO: 2191 - protein, 56 aa, Artificial Sequence
  Synthetic sequence.
ETEVRDVKRKADEIKEEDKRILEEAEKRHKELLEDLKRLLDRIKEEVKRVREDIKT

SEQ ID NO: 2192 - protein, 59 aa, Artificial Sequence
  Synthetic sequence.
REEDEARKRLKELLDRITKLSKEVRDLIREMLRELEESIERTKREIDDLLRRLEEIRRA

SEQ ID NO: 2193 - protein, 56 aa, Artificial Sequence
  Synthetic sequence.
SDEVERVKREIEEHLRRSEEDIRRVAEEIKKLVEESRRVIEEAKDRVRRLVERVKK

SEQ ID NO: 2194 - protein, 60 aa, Artificial Sequence
  Synthetic sequence.
SEEDDARRKVEELLRRDKKVVDEVRDELRKLLEELRRLSEEVEKLIRKLEKELREVRKRG

SEQ ID NO: 2195 - protein, 55 aa, Artificial Sequence
  Synthetic sequence.
ETVKKVEDEVRDSLRRAKKIIEDAARAIRKHLEESKRRIEEARKRLEELLKEAED

SEQ ID NO: 2196 - protein, 59 aa, Artificial Sequence
  Synthetic sequence.
SREEEAKKEVKRLLDELKKLSDDSRKRIRESHERLKRVIEEVRREAERSHEELERVIRR

SEQ ID NO: 2197 - protein, 56 aa, Artificial Sequence
  Synthetic sequence.
EKDVRKVDRDVDEILKRSEDIIRKVKEDSERLLKEVRERIEEMKKRTDDLLKEAEK

SEQ ID NO: 2198 - protein, 60 aa, Artificial Sequence
  Synthetic sequence.
RKEETLKRAEEKSKETLERNKRLLERIEEESRKTLEKNKDMLRRVKKRVEDLLREIKRDK

SEQ ID NO: 2199 - protein, 56 aa, Artificial Sequence
  Synthetic sequence.
EEELRRVIEDVLRESEKLHREDEELARRVLEESERLHREDEELARRVEKEIRELKK

SEQ ID NO: 2200 - protein, 56 aa, Artificial Sequence
  Synthetic sequence.
SLDELAKKAKEDSERSVRTDEKRLEEIARRIKELIKENEDLLREVKKEIDRLIEEI

SEQ ID NO: 2201 - protein, 56 aa, Artificial Sequence
  Synthetic sequence.
EEEARKLLEDIKRRSEELHKRNDELAREVEKRIRKLIKENRELAEEVRRRIEELRR

SEQ ID NO: 2202 - protein, 56 aa, Artificial Sequence
  Synthetic sequence.
RTDETVKKIEEDSRRSLEEDRKELEEVERRSRESIKENERLLREVAERIKRLIEEI

SEQ ID NO: 2203 - protein, 56 aa, Artificial Sequence
  Synthetic sequence.
EKTLKELADRIKERSEELHRRNEKLAREVLERSKELIKRNEELARRVIEEIKKLKK

SEQ ID NO: 2204 - protein, 60 aa, Artificial Sequence
  Synthetic sequence.
DVEETLKTVEDESRKTIETLRRSLRKSEEESKRSIDRLRESLERSREEVERLLREIERDK

SEQ ID NO: 2205 - protein, 59 aa, Artificial Sequence
  Synthetic sequence.
EEAVEKLKKLAEDVRRESEELRRELEELSKDVRRVSEELERRLRKLSEEVKKRIKDLKR

SEQ ID NO: 2206 - protein, 60 aa, Artificial Sequence
  Synthetic sequence.
SVEKILRDVEDTSRRTIEELKRSLEESKKTVTKLLEENKDLLRRIKEDVRRRLEEIKRDK

SEQ ID NO: 2207 - protein, 59 aa, Artificial Sequence
  Synthetic sequence.
EEAVERLKELAEEVKRVSKELLEELRKISEEIERRIRRLIEENKELADRVREEIERLKK

SEQ ID NO: 2208 - protein, 61 aa, Artificial Sequence
  Synthetic sequence.
DKVDRVIEEARRILERLRKRVTDVVRELEEINRRLKREVDESVKEVDEILKKLEERVRKRK

SEQ ID NO: 2209 - protein, 56 aa, Artificial Sequence
  Synthetic sequence.
KELVEKLDREVKRLLKEARELSEENRRRSKKLLDELRKSSERIREKVEDLVRRIRK

SEQ ID NO: 2210 - protein, 59 aa, Artificial Sequence
  Synthetic sequence.
SEEEAAKRRIDELLKRLKEVSDKVKEDIDELLKDLERRSREVVEEIKKLLEEVKDRVRK

SEQ ID NO: 2211 - protein, 56 aa, Artificial Sequence
  Synthetic sequence.
SERLKRVTEEAKRLHEENKKLLDDVRREARRLNEDNRRLLDEVRKRVEEVLRRIRK

SEQ ID NO: 2212 - protein, 61 aa, Artificial Sequence
  Synthetic sequence.
DEDRRALEEVRRVLEEDKRVSKRSRDLIEKVLREVEELIKEVTKRAEDVLRRVREIIKTSG

SEQ ID NO: 2213 - protein, 56 aa, Artificial Sequence
  Synthetic sequence.
RELVKKVEDEIKESEDESEDLIRRADEAVKRLRKRVRDVIEKARRDLEKIVTDAKK

SEQ ID NO: 2214 - protein, 59 aa, Artificial Sequence
  Synthetic sequence.
SIEKLIEDVRREVERIEEESKKLVKKAREDVKRSHDHSKRLMEEATRRVRDILRRAEEM

SEQ ID NO: 2215 - protein, 59 aa, Artificial Sequence
  Synthetic sequence.
KELVDDARRRVEELLRRLEDSLRKSERLVRELLKRSKEVDDRIREEVKRLLEELDDRRR

SEQ ID NO: 2216 - protein, 60 aa, Artificial Sequence
  Synthetic sequence.
DTEEILKRIEEEIRRLLEENEKLLRDAEDTVRKSLEEHERILDEVTKRIRKMLEEIARTD

SEQ ID NO: 2217 - protein, 56 aa, Artificial Sequence
  Synthetic sequence.
DETLKRLAEEVLREVERLLRENERLIREVERRADKTVKDLEKLIEEVERRIDELKK

SEQ ID NO: 2218 - protein, 60 aa, Artificial Sequence
  Synthetic sequence.
DSKEIIDKVREDIKRADEENKRLLEEVRDRIRKLLEENETLLKDSERKARELLEELRRKD

SEQ ID NO: 2219 - protein, 56 aa, Artificial Sequence
  Synthetic sequence.
EEDLKRLAKEVKDRIRELLERNRELIKEVEKRVRRLLDENRKSSEEIRKEVEDRKR

SEQ ID NO: 2220 - protein, 60 aa, Artificial Sequence
  Synthetic sequence.
SDEERALKLVEDVIRDVKRLNKRDRELIEKVERDIEKLLEDHRRLVDEVRRRVKELEDKV

SEQ ID NO: 2221 - protein, 56 aa, Artificial Sequence
  Synthetic sequence.
SELLKEVEERIKKLLKSNKDLLREVEERVRRALERVKRSDEEVHKMARDALRRVRK

SEQ ID NO: 2222 - protein, 60 aa, Artificial Sequence
  Synthetic sequence.
SEDEDAERLVEEVIRRVKELLDTHKRLVEEVERKIRELDKKDAELVKEVEKRAEDLRRKV

SEQ ID NO: 2223 - protein, 56 aa, Artificial Sequence
  Synthetic sequence.
SELLERAEREIRRLLREVKESDKEVHRRVRRMLEHNKDLLRRARDSIKKVLDEIRR

SEQ ID NO: 2224 - protein, 60 aa, Artificial Sequence
  Synthetic sequence.
SEREDAERVIERVEREIRELNRRDEELIRRVEKEIRRMLEEHKTLVKEVTRELDRLRREV

SEQ ID NO: 2225 - protein, 56 aa, Artificial Sequence
  Synthetic sequence.
SEDLKRVDKKVRDVLRSNKELLDEARKRITKVLEEVRRSDEEVKRRAEKVLDEVRK

SEQ ID NO: 2226 - protein, 60 aa, Artificial Sequence
  Synthetic sequence.
SEEEDAERAVREAAELAKKANKEDEELARRAAELAKKALREHEELVERAARLADEAEKKA

SEQ ID NO: 2227 - protein, 56 aa, Artificial Sequence
  Synthetic sequence.
SERAKKAEDDARKAAEDNRRLAKRAKEEARRAAEEVKKSDKEAEERARRAAERVRR

SEQ ID NO: 2228 - protein, 56 aa, Artificial Sequence
  Synthetic sequence.
SLERLLEEVTRRSEETVRTNEEILRRAADEVRKAIESNKDLLRKIKKEVDDVKRRL

SEQ ID NO: 2229 - protein, 56 aa, Artificial Sequence
  Synthetic sequence.
EESVRTIIEEVERTSREMNERLKKIIDEVRRTIEELNKDLKRILEEIRELVKRLET

SEQ ID NO: 2230 - protein, 56 aa, Artificial Sequence
  Synthetic sequence.
SLEETLEEVDRKSKETVKRLKELLDRIRERVEEAIKSNEDILRRIKAEAEEAERRL

SEQ ID NO: 2231 - protein, 56 aa, Artificial Sequence
  Synthetic sequence.
ESEVERIIRELERVSRELMELLKKILEEVRKRIKELNDRLEEILRRVRKRIRELEQ

SEQ ID NO: 2232 - protein, 56 aa, Artificial Sequence
  Synthetic sequence.
SLEELLERIKRDSDRTVRELEELLERAEEISRRTEKSNEDSLRRSTKEVKEAEDRL

SEQ ID NO: 2233 - protein, 56 aa, Artificial Sequence
  Synthetic sequence.
EEVVKKMLDELRDRSEKLLRTLRDIIRRAKERSDDLNRKNKESTEKVREDIRRLEQ

SEQ ID NO: 2234 - protein, 56 aa, Artificial Sequence
  Synthetic sequence.
KLEELLKRIAEESKKTVEELEKLLEEVERISKKTVEELEDSLRRSEEDAKEAEERL

SEQ ID NO: 2235 - protein, 56 aa, Artificial Sequence
  Synthetic sequence.
EDDVRRILEEVRRLSEELKTRLRKILEDLRRLSEKLKRENEESTKTVRKVIEDLER

SEQ ID NO: 2236 - protein, 56 aa, Artificial Sequence
  Synthetic sequence.
SLEELLKRIKERSEETVKRLEDLLKRVREDIDRAIKELKKSLDDSRKTVEDIEREI

SEQ ID NO: 2237 - protein, 56 aa, Artificial Sequence
  Synthetic sequence.
EEKVKEIAEEVRRRSEKMLEELKKLVDEVRKRLEDLRKRNEDSTEEMKKRVEEEKR

SEQ ID NO: 2238 - protein, 57 aa, Artificial Sequence
  Synthetic sequence.
SEVEKVIKDNKRSVDEIRKTLKRVLERNEKTLRENEKKIRDIIAEVDKRLKDLEREI

SEQ ID NO: 2239 - protein, 59 aa, Artificial Sequence
  Synthetic sequence.
DKAIKEIEEEVRRVDDRVRKLVEKLDRDIKEVDDRSRKLTDDLRRKVEEVLRRIKETVT

SEQ ID NO: 2240 - protein, 55 aa, Artificial Sequence
  Synthetic sequence.
REVEEIEKELRKIIRDLKELLRELRERLEKLDRDLKDLLRRLREENREILDRLRK

SEQ ID NO: 2241 - protein, 55 aa, Artificial Sequence
  Synthetic sequence.
EKVIRDADRMAKELKKDLRKVLEDNRRTVEKLKRDLEEVDKESDEEARKLREEIR

SEQ ID NO: 2242 - protein, 63 aa, Artificial Sequence
  Synthetic sequence.
SESEKIEREIRKLIDDSRKNSERIRREIEKLIRDSEETSKEIKKEIEDLLRELKEMLDEIKKR

SEQ ID NO: 2243 - protein, 55 aa, Artificial Sequence
  Synthetic sequence.
EEVLRRAKKALEEDKKRNDEVLDEVRKALEEDKKRNDKVLEDARRVIKKIKDELK

SEQ ID NO: 2244 - protein, 63 aa, Artificial Sequence
  Synthetic sequence.
KDEETIRRRIEELLKRSEDNSERIRRTIRELLERSKKLSEEVRKRIEELLKRLDEKVKEIRKR

SEQ ID NO: 2245 - protein, 55 aa, Artificial Sequence
  Synthetic sequence.
EEVLKEAEKRLREDKKRNDEVLKRVTEAVEEDKKRNDDVLEKVERAIREIARKLD

SEQ ID NO: 2246 - protein, 60 aa, Artificial Sequence
  Synthetic sequence.
SEEEKVIRDLERLLEENEEHSRDVERKLRESDKRLREMVKKVSDEIRKLDEEVEELLRRG

SEQ ID NO: 2247 - protein, 55 aa, Artificial Sequence
  Synthetic sequence.
EDALRRVKEALERSKKRLDKVLKDHEDSVRELKKEIDDVLKRNEETVREIEKRAR

SEQ ID NO: 2248 - protein, 60 aa, Artificial Sequence
  Synthetic sequence.
EEVERVKRELERLLEENDEHSKEVEKRIRDLDRKAEELLREIEERLRRSDERLKRLLERG

SEQ ID NO: 2249 - protein, 55 aa, Artificial Sequence
  Synthetic sequence.
ERVLKKVEDDLRESEKRVEEVLRKNEETVRRLKEELRKVLEDHKRTVEELRRRLT

SEQ ID NO: 2250 - protein, 60 aa, Artificial Sequence
  Synthetic sequence.
SREEEVEKRIREVLKRLEELLADVERRARELNRRLEKVVRDVKKEIEDLDRKLRKLLKDG

SEQ ID NO: 2251 - protein, 55 aa, Artificial Sequence
  Synthetic sequence.
EKVLKDVTDMARELERRLEEVLRKHRKSSEDLKRRIDEVLKRNEETLREIDRRLN

SEQ ID NO: 2252 - protein, 60 aa, Artificial Sequence
  Synthetic sequence.
SEREKAKRELERLLEEDRKHLKDVERELKELDEEDERHLREVEKELKELDDRAKEALDRR

SEQ ID NO: 2253 - protein, 55 aa, Artificial Sequence
  Synthetic sequence.
EEVLKEVKRLSEKSKTDLEKIVRDNKRSSDDSRRELERVIRENEETLRRLAERIK

SEQ ID NO: 2254 - protein, 60 aa, Artificial Sequence
  Synthetic sequence.
KEEEEAKKELDDLLRRLKDLYRRIREELERLDRRLEEAYRRIKEDLKRLDEELRRLLEKD

SEQ ID NO: 2255 - protein, 55 aa, Artificial Sequence
  Synthetic sequence.
EKVIRDVRKASRDTEREIRKVAEDNRKSSEDSRRKLEDVLRKNKETLDRLRDELR

SEQ ID NO: 2256 - protein, 60 aa, Artificial Sequence
  Synthetic sequence.
DEKETVEEELRRLLEELKKHIEDTERKLRKLDTDLEDVYRRIEEELRRLLEELKKMLDDR

SEQ ID NO: 2257 - protein, 55 aa, Artificial Sequence
  Synthetic sequence.
EKVLRDVEEALRRAKKRSDDVVRENEKSSRRSEERLERVLRDAKRVLKELKERID

SEQ ID NO: 2258 - protein, 61 aa, Artificial Sequence
  Synthetic sequence.
SELEEVLKRVAEVVERVSREDEKVNRKNDAAVKKVTKDDRKVLEDLERKLRELEKDAKDRG

SEQ ID NO: 2259 - protein, 59 aa, Artificial Sequence
  Synthetic sequence.
EDVIRRLEKEVRDVLKDWEEKSKEAEEKNKTVNKRWEDESRRLKKKVDRLIEKIKEDLR

SEQ ID NO: 2260 - protein, 60 aa, Artificial Sequence
  Synthetic sequence.
RSEELLREIEERIKRLKEKNEELVKEIRRRARELEREDDRAKKEIDDLARKVEEKIRRTI

SEQ ID NO: 2261 - protein, 55 aa, Artificial Sequence
  Synthetic sequence.
DDVVREVRKLIEELDRHLERLVEEVRRVVKELLEISKEILDRVREVITRLREEVK

SEQ ID NO: 2262 - protein, 59 aa, Artificial Sequence
  Synthetic sequence.
SEVEDAVRKIRELAKEIARAIDELLKEHEELIRTVADALEKLVRTSDKLAEDIARVIDG

SEQ ID NO: 2263 - protein, 56 aa, Artificial Sequence
  Synthetic sequence.
RELLEELKRILEDLERRAKEIVDRARELNKRAEDEIRRLIEDSKRKLEEIRKRIEE

SEQ ID NO: 2264 - protein, 59 aa, Artificial Sequence
  Synthetic sequence.
KEAEEAVKRLRDLVRRVEEETKRLLRESRESLKTLEEITDRLLKRSEESVKEIEKVITR

SEQ ID NO: 2265 - protein, 56 aa, Artificial Sequence
  Synthetic sequence.
RELLTEVTKLIKDHHDKVREILRESDKELDRHHKDVERILERSKRELERLEDEVRR

SEQ ID NO: 2266 - protein, 57 aa, Artificial Sequence
  Synthetic sequence.
SREELLKEIKKKIDDIKRENEKLLRDIERLIRELEKRDKELLDEARKTSEELVRRAG

SEQ ID NO: 2267 - protein, 55 aa, Artificial Sequence
  Synthetic sequence.
RDVVRDVDRILTEWKKESEDLVEEVKELIKRWKDTSEELVRRVRELNERIDRETR

SEQ ID NO: 2268 - protein, 60 aa, Artificial Sequence
  Synthetic sequence.
SEVETVEEKVKKVIEDLRRLLKEVRDRNRRIIEEIKRLLERVAEKNKRIVDEIRDLLRRR

SEQ ID NO: 2269 - protein, 56 aa, Artificial Sequence
  Synthetic sequence.
EDIIRRIDELFREILKEVKRLNEESKRRLEKLEEDIKRLDDRSREEAEKLRDAVRR

SEQ ID NO: 2270 - protein, 60 aa, Artificial Sequence
  Synthetic sequence.
SEVEKVARDVEEVIRTSEDKTRKLEKRNKDIIREIKKLLDDLARENKRIADEIKRKLDER

SEQ ID NO: 2271 - protein, 56 aa, Artificial Sequence
  Synthetic sequence.
KRLIDEIRREMERSHRRDEEVNEKSKREADKLRRDVEKLDEDSARELKKLEDEVRT

SEQ ID NO: 2272 - protein, 60 aa, Artificial Sequence
  Synthetic sequence.
SEVERVERELDKVITDLRRLLDDLKRKNEELVRRIRELLKKVKERNKKIVTEIDDLLRRR

SEQ ID NO: 2273 - protein, 56 aa, Artificial Sequence
  Synthetic sequence.
ERIIRRIKELADRIEERVKELNERVREEVRKLEEDIKKLDDESREEARKLEDKVRQ

SEQ ID NO: 2274 - protein, 60 aa, Artificial Sequence
  Synthetic sequence.
SSEEIRREIERESEDTRRRLDRVLEDIERLSRETKEHIKESLERVRREHDRLRRELERKA

SEQ ID NO: 2275 - protein, 55 aa, Artificial Sequence
  Synthetic sequence.
EEVRREVRKLIEESRRAIDEVKRRVEELIKESRDRNRRIEERVKELVKENAERIR

SEQ ID NO: 2276 - protein, 60 aa, Artificial Sequence
  Synthetic sequence.
KSEEIRRKIEEDSRRTKKELDDILDEIRKLAEKVKKEIEELLRKVRRRHEDMKRRLREKV

SEQ ID NO: 2277 - protein, 55 aa, Artificial Sequence
  Synthetic sequence.
EEVAKEVKKLIEESRKLLEELKDTVRRLIKRLKELLEELERRVEELIKENEERIR

SEQ ID NO: 2278 - protein, 60 aa, Artificial Sequence
  Synthetic sequence.
RSEDILREIEDLSRETKEKIDEILERIRKLAEEVKRHIDESLKEVRRRHEEADRELDEKM

SEQ ID NO: 2279 - protein, 55 aa, Artificial Sequence
  Synthetic sequence.
EEVAKEVRDLIRRSEDLLRRILETVDKLIKELRKLNEDILERVRKLIKKNKDDIK

SEQ ID NO: 2280 - protein, 60 aa, Artificial Sequence
  Synthetic sequence.
KSEEIERRIRERSRETRRELEEVDKKVKKRHTELREHLKRSLKKVKEDHDDLKRKLEEKI

SEQ ID NO: 2281 - protein, 55 aa, Artificial Sequence
  Synthetic sequence.
EEVEEEVKRLIEESKELIKRLEEEVDKLIRDNKKLNDDILRRVKRLAEENDERIR

SEQ ID NO: 2282 - protein, 60 aa, Artificial Sequence
  Synthetic sequence.
SSEDILRDIERIARKLREDLKRVLKRVKELSDDTRREIERLVEEVERIHERLRRELERKV

SEQ ID NO: 2283 - protein, 55 aa, Artificial Sequence
  Synthetic sequence.
ERVADEVRKLIAELEKLIRDLKRRVDELIRRSRELLERIRDRVRKLIEENKRAID

SEQ ID NO: 2284 - protein, 59 aa, Artificial Sequence
  Synthetic sequence.
SKVEEAKREVDRVIKELREDIKRVEEEVDKLIKDHEKLNKELEDESRKLAERVEKLRRD

SEQ ID NO: 2285 - protein, 56 aa, Artificial Sequence
  Synthetic sequence.
EKIVRDIKELLRDLRREVEKVIERIDRLIKRLEEESRRLFEESEKAIRELKRRVDK

SEQ ID NO: 2286 - protein, 59 aa, Artificial Sequence
  Synthetic sequence.
KKVEEAKKEVKEMIRRHRERNKEVEKEVKDLARKHEKENRDVAETSKRLAEKVKKLRDD

SEQ ID NO: 2287 - protein, 56 aa, Artificial Sequence
  Synthetic sequence.
EEIVKDIKREIEELEDESRRILEEIREDIDRLRRRSEKLFEDSRELIERMKREVDR

SEQ ID NO: 2288 - protein, 60 aa, Artificial Sequence
  Synthetic sequence.
DEIEKVRKRAEDLNREDKRLSERAFEESKEVVEEHRRLSDRARRESDRVVEEVEKTLKDK

SEQ ID NO: 2289 - protein, 56 aa, Artificial Sequence
  Synthetic sequence.
RKILEEIRKAIDRNRDENRRLVEESKKELDELRKEDEELVERSKRKLEELDRRAKK

SEQ ID NO: 2290 - protein, 60 aa, Artificial Sequence
  Synthetic sequence.
SRIETVKDELRRIAEDVRRALEEIEERLKDLNRRDEELTKRIEDTSRDILRRVEEVLRRN

SEQ ID NO: 2291 - protein, 56 aa, Artificial Sequence
  Synthetic sequence.
EKILKEVADRLRELKRRAERLIEEVTRLLKENEKRNKEVVDTSREALREIRDRVRK

SEQ ID NO: 2292 - protein, 57 aa, Artificial Sequence
  Synthetic sequence.
SKEDILREIEKRIRKIEKEAEELLRESRKILEELEERDRRLLERVKREIDRLLEETG

SEQ ID NO: 2293 - protein, 59 aa, Artificial Sequence
  Synthetic sequence.
EELLRRVERELKKLIDEVRKVLKDNFDRNRELAKEWEDLSRELFKRAKELIEKVEEASR

SEQ ID NO: 2294 - protein, 57 aa, Artificial Sequence
  Synthetic sequence.
SKEDILREIKKRIEEIERDARRLLEESKRILDELRKTDEKLLRESEERVEELERKSG

SEQ ID NO: 2295 - protein, 59 aa, Artificial Sequence
  Synthetic sequence.
EELLKRVMEELRELIERVERELRRNARENRELARKWKKLSEENKKKNDDLIREVDEASR

SEQ ID NO: 2296 - protein, 60 aa, Artificial Sequence
  Synthetic sequence.
DEKERIEEEIRRILEELERKVDEAREEIKRMDEELKRRIEEIARRSRELDDELRERVDKD

SEQ ID NO: 2297 - protein, 55 aa, Artificial Sequence
  Synthetic sequence.
EEVRKEAERVLRKIEEDIDRVLRENEDSVRKLRTEIDRVEEENRRSAKRIRERLK

SEQ ID NO: 2298 - protein, 59 aa, Artificial Sequence
  Synthetic sequence.
DEVRDVVTRIRDLLRRIKERLEELTERIRRLLEKIHKTTEDLARRNRKLIDEIRKEIDK

SEQ ID NO: 2299 - protein, 55 aa, Artificial Sequence
  Synthetic sequence.
EDVKREVKELLDKIREDLERVREEAKRSNEENRKRLEEVVEESERLLEELKRRST

SEQ ID NO: 2300 - protein, 55 aa, Artificial Sequence
  Synthetic sequence.
DEVREVLKELKKVLREIEKAVRDVLEEDREMHERIARKVKKVLDENKKSLDDLRR

SEQ ID NO: 2301 - protein, 59 aa, Artificial Sequence
  Synthetic sequence.
EKKLKEIADKIRELLERLKDRLEKIAREIRDVNRKLDEDLEDIVRRIRDVDKKLDDKTK

SEQ ID NO: 2302 - protein, 63 aa, Artificial Sequence
  Synthetic sequence.
SVLEEIEREVEEIRRRIEKVLKELNDDDRRVIEDSKRLNEKLEKEVRDIERKARDLLRKLKDT

SEQ ID NO: 2303 - protein, 59 aa, Artificial Sequence
  Synthetic sequence.
REELEKLKRRLDEELDRVREKVEENIRRTDKAVEDSERENERLKRELDEKVKRIRDELR

SEQ ID NO: 2304 - protein, 55 aa, Artificial Sequence
  Synthetic sequence.
SDEEDVERLVKELIDRVRKTDAELERKVDEVIRELKEVIKRIEDHSRDSIRKLRN

SEQ ID NO: 2305 - protein, 55 aa, Artificial Sequence
  Synthetic sequence.
RELIKRLRDAVRESEKENKRINERLRRVIEKAKRDLEKILEEDRRVLEEMAERAK

SEQ ID NO: 2306 - protein, 56 aa, Artificial Sequence
  Synthetic sequence.
SEVETIKREIDKLMKELTEKIKRIKEEDDKVHEELKRAVDRSRERLEEVLKELRDR

SEQ ID NO: 2307 - protein, 59 aa, Artificial Sequence
  Synthetic sequence.
EKEIRDLMREIREVAERAKKRVDELLERIRRINTKLKEELKELHKRTEDLIKKAKEEVN

SEQ ID NO: 2308 - protein, 56 aa, Artificial Sequence
  Synthetic sequence.
KEVEEIDERLKRVLEELRRMLEESRKEDERVHDELRKEAEKIKRELDKAVEELRAR

SEQ ID NO: 2309 - protein, 59 aa, Artificial Sequence
  Synthetic sequence.
KKVIDDLLRKIEKLIREMKKRLKDLHEETKRINEELERRLRDLERRVRDLLRRAREEAN

SEQ ID NO: 2310 - protein, 56 aa, Artificial Sequence
  Synthetic sequence.
SEIERIKEEDEEVHKRLKEINDRINKEDKDVHDKLRDEARKIEERLRRVMEELRAN

SEQ ID NO: 2311 - protein, 59 aa, Artificial Sequence
  Synthetic sequence.
EKVIRKLLEEIRRINEELERRNRKLMKDIREINERAEEKLRRLAEEIEELIKKLKEEVK

SEQ ID NO: 2312 - protein, 56 aa, Artificial Sequence
  Synthetic sequence.
SEVEEIKREDDKVHEDLKKAADDIRKRDEDVNRKLTEAIEEIRREVDKALEDLERR

SEQ ID NO: 2313 - protein, 59 aa, Artificial Sequence
  Synthetic sequence.
EEVIRRLMEKIRRINAELRKALKRLLEEIEDINRKLEEEVKKILEEIRRVLEELRRRAN

SEQ ID NO: 2314 - protein, 61 aa, Artificial Sequence
  Synthetic sequence.
SEVEELVKELRRLIEEWDRRSKRLMEELKELAERIDKTTKELLKELEDLVEKIKRELDKKG

SEQ ID NO: 2315 - protein, 55 aa, Artificial Sequence
  Synthetic sequence.
ERVAEEVKRAIERAKRESDKIERDVRELNRRNREILKKIKKRVEDVLRKLRKDLE

SEQ ID NO: 2316 - protein, 59 aa, Artificial Sequence
  Synthetic sequence.
DEVEELKERLRRLAETIARRIRELVERLRDSARKIEKRVRELAKKLRDSVREITKVIKD

SEQ ID NO: 2317 - protein, 55 aa, Artificial Sequence
  Synthetic sequence.
EEIREEVEKAVRDLEELLKELKRESEETIRRIEKLVRDLERESEEAVRRLKEEKD

SEQ ID NO: 2318 - protein, 59 aa, Artificial Sequence
  Synthetic sequence.
SEEEKLKKELEDLARRIEKRLRELVEELERSVREIERRIEKLHKELEESVDRIKKVVDK

SEQ ID NO: 2319 - protein, 55 aa, Artificial Sequence
  Synthetic sequence.
DEIRRRVEEVVRRLEKIVKELEERSREVLKRLREEIEKHKKRSEETKERIRTRAT

SEQ ID NO: 2320 - protein, 59 aa, Artificial Sequence
  Synthetic sequence.
SEVEELLKRLEDLIRKIEERLKELVKRLKESAKEIEERLEELHRRLKESVDRIREEIEK

SEQ ID NO: 2321 - protein, 55 aa, Artificial Sequence
  Synthetic sequence.
EEIKKEVKKALERLKKIVEDAKKVSEETMERIRKLVEEHKDTSRKTVEDLERATK

SEQ ID NO: 2322 - protein, 59 aa, Artificial Sequence
  Synthetic sequence.
DEVERLMEELRRLLEEVRKRIEDLIRENRKLVKEIKDRLEKLLRDNERLAREIEEVIRS

SEQ ID NO: 2323 - protein, 55 aa, Artificial Sequence
  Synthetic sequence.
ERIREEVKRAIEKLKELVEDSNREVTEALKEIEDLLRKLKERSEELLRRIKARTD

SEQ ID NO: 2324 - protein, 60 aa, Artificial Sequence
  Synthetic sequence.
KEVDELDEELKKHAERIDRELERLDRENEKHVEDVRRELERLREENERHARRIEDEVKKR

SEQ ID NO: 2325 - protein, 59 aa, Artificial Sequence
  Synthetic sequence.
RKTLEDIRRKVEKSLRELEKKLEEIDKKNRDTLEEARRELERIRRENEEVIRRLDKRRR

SEQ ID NO: 2326 - protein, 60 aa, Artificial Sequence
  Synthetic sequence.
KEVEELVRKLREHVRDIKRKLEELLKENEDHARRAEDRLRELTKENRDHVKEMEDVLRRD

SEQ ID NO: 2327 - protein, 59 aa, Artificial Sequence
  Synthetic sequence.
KDTLERLEREVRKSIKELEDKLREIRKRNKEVIDKLRDILEKIKKENREALKRLRDTEE

SEQ ID NO: 2328 - protein, 60 aa, Artificial Sequence
  Synthetic sequence.
SEVEKLTEELRRHVEEIERDLDRLRKENERHAKKIKDELKRLLEELEEVARRIEAELERD

SEQ ID NO: 2329 - protein, 59 aa, Artificial Sequence
  Synthetic sequence.
KDMLRRIEEEVERSIRRLEELLERIRERNEKVIEDLKELLKRIRDRAEEVKDRLRRTRK

SEQ ID NO: 2330 - protein, 60 aa, Artificial Sequence
  Synthetic sequence.
SEVEKLKKELEDHVRDIEKKLRDLMRENEEHAKRARERLKKLLEDNEENVKDIEDKVRKK

SEQ ID NO: 2331 - protein, 59 aa, Artificial Sequence
  Synthetic sequence.
EDTLRKIREDAKRSEKKLEEILRTIRKRNEKVIRDLRRLLEELRKRNREAIERLRKELE

SEQ ID NO: 2332 - protein, 60 aa, Artificial Sequence
  Synthetic sequence.
SEVERLAEELRKHVEEIKKELRKLKEKLEKLARDIERELKRLRDENKKHADDIRDKVEKR

SEQ ID NO: 2333 - protein, 59 aa, Artificial Sequence
  Synthetic sequence.
KDTLRRIEEEVKKSERELREELKRLEERVRRVIEKLEDLLRRIEKENEEVKRDLERRRK

SEQ ID NO: 2334 - protein, 60 aa, Artificial Sequence
  Synthetic sequence.
SEVDELKRRLDEHAKDIRDKLRKLVKELREHAKRAEDELRRLLKENEDNAREIRELVKTL

SEQ ID NO: 2335 - protein, 59 aa, Artificial Sequence
  Synthetic sequence.
EKTLRDIKRAVEKSIRDLERILEELRKEVEDTIKRLEDILREIRKRNKDVIDDLRRRMK

SEQ ID NO: 2336 - protein, 60 aa, Artificial Sequence
  Synthetic sequence.
SEVDRLVRELDKHVEDIERTLKKLREENEKNVEEIKRTLKKLVDELRKLAREIIDTVDKN

SEQ ID NO: 2337 - protein, 59 aa, Artificial Sequence
  Synthetic sequence.
EKTLRDIKRRVDKSLEDLKRTLEEIKRENERTLEEIKKILEDMEREVRDIERKLREKEK

SEQ ID NO: 2338 - protein, 60 aa, Artificial Sequence
  Synthetic sequence.
KEVEDLVRELEKLIEEIKRRLEELDKELKKHVEDAERRIKKLLDENRENAERILEKLRRD

SEQ ID NO: 2339 - protein, 59 aa, Artificial Sequence
  Synthetic sequence.
EELLRRAKERVREALEDLRRILEEIRRKVEETIRRLEKLLKELRDRNRRVLEELERTLK

SEQ ID NO: 2340 - protein, 60 aa, Artificial Sequence
  Synthetic sequence.
REKEEIKREVEEAKKRLEDLLREIAEEVKRALERLRELNERNNDRARRVLKRLTDELRRV

SEQ ID NO: 2341 - protein, 55 aa, Artificial Sequence
  Synthetic sequence.
DRLSERLRRLVREIEETLKELLKALRRLLERIREVSEELHRRSEELVERILRKLK

SEQ ID NO: 2342 - protein, 60 aa, Artificial Sequence
  Synthetic sequence.
REKEDIEEKVKRVLERLERLNRENNKESERLLRRLEELNKRNNEAVKELLDRLREILKRV

SEQ ID NO: 2343 - protein, 55 aa, Artificial Sequence
  Synthetic sequence.
DRLMEELKRLAREAERVSEELHDRTRRLAEEIEKVSKELHKKSEKLAREIKKRLD

SEQ ID NO: 2344 - protein, 60 aa, Artificial Sequence
  Synthetic sequence.
KEAEELIKELKDLAERIRRENRRLLEELKKLVEEIRRRIRELIERSEDSVRKIEETVKRK

SEQ ID NO: 2345 - protein, 55 aa, Artificial Sequence
  Synthetic sequence.
EKAERELKKISEDDERSIKELEDLLRKVEEDIRRLLDELRDIMKKTKEKVDELRR

SEQ ID NO: 2346 - protein, 60 aa, Artificial Sequence
  Synthetic sequence.
DEAERVKRELERLVKEIKEENRRLLRELRELSKRSREVLERLLRKLEDLVRKIREVLERL

SEQ ID NO: 2347 - protein, 59 aa, Artificial Sequence
  Synthetic sequence.
KKVLDEIEKEAEEIKRENKDFNRRIEREVRESKREIEEVVKRIREIAERVDRDIDRTRR

SEQ ID NO: 2348 - protein, 60 aa, Artificial Sequence
  Synthetic sequence.
DEEREVKERLRDLTRRIRETIKRLLDKNKDLARRIREVNKETSEELERLARDIERVLEEL

SEQ ID NO: 2349 - protein, 59 aa, Artificial Sequence
  Synthetic sequence.
KKVLDEIREAAERVKREIEELLKEVHRINTELNKDNTELNKRNREIVERVKRRIDERAR

SEQ ID NO: 2350 - protein, 60 aa, Artificial Sequence
  Synthetic sequence.
DEVEEVKKALEDLAEKIRDLNRKILEKNKKLADDIRRLNEKLLRELRKLVEEIERVLRKL

SEQ ID NO: 2351 - protein, 59 aa, Artificial Sequence
  Synthetic sequence.
KELLDEIRRRVEEVKKDNERVNKEIEELNRKLDEDNERANREIRDTVEKVRRRIDEEEK

SEQ ID NO: 2352 - protein, 61 aa, Artificial Sequence
  Synthetic sequence.
SEIEEIEKEIRRVLEEIERLLRTLKKINDDVKRESEKLVRDDKKKIDDALRELRKLAAERG

SEQ ID NO: 2353 - protein, 59 aa, Artificial Sequence
  Synthetic sequence.
DEVVRRAEKLLKEIRDTVETALKELEDKNERSERENKRVAEESERKLRKIKEEVDKAAE

SEQ ID NO: 2354 - protein, 60 aa, Artificial Sequence
  Synthetic sequence.
RKVEEIKKRLKELKERLEESVKRIKDRLRKLEEDNRRLAEEVKKRLEELLKRLEDLVKRR

SEQ ID NO: 2355 - protein, 59 aa, Artificial Sequence
  Synthetic sequence.
EKAVKELEDELRRIEKTSRDVLKELEDILRRLREESKRVADELRELLRRVKEKVERETK

SEQ ID NO: 2356 - protein, 60 aa, Artificial Sequence
  Synthetic sequence.
SEDDRIRERLKELVDRNDELVKRIKRALDELLRELRKSVEDIKRTLDDLARKLEELARRR

SEQ ID NO: 2357 - protein, 59 aa, Artificial Sequence
  Synthetic sequence.
REVVEDLKRILRELEKRSEDVLRELKKKLDDVEKESRDVLRELTEKLKKIEEDVRRAEK

SEQ ID NO: 2358 - protein, 60 aa, Artificial Sequence
  Synthetic sequence.
REVEEIERRIRELLETNREIAERTTEEIKRLKKELEDSLEEIKKRLKELVDELRKLATDR

SEQ ID NO: 2359 - protein, 59 aa, Artificial Sequence
  Synthetic sequence.
EEAVRRLEELVREIEDRSERLNKENEDELKKIEETSRKALKELEDRLREVKKEVREAER

SEQ ID NO: 2360 - protein, 57 aa, Artificial Sequence
  Synthetic sequence.
DSDRELEKKIRDSLKRLEEALRELEERLKRSLEDDERVHEELRRRAERIRETIKKRL

SEQ ID NO: 2361 - protein, 59 aa, Artificial Sequence
  Synthetic sequence.
SELVKRMKERVDELHKRTEELLERLKEELKKLHDETRDINRELKKRLEDLERKIEEAAK

SEQ ID NO: 2362 - protein, 57 aa, Artificial Sequence
  Synthetic sequence.
KEAEELRRLIEESKRTDKKVHEDLKEEVRKIEEEDDKAHEELRKEVERIKKKIDDDM

SEQ ID NO: 2363 - protein, 59 aa, Artificial Sequence
  Synthetic sequence.
SELIKRLKDEVKKLHDETERINRELKKELDDLLRRVRKINKELKEELKKLERKIEEAAR

SEQ ID NO: 2364 - protein, 57 aa, Artificial Sequence
  Synthetic sequence.
SSREELEKRIRESEKRDREMHERLRRTAEKIEKEDKEMHDRLREKAERIEERIDKEV

SEQ ID NO: 2365 - protein, 59 aa, Artificial Sequence
  Synthetic sequence.
SELIERIAERIERLNRDTERINRELEEKLRRLLKRIREINTELDKRLKELLDRIEEASR

SEQ ID NO: 2366 - protein, 57 aa, Artificial Sequence
  Synthetic sequence.
SSEEKIEKASEDNERKVKEVLREIEELSKKDKTDVERVLRELEKRLEEIKREVDRRD

SEQ ID NO: 2367 - protein, 56 aa, Artificial Sequence
  Synthetic sequence.
EEDLKRELDEIDKRTEELARELRELMREIHERTKRLADDLRRAIDEIRKKIEEDAR

SEQ ID NO: 2368 - protein, 59 aa, Artificial Sequence
  Synthetic sequence.
DELEDLLRRHRELVKRSLERLKDLLERNRELIEDSERRAEELLRELRRLIEEIKKVLDE

SEQ ID NO: 2369 - protein, 59 aa, Artificial Sequence
  Synthetic sequence.
KKVLEELKRSNDEANERHKTVLRRLEEENKRANDSHRKIKEELKDLLRRVDETVKEKRR

SEQ ID NO: 2370 - protein, 59 aa, Artificial Sequence
  Synthetic sequence.
SRLEELLKTHKKLVEDSVDEVRRLLERNRKLIEDSKERLKELLRTNEELIRTLKEVLDR

SEQ ID NO: 2371 - protein, 59 aa, Artificial Sequence
  Synthetic sequence.
EEVLRRLKESNKKANEDHRRLNEENKDLNRRANEEHKKVNDRNKELLDRARRTADEKRR

SEQ ID NO: 2372 - protein, 59 aa, Artificial Sequence
  Synthetic sequence.
DEVDELVKTHERLVEESERRIEELLERNRRLIERITERAKELLKENKRLIEEITEVLKR

SEQ ID NO: 2373 - protein, 59 aa, Artificial Sequence
  Synthetic sequence.
KDVLERLKDSNRKANERHKRMNEENKRLLEDVERRIKELNKRNEDLLREAEKRVRDERR

SEQ ID NO: 2374 - protein, 60 aa, Artificial Sequence
  Synthetic sequence.
SELEELLKTHKKLVEDSVERVRDLLRENKRLIEESEKEIRKLLDELRELIERIIELVERG

SEQ ID NO: 2375 - protein, 59 aa, Artificial Sequence
  Synthetic sequence.
KEVLERLKKSNKEANDEHRRLNDENRELNERANRKHKEVEDRLKDLLRRAEEKLTEDAK

SEQ ID NO: 2376 - protein, 60 aa, Artificial Sequence
  Synthetic sequence.
DEVERLITKHRKLVEDSRRRVEELLRRNAELIKTSKRRVEELLERNRRLAEELRRLLKEG

SEQ ID NO: 2377 - protein, 59 aa, Artificial Sequence
  Synthetic sequence.
DEVLRRVEDSNRRANETHKDLNRKNKELNEEANRTHEELLRRNEKLLREIEDTVDRETK

SEQ ID NO: 2378 - protein, 60 aa, Artificial Sequence
  Synthetic sequence.
SEVEKLLKELEDESRKSEDDNRRLLEELRRLSEESLRDLRRLLEDLKRLAEEIEREVRKR

SEQ ID NO: 2379 - protein, 59 aa, Artificial Sequence
  Synthetic sequence.
DELKKRVDEVLETSRELLRESKRKIEEIARRSEEELKRVKDEVDDTARRIKRKIEEAEK

SEQ ID NO: 2380 - protein, 57 aa, Artificial Sequence
  Synthetic sequence.
DSERRLDEILERAREVNEESSRRLDKLLRETEEKNRKSTEELRKIVEDLKRTVKDES

SEQ ID NO: 2381 - protein, 56 aa, Artificial Sequence
  Synthetic sequence.
AETVIRRIEKLLEDLKRVDDKILEEHKDLSKKLDDVDREIKERIKKLIKDLKDTAR

SEQ ID NO: 2382 - protein, 57 aa, Artificial Sequence
  Synthetic sequence.
DSEEELKDILRKAKEDNDRSSDKLRRLLEETEKRNRDSTKRLEELLEETEREVRRRS

SEQ ID NO: 2383 - protein, 56 aa, Artificial Sequence
  Synthetic sequence.
AETVKERIKKLLKDLREVDREILERHKKMSDDLKRVDEEISKTHKELSRRLKETAR

SEQ ID NO: 2384 - protein, 57 aa, Artificial Sequence
  Synthetic sequence.
SKEEDLKRILEEAEKTNKESSDRLRELMDRTRRENEESSRTLKEIVKDADRRVAEII

SEQ ID NO: 2385 - protein, 56 aa, Artificial Sequence
  Synthetic sequence.
VERVKEDIERLLDELRKVDREILETHKKLSEELRRVDEEIIKRVKDLIRTLEKAAE

SEQ ID NO: 2386 - protein, 57 aa, Artificial Sequence
  Synthetic sequence.
SSEERLRTILREIEKTNRDSSKRLRDLLRETKRENKESSDELRKLLEETRDEVEKRR

SEQ ID NO: 2387 - protein, 56 aa, Artificial Sequence
  Synthetic sequence.
SDTVAERIRRLLEELKRVDEEILKTHKDLSDRLRELDEEIKKTHEKLSEELRRAAN

SEQ ID NO: 2388 - protein, 60 aa, Artificial Sequence
  Synthetic sequence.
KEVEEILETHKEIARELREVAEEIIRDHERILRDLEKKIRELRRTHERMVEELDRVAKEG

SEQ ID NO: 2389 - protein, 59 aa, Artificial Sequence
  Synthetic sequence.
KDALDKLRDSDRRVHEDVRRMLKRLDDSDKRVHDRVRKVLEDLKRSNDELRRTVEERER

SEQ ID NO: 2390 - protein, 60 aa, Artificial Sequence
  Synthetic sequence.
SEVEKILEDHKRIVDELEKEAKKIEETHTELVKRLREEVEKLKEELRRLLEELKDMARRG

SEQ ID NO: 2391 - protein, 59 aa, Artificial Sequence
  Synthetic sequence.
EEALRRLKKSDEEVHRRVREILKRLEKSNRDLNDDSRKVEEELKRILRRIEEEAKRTED

SEQ ID NO: 2392 - protein, 61 aa, Artificial Sequence
  Synthetic sequence.
SEAERLLDELRRLLEEIKRRIEELLEESKRSLEEVEKRSKELLDRLEDLLRKIKEEIRKDG

SEQ ID NO: 2393 - protein, 59 aa, Artificial Sequence
  Synthetic sequence.
EEVKERLERLRERIKREIDRVIRELRELDKRAKEVSKRTKEELEKILEKVRRVIEEVKR

SEQ ID NO: 2394 - protein, 61 aa, Artificial Sequence
  Synthetic sequence.
DDVDRLLDELRELIDRIRKDLERLLKESRDSLEELRRRSEELLKKLEEEIREVVERIRREG

SEQ ID NO: 2395 - protein, 59 aa, Artificial Sequence
  Synthetic sequence.
DELKRRAEKLLEDLRRVIEEIKRRLDKVNDEVREVSKETTDRLDDLVRKARELIRRVEK

SEQ ID NO: 2396 - protein, 61 aa, Artificial Sequence
  Synthetic sequence.
SEREKLLTDLRDLLKKVVDTLRRLNEELKKSIEESKETLERLNRTLKKLLDEVKKKLEDDG

SEQ ID NO: 2397 - protein, 55 aa, Artificial Sequence
  Synthetic sequence.
DELRKIVEEIRTELDRVRETNERILKEVRDEHRRVDKTNTDIERDIERVIKEVET

SEQ ID NO: 2398 - protein, 61 aa, Artificial Sequence
  Synthetic sequence.
KKDEDLKKLLKDNEDVMKKAADEVKRLNDENRDLMRRVAEKIEDLLRRLEKLLRDILRRRG

SEQ ID NO: 2399 - protein, 56 aa, Artificial Sequence
  Synthetic sequence.
SKTVKDRIKRLTDELERVNRELSEEHKRVLDELRKRNKEILDRLKELLKRLKEEAD

SEQ ID NO: 2400 - protein, 60 aa, Artificial Sequence
  Synthetic sequence.
SSEEELERLLEELRRITEEAKERMERSSKELEDVSREAEKRLEKSSRDLDKTVRDIKRRI

SEQ ID NO: 2401 - protein, 56 aa, Artificial Sequence
  Synthetic sequence.
AEDVKRRVRELIEEHKRLNKELLDESRELLKTHAELVKRILDESRRLLEELEKAAR

SEQ ID NO: 2402 - protein, 60 aa, Artificial Sequence
  Synthetic sequence.
SEREDATRRLRDIIRRLRDLIRRLTEESEESIKEIRERIERIIRTSEESLKELEERIRRN

SEQ ID NO: 2403 - protein, 55 aa, Artificial Sequence
  Synthetic sequence.
EDLERLREEIEDVVRKAEKRLDELHDEIRRTIEDAERRLDESNERAEKVVRDAEK

SEQ ID NO: 2404 - protein, 60 aa, Artificial Sequence
  Synthetic sequence.
SDEERALEKIRRLIEDLRRMVREMLERSKKSLEEHKELAREILRRSRESLERLKDVARRN

SEQ ID NO: 2405 - protein, 55 aa, Artificial Sequence
  Synthetic sequence.
RELDKLREELEEVVRRVEEKLDDSDRRANEVTREIEKTLDDLHREAEEVVKEIRR

SEQ ID NO: 2406 - protein, 60 aa, Artificial Sequence
  Synthetic sequence.
SVEETLRRLLEESERVNRRVKEDLDRIRRESEEVNKRAEEMAKELLDEIRKDIDRVRKRN

SEQ ID NO: 2407 - protein, 59 aa, Artificial Sequence
  Synthetic sequence.
EELAKEVIKTLRKLIEESKRNHEDLRRELRELIEESKRDHERLLRRLRELIKRIRDTTK

SEQ ID NO: 2408 - protein, 61 aa, Artificial Sequence
  Synthetic sequence.
DEIEDLLRRAEKLIRDLKRKNDKLLKESEELLERLRERAKEVLDESKKLLEELRELVRRRG

SEQ ID NO: 2409 - protein, 59 aa, Artificial Sequence
  Synthetic sequence.
ERAARDVERLKRRNKKVVEDSEDLARKTNKKSEELLREIRKRVEDSNRETKEILDRVRK

SEQ ID NO: 2410 - protein, 60 aa, Artificial Sequence
  Synthetic sequence.
DEDEELLKRLRDLIREVRDRVRRLLEEDKDSLRRIRERVEELLRRSEESLKDLEKKIREG

SEQ ID NO: 2411 - protein, 55 aa, Artificial Sequence
  Synthetic sequence.
EELKKIADKVEEVLREVEKELDKSRRTSDEILKKVEKAVRDLDRRVKEVIDRARR

SEQ ID NO: 2412 - protein, 60 aa, Artificial Sequence
  Synthetic sequence.
SEAEELLKRLERLLRESKKDLERLRKELKDLLEESRKDVTRLLDEIRRLLEEIKRRLDKR

SEQ ID NO: 2413 - protein, 59 aa, Artificial Sequence
  Synthetic sequence.
EEVKRMIEKLKKESEEVIRKAKEDLDRVTKESRRVIEEVERRLDELRERLREVVERVKT

SEQ ID NO: 2414 - protein, 60 aa, Artificial Sequence
  Synthetic sequence.
DEAEKLLKELRDLLEESRKDLERLLKELEDLLEESKRDLERLLEEITELLKRIKETVERR

SEQ ID NO: 2415 - protein, 59 aa, Artificial Sequence
  Synthetic sequence.
EEVKRKIDRLEEESRRVIEEARKRLEEVEEKSKKIIDDARRALDRIDKELRRVVEETRK

SEQ ID NO: 2416 - protein, 60 aa, Artificial Sequence
  Synthetic sequence.
SVEETARRLLDENRKLLEEAERIHTEINERNKELLKRADDLHRRVLEDLRKLLDKVAKEI

SEQ ID NO: 2417 - protein, 56 aa, Artificial Sequence
  Synthetic sequence.
ADTVVKRIKKVIDELEELNRKSKKELKEVIEDLERRNRDSIRRAEDLLRRLEEEVR

SEQ ID NO: 2418 - protein, 60 aa, Artificial Sequence
  Synthetic sequence.
KDEETVEKLLRELEELLKEAEERAKDLNRRNKELLDEADRRHEELLRRLEDLLRDVRRRI

SEQ ID NO: 2419 - protein, 56 aa, Artificial Sequence
  Synthetic sequence.
SDTVSERIRKVIREIERLIKEIVKEIEKLIRDLEKRNRESLKEIKDLLKKLKDEVD

SEQ ID NO: 2420 - protein, 60 aa, Artificial Sequence
  Synthetic sequence.
SRKEKLLTELKEILKRLKEEVEKIVKESEKSIEEHHRRSERLKRESKKSLDDLAKILERS

SEQ ID NO: 2421 - protein, 55 aa, Artificial Sequence
  Synthetic sequence.
EELEKIRREVEELLRRAEEELRRLNREIEENHKRVKRELEKIDKEMKDLLREAKR

SEQ ID NO: 2422 - protein, 60 aa, Artificial Sequence
  Synthetic sequence.
DRKERLKERLERLLKEHHDRSRELLRTSEESIRRHHEESRRLLRRSKESLDRLRDELRRL

SEQ ID NO: 2423 - protein, 55 aa, Artificial Sequence
  Synthetic sequence.
EELRKLERRARENHKRVREALERLNRRIEENHKRVRRRLEDLDRAAEELLREAKR

SEQ ID NO: 2424 - protein, 59 aa, Artificial Sequence
  Synthetic sequence.
SRKEDLKRRLEEIIKRLEEVVRRILRTSEESLKDHHEASKRLLEESEKSLKRLEEELKR

SEQ ID NO: 2425 - protein, 55 aa, Artificial Sequence
  Synthetic sequence.
EELRKIEERIRELAKRAREELDKLDKEVRKNHERVKRRLEELDRRAKELVREERR

SEQ ID NO: 2426 - protein, 60 aa, Artificial Sequence
  Synthetic sequence.
SEKEKLLKEIERLIEELRRVVKKAVEDSKESIDRHHERSRELLRRSRESLKDLERRLKDS

SEQ ID NO: 2427 - protein, 55 aa, Artificial Sequence
  Synthetic sequence.
RELEELEKRVRELERRIRETLTRLNEEIEKNHRRVEERLRDLNREAEKLAEEAKR

SEQ ID NO: 2428 - protein, 60 aa, Artificial Sequence
  Synthetic sequence.
SEKEDLSRRLAELLKEHHDRSKKLLDESRDSLRKHHKASRDMLRRSDESLKRLDRVRKER

SEQ ID NO: 2429 - protein, 55 aa, Artificial Sequence
  Synthetic sequence.
EELDRIRKEVKKNHDRARRALEKIDKEAKENHERVREALRKLNEDLEKLEREKRK

SEQ ID NO: 2430 - protein, 60 aa, Artificial Sequence
  Synthetic sequence.
REKEELIKRLKRLIDELRRVVKTLLADLERLLKEHHDRSRRILEESKRSLEELEKTLRRS

SEQ ID NO: 2431 - protein, 55 aa, Artificial Sequence
  Synthetic sequence.
DELRKLKEELEDLARKARKEIEDIKEKLRRNHERVKKALEDLNRTAEELLDRARQ

SEQ ID NO: 2432 - protein, 59 aa, Artificial Sequence
  Synthetic sequence.
SREEKLLKELKDIIDTLRRRVEEILTESEKSLRDHHRESRKIVEELRKLLEDLRRLLER

SEQ ID NO: 2433 - protein, 55 aa, Artificial Sequence
  Synthetic sequence.
RELDKIEEEARELVKRAEEKLREIDKRARDNHKRVRDELKRILDELKKLIDERRK

SEQ ID NO: 2434 - protein, 61 aa, Artificial Sequence
  Synthetic sequence.
SVEDSIDKIDKELEKNSERTKRTIDRIREESRRLIEEIKDRVRRLLREAERTIEDVKRKLK

SEQ ID NO: 2435 - protein, 59 aa, Artificial Sequence
  Synthetic sequence.
RRVVEELRERLKRLLEKHHDLMRRLTEDLKRLLEESERDARRLVKELEDALREIREDTR

SEQ ID NO: 2436 - protein, 59 aa, Artificial Sequence
  Synthetic sequence.
SREDKVRELEERLKRLNERLNREVKKVNEDNRRLLKRAEDTARRLAERIRRLLERVDRE

SEQ ID NO: 2437 - protein, 56 aa, Artificial Sequence
  Synthetic sequence.
DEELERRVEELLKRNEKLIREVKKRLEELLRRNEELIRRILEEVEKLLKDLEDKVR

SEQ ID NO: 2438 - protein, 60 aa, Artificial Sequence
  Synthetic sequence.
RREERVKEALERIRRLNKRINERVEEVNRENKRLLDEAKRTHEELEKEADRLLDDVRRKI

SEQ ID NO: 2439 - protein, 56 aa, Artificial Sequence
  Synthetic sequence.
EEELEKEIRKVLETNRKLAEDVRRDLERLLRRNRRLIEESKKEVEKLLKELEEDVR

SEQ ID NO: 2440 - protein, 60 aa, Artificial Sequence
  Synthetic sequence.
RRDDKVRKLEKELRDSNRKANDESKKLRDELRRLNEEANRRVRELERRIERLLEKVKDDI

SEQ ID NO: 2441 - protein, 56 aa, Artificial Sequence
  Synthetic sequence.
EEELKKRVEEALEEHRRLVEEVRRRVERILERNDELIKRIEETVEDLLRRLEEEVR

SEQ ID NO: 2442 - protein, 61 aa, Artificial Sequence
  Synthetic sequence.
SEIDEIVKEVERLLEKLKEDSRRTVEEVKKLLDELRKHSEDSVREIEELIERLRREIERDG

SEQ ID NO: 2443 - protein, 56 aa, Artificial Sequence
  Synthetic sequence.
EEKLRRLEEELREILKRSEDLARKLDEDLKRILERTRREIKRLEEDLDRLDEEVRR

SEQ ID NO: 2444 - protein, 61 aa, Artificial Sequence
  Synthetic sequence.
SESDEIIKEVDELIKRLRKHSKETVKEIEEILTRLEERSRKSVKEIEDEIRKLEDIVRKRG

SEQ ID NO: 2445 - protein, 56 aa, Artificial Sequence
  Synthetic sequence.
EEKARTLERKLDKILEETKREAEELKKRLDELVEKTRRLIEELKRRLKELLDRAET

SEQ ID NO: 2446 - protein, 61 aa, Artificial Sequence
  Synthetic sequence.
DESRKIVRDVEELIKRLEEHSRETVKRADRVLREDHKKSRDSVREIEKLIRDVKDKIDKRG

SEQ ID NO: 2447 - protein, 56 aa, Artificial Sequence
  Synthetic sequence.
EEEVRRLKKELDDLLEETKDLIRRLEEKLDKNVKETEDEIRRLIEELKKILEDATR

SEQ ID NO: 2448 - protein, 61 aa, Artificial Sequence
  Synthetic sequence.
REIDEIVKEIEKILRELKKRSDETVREIERLIEEDHRKSRKSVRDIEKLIDDLRKDVERRG

SEQ ID NO: 2449 - protein, 56 aa, Artificial Sequence
  Synthetic sequence.
EEKLRKLEEELRRLLEESKREADRLKKELRDNLKTTDELIKELKERLDKLKEDIER

SEQ ID NO: 2450 - protein, 61 aa, Artificial Sequence
  Synthetic sequence.
DESDRIVEEVRRLIKTDHDNSRRSVRKIEELIARDHKKVKEIVDEIRRLIRELEELIRRDG

SEQ ID NO: 2451 - protein, 56 aa, Artificial Sequence
  Synthetic sequence.
KEKLDRLEEEIDKNVKRTREEIERLKRELDKNLEDVRRLAKELEDELRKLDEDAKR

SEQ ID NO: 2452 - protein, 61 aa, Artificial Sequence
  Synthetic sequence.
SEIDRIIEDAERLLRELERNSDRSVEEIEKLIRDDHDNSRRTLEKIEKVIRELRKDVKDRG

SEQ ID NO: 2453 - protein, 56 aa, Artificial Sequence
  Synthetic sequence.
REKVKRLEEELRKILKKTREKAEELKRRIDRNVEETRRRARELKEELDRLLKEART

SEQ ID NO: 2454 - protein, 59 aa, Artificial Sequence
  Synthetic sequence.
DESRKVIKEIEDLLEEWKRRSERMIRESEKLIEELRERVDKILEDIDRLIRTLDELRKA

SEQ ID NO: 2455 - protein, 56 aa, Artificial Sequence
  Synthetic sequence.
EEEAKRLKDELEEILKESEDLSRRTKKELEDLLREVEKEIKKLEDKLKKLLDETDK

SEQ ID NO: 2456 - protein, 59 aa, Artificial Sequence
  Synthetic sequence.
SETEKVIREIEKLIDDIRKESERSIEESRKLLKELEEIVEKAIRDSRRLLEDLRRLVED

SEQ ID NO: 2457 - protein, 56 aa, Artificial Sequence
  Synthetic sequence.
EEKADTLRRKLEKLLEDTKRMSEKTKKEIEDLLKRVRELSEETKRRLDRILEDVER

SEQ ID NO: 2458 - protein, 59 aa, Artificial Sequence
  Synthetic sequence.
SESDKVVKEIEELLRELRKRVEEIIRESEALIETLKKRVDDAVRESRKLIKDLRELIER

SEQ ID NO: 2459 - protein, 56 aa, Artificial Sequence
  Synthetic sequence.
REKAKKLREELRKLMEEVRRLSKETKDKLDELLKTVEELSKELRERLKRLLDEAET

SEQ ID NO: 2460 - protein, 59 aa, Artificial Sequence
  Synthetic sequence.
SESDEVAKRIKELIDRLEERSRRSIRESDRLIKELEKEIEKAVRESEKLIRDLEELIRR

SEQ ID NO: 2461 - protein, 56 aa, Artificial Sequence
  Synthetic sequence.
EEKMRTLEEDLKRLLEETRDMSRKTKEKLEELLKRVRDLSKKLAEDLRRLLEEVRR

SEQ ID NO: 2462 - protein, 59 aa, Artificial Sequence
  Synthetic sequence.
SETDEVIKTLEELLERIKRRVEELVKRNKDLIKALEEEVRRIIKESKKLIDDLAELAKE

SEQ ID NO: 2463 - protein, 56 aa, Artificial Sequence
  Synthetic sequence.
KDKADRIREEIRKLEEEVKRLHDELKKELDDLLRRVEEDSKRTKERLRKLLTDVKK

SEQ ID NO: 2464 - protein, 60 aa, Artificial Sequence
  Synthetic sequence.
SEVDDLIRRLEKLLEDIKRRVEELVRRDEKITKDWERESERLIRELEELLKTIADLVRRR

SEQ ID NO: 2465 - protein, 56 aa, Artificial Sequence
  Synthetic sequence.
KKKLDEIRKRLEEILKRVRELLERLDRENEDLARKSKELADRIRKELKRILDEVRR

SEQ ID NO: 2466 - protein, 60 aa, Artificial Sequence
  Synthetic sequence.
DEVDELVKELEESLRRSREEIERLVREDEELTKTIREEVKKLVKTDEDLSKKIEDTVRRR

SEQ ID NO: 2467 - protein, 56 aa, Artificial Sequence
  Synthetic sequence.
KDKIKELKERNDKLLEEARRLAKELKERNDTLLKEVREELRRLRERNDRILKEAKK

SEQ ID NO: 2468 - protein, 60 aa, Artificial Sequence
  Synthetic sequence.
DEVDKLIRDLEELIRRIRKRLKELVDRDRELTREIRRRIRELIEESKEALERIDKRVKER

SEQ ID NO: 2469 - protein, 56 aa, Artificial Sequence
  Synthetic sequence.
KDKIKKLKDDLDRLLKEAEDRLRELEERNKRLLDEARKEIEKSDRRLEEILERVRR

SEQ ID NO: 2470 - protein, 60 aa, Artificial Sequence
  Synthetic sequence.
DEVDELIKTLKKLLEDIRERVERLVTDSKRSLDEIRETVRDLVRRDKELLKRIEDTVRER

SEQ ID NO: 2471 - protein, 56 aa, Artificial Sequence
  Synthetic sequence.
KDKLEKIKRDLEKILTEVREALRELDERLKKLAEEAKRLLEELRKRNRDILEKVRK

SEQ ID NO: 2472 - protein, 60 aa, Artificial Sequence
  Synthetic sequence.
DEVDKLIKEIEESLRRSEKEVRDLVRESERSLKEIEKRVRELVKRDEDLLKEIEEVVRKK

SEQ ID NO: 2473 - protein, 56 aa, Artificial Sequence
  Synthetic sequence.
EEKLKRLRKENKDLRDRVEEELRRLDKELDELLETVRRLLDELRKRNKKLLDEARK

SEQ ID NO: 2474 - protein, 60 aa, Artificial Sequence
  Synthetic sequence.
RLEEEIERLRREVEELIERSKDLIRRSHTKSRKLIEDVKRELDRLRREVEELIKRAEDRT

SEQ ID NO: 2475 - protein, 55 aa, Artificial Sequence
  Synthetic sequence.
DRVVREAEKLIRKIAEDNRKALEESDELIRRSEKDVRDMVRRAEELIEEIKRRVD

SEQ ID NO: 2476 - protein, 59 aa, Artificial Sequence
  Synthetic sequence.
SKDEEVERLKEELDRLLEEVRRLSEESKKRNDELLKRAEEIIEELKKELDEIREEVERR

SEQ ID NO: 2477 - protein, 56 aa, Artificial Sequence
  Synthetic sequence.
KDTVVRRAKKVIDELRKDVERVKRESDEVLKELEKLNREIEREVRKLLKELRDTVR

SEQ ID NO: 2478 - protein, 59 aa, Artificial Sequence
  Synthetic sequence.
RSEEEARKLERENKKLVDDARKLSEESRRRNDKLVEEARRIAEELKRELDRLLEEVDRR

SEQ ID NO: 2479 - protein, 56 aa, Artificial Sequence
  Synthetic sequence.
TKTVVDRVKKLLDDLREVNREILRESDKVLRDLKRLNDEIKREVEELLERLEREVR

SEQ ID NO: 2480 - protein, 59 aa, Artificial Sequence
  Synthetic sequence.
SAEEDAERMKDRNRRLLEKVRRLSEESKRRNDKLVEDAKKLSEDTRRKLEDIARKVRKR

SEQ ID NO: 2481 - protein, 56 aa, Artificial Sequence
  Synthetic sequence.
KDRVSEEIDRLLRDLERRNREILKESKEVLDRLKKLNEEILKESEDLLRRLEEEVR

SEQ ID NO: 2482 - protein, 60 aa, Artificial Sequence
  Synthetic sequence.
SEIEKVVKDVDKLLKELEDHTRKSLEDSKRLLDELRKHTEDTSREVKELLERLEEVIRRN

SEQ ID NO: 2483 - protein, 56 aa, Artificial Sequence
  Synthetic sequence.
KEDADRLRERLDRILEESERLSRETKEELDRLLEDSKRKIRELEERLKKLLDDAER

SEQ ID NO: 2484 - protein, 60 aa, Artificial Sequence
  Synthetic sequence.
DDSDKVLKELEKLLEDLERHTRESLRESDELLKELKEHTKTTLRRSERLLRELKRLVDEN

SEQ ID NO: 2485 - protein, 56 aa, Artificial Sequence
  Synthetic sequence.
EKDVEEVRRKVEELLKDSERLSKETKERLRDILRDSRRLSRETKEELKRILKEVRD

SEQ ID NO: 2486 - protein, 60 aa, Artificial Sequence
  Synthetic sequence.
RESEEVIKEVEKLLEELKENTKRTLKESRDLLKTLEDHTRETKKTVEKMLKELEDKVRKR

SEQ ID NO: 2487 - protein, 56 aa, Artificial Sequence
  Synthetic sequence.
EEEADRLRRELKKILDRSRELSRKTKEDLKKLLKESEDIIRELDRRLEEILKEVER

SEQ ID NO: 2488 - protein, 60 aa, Artificial Sequence
  Synthetic sequence.
EEIERVIKEVKDLIEELRRNTERTLRESEELLKTLKKISDDSKEEVERMLRELRELVKSN

SEQ ID NO: 2489 - protein, 56 aa, Artificial Sequence
  Synthetic sequence.
KEDADRLRREVDKLLEESKRLSEETKRELDRILEETKRTLERLKEELDKILEEVER

SEQ ID NO: 2490 - protein, 60 aa, Artificial Sequence
  Synthetic sequence.
SEKEKLVEEVRRIIERHKRVTEELLKELRRILKEWEDVSRDIERRVREILERLERAARDG

SEQ ID NO: 2491 - protein, 55 aa, Artificial Sequence
  Synthetic sequence.
KDLEELKKELEDSARRSKKLADDVREELKTLLRESERIIKELRKELEKLLREVEK

SEQ ID NO: 2492 - protein, 60 aa, Artificial Sequence
  Synthetic sequence.
TLEEVLKEVKRRVERVNEEDKRVLDESRKRAKEINDEDRRLLEESKRKAEELLERLRRKD

SEQ ID NO: 2493 - protein, 56 aa, Artificial Sequence
  Synthetic sequence.
EDRLRREAERILREIRELSRELKRKNEELLRTIRRVSEELRKKNEEILERVDREIK

SEQ ID NO: 2494 - protein, 60 aa, Artificial Sequence
  Synthetic sequence.
SAKELLDDLRKKIEDNVRETEKLLRRLREKVEKIEREIKELVRKLREDLERLLEKVKRRG

SEQ ID NO: 2495 - protein, 55 aa, Artificial Sequence
  Synthetic sequence.
KEVVDTVRELIERDHKKSRDSVRRVDELIDRARKDVRRVVEEVRKDLEKLDEDVK

SEQ ID NO: 2496 - protein, 59 aa, Artificial Sequence
  Synthetic sequence.
REVEEVLKDLKRLIDEAKKRVEDAIREIDRLIREWERLNREMLREIKKSNDEVRELVKA

SEQ ID NO: 2497 - protein, 56 aa, Artificial Sequence
  Synthetic sequence.
EEAVRDVERRLEKLLKEIKDLIDRLKEKVDRVKREVERSIEELKRHNEEVLKEVRK

SEQ ID NO: 2498 - protein, 59 aa, Artificial Sequence
  Synthetic sequence.
KEVEDVLEELDRLIETWARLNRELVERIRRLLEEWREENRKVVEEVRRSNETLRELVER

SEQ ID NO: 2499 - protein, 56 aa, Artificial Sequence
  Synthetic sequence.
EEVVRRVKDKLREVKREVEETARELRERVDDLLRKVEESVTRLKRHNEDLLREVER

SEQ ID NO: 2500 - protein, 59 aa, Artificial Sequence
  Synthetic sequence.
SEVEEVLRDLKRLLEEWKKRNEDLVRDVERLLREWKEANDRALKKSRDSNKELERLARD

SEQ ID NO: 2501 - protein, 56 aa, Artificial Sequence
  Synthetic sequence.
KEMVERVRREIKRLEEEVKKTITDLKERLKKLKEDADRSSRESEEHNKKVVEDVRR

SEQ ID NO: 2502 - protein, 59 aa, Artificial Sequence
  Synthetic sequence.
REVEEVLKELDRLIDELRKEVEKIVREVERSNDEWRRRNKELVDEVRRELDRLRKLVDD

SEQ ID NO: 2503 - protein, 56 aa, Artificial Sequence
  Synthetic sequence.
KEVVDDVKRKLEDLKRRVDELVRRLEEHNKDLRRKVEESAKDLRRKLEELRERVER

SEQ ID NO: 2504 - protein, 60 aa, Artificial Sequence
  Synthetic sequence.
SEKDEVRKTIERLLKEVEKMIRRVLKEVEDLLRELKKRTEKLKRELDESHRRVKEVIERR

SEQ ID NO: 2505 - protein, 56 aa, Artificial Sequence
  Synthetic sequence.
RELLEEVERALKKLKEDVDKVIEELREKLKRHHEDVKRAIDRVREESKRLKDEAEK

SEQ ID NO: 2506 - protein, 60 aa, Artificial Sequence
  Synthetic sequence.
REDEEVVKTLRELLREAKERTDRLLRELREIIKTMRKRLRDIEEDLRRSHREIEKLIRDR

SEQ ID NO: 2507 - protein, 56 aa, Artificial Sequence
  Synthetic sequence.
RELLEEVRKELERHHREARRAVEEVKKLIDDLMREVRKLIDEVRKDSERLRREVER

SEQ ID NO: 2508 - protein, 60 aa, Artificial Sequence
  Synthetic sequence.
DEDEEVKRRLEKLLEDADRVTEKIRKDLKETHDRVKRAIDELKKELEKSHRTIKEVIERR

SEQ ID NO: 2509 - protein, 56 aa, Artificial Sequence
  Synthetic sequence.
RELVEEVRDRLRKHHKKVRDIVDDVDKRSKDLERTARRVIEDVKEKSDRLKEEVDR

SEQ ID NO: 2510 - protein, 56 aa, Artificial Sequence
  Synthetic sequence.
EDEERVKEKLKRLLEKAEEALRRSKRRNEENKKEHERVLKEIDERLKRLEEKVRRG

SEQ ID NO: 2511 - protein, 56 aa, Artificial Sequence
  Synthetic sequence.
REDIERLLKELDDRIRRIIEELKRSDEELHKENRRKIKELEDLVREADKRIEDKRK

SEQ ID NO: 2512 - protein, 56 aa, Artificial Sequence
  Synthetic sequence.
DDEKEIKDRLDDNKRKDDEMTKRAEDELRKNLETTKEALRDIKRKLDRLREKVERN

SEQ ID NO: 2513 - protein, 56 aa, Artificial Sequence
  Synthetic sequence.
REELEKIVRDLHKRNKEVIDDIRRLIDELHKRDRETIKRLEEIVRRADEKIKEKAR

SEQ ID NO: 2514 - protein, 56 aa, Artificial Sequence
  Synthetic sequence.
SDEERIEERLKRNEETDKRATDENEKRNDDLLRRAKEALDRNRERNDELRDKVRKE

SEQ ID NO: 2515 - protein, 56 aa, Artificial Sequence
  Synthetic sequence.
REELSKLVKELHDDNREKIKDSDRSDDDIRREIERMIRETNKSDEDIARAIDESAR

SEQ ID NO: 2516 - protein, 57 aa, Artificial Sequence
  Synthetic sequence.
SERERVEERLKELAKRVEDAIRRLKKDLERTKEEHKEADRRVKEKLKRLKEEVDRAN

SEQ ID NO: 2517 - protein, 56 aa, Artificial Sequence
  Synthetic sequence.
DTEVEELLKDVKRKIEEMIKELKRLNDELNKRSEEMIRRNDDLIKRLEEEIRKDSK

SEQ ID NO: 2518 - protein, 59 aa, Artificial Sequence
  Synthetic sequence.
SSEDEVRKTVDELRERSERTIRDLERVDRELKKEHEELIKELREIVKELREKVKRASKE

SEQ ID NO: 2519 - protein, 55 aa, Artificial Sequence
  Synthetic sequence.
KRIEEELRKLHKENKEAVERSERTNRDILRRNDEADKEIEKELRELIEKLERDRK

SEQ ID NO: 2520 - protein, 57 aa, Artificial Sequence
  Synthetic sequence.
SEKEDLKEKLKRNEEEHRRAVEEIRKRLDENRRRHEKVIKEIEDALKKDEDDVDKEN

SEQ ID NO: 2521 - protein, 56 aa, Artificial Sequence
  Synthetic sequence.
KDELTREIEKLHRTNREMVRDLRETLKRLHEENKRLVDELRRLLEELHRRTREASR

SEQ ID NO: 2522 - protein, 57 aa, Artificial Sequence
  Synthetic sequence.
SEEEEVRKALERLRRELKRVLERSEELLKEWEDRLRRVLEESRRLLERWREELEKDG

SEQ ID NO: 2523 - protein, 56 aa, Artificial Sequence
  Synthetic sequence.
REELKEILKRLEDTLREIEKEAKRLNDELARVLEEIRRKSERENRRLKELIDRLRK

SEQ ID NO: 2524 - protein, 57 aa, Artificial Sequence
  Synthetic sequence.
SDRERLEEMLKRLKEELEKVRRDNERSLEEIKRSVDRVLEEHKRTLEELKREVDRAN

SEQ ID NO: 2525 - protein, 56 aa, Artificial Sequence
  Synthetic sequence.
GEEADEVVKRLADVLEKAREDLKRSDKRLRDSNRESRKELEKINRDLRRKLEEAKR

SEQ ID NO: 2526 - protein, 57 aa, Artificial Sequence
  Synthetic sequence.
KDEERLETVLREIETRAEKVARDHRDSLRRIREELERVLKENKDTLKRIREELEKTN

SEQ ID NO: 2527 - protein, 55 aa, Artificial Sequence
  Synthetic sequence.
EEVKRVLKELRDLLEEIRKRLEDINRDLKRKLDEIEEELRRSDEKLKRDLEEARK

SEQ ID NO: 2528 - protein, 56 aa, Artificial Sequence
  Synthetic sequence.
SDEDKLREDLRRLEEELKKVLDDHRKSLKEIEDSLRRVLEENKRTLEKLKRDAEKA

SEQ ID NO: 2529 - protein, 56 aa, Artificial Sequence
  Synthetic sequence.
GEEAKKVVKALEDVLREIRERLKRINDELRERNKKSSDELRKSDERLKRELDKMRK

SEQ ID NO: 2530 - protein, 59 aa, Artificial Sequence
  Synthetic sequence.
DADKELEKLLREWEKRSEELRKRLEDINRRWEEESKRLKKELKDINADLRRKVEELRRD

SEQ ID NO: 2531 - protein, 59 aa, Artificial Sequence
  Synthetic sequence.
SDVIRRAKEELDRIEKKDRDVLDDNRRLIETWRREDKKVNDDNRRSNEELKRELDKTRE

SEQ ID NO: 2532 - protein, 59 aa, Artificial Sequence
  Synthetic sequence.
SAEEELKELLERWDRDSKRAEEELRRLLEESRERSEKVLRDLKRLLDEMEDAVRKLKRD

SEQ ID NO: 2533 - protein, 59 aa, Artificial Sequence
  Synthetic sequence.
SEVIERFKDVLRRIEKRNKEVIDRAKEVIDEDEKRNREVIERVERKVERLRKEVEDREK

SEQ ID NO: 2534 - protein, 63 aa, Artificial Sequence
  Synthetic sequence.
EEKERMREVLKRLEEEAKKVLDDNRRAVEEIEKKDREVHKRNRDLLERWREEMEEILRKARER

SEQ ID NO: 2535 - protein, 56 aa, Artificial Sequence
  Synthetic sequence.
EEELKKIIERAREELEKVRRELEEHLKRWDEISKKLSKDLERHNEEVARTLKRSRD

SEQ ID NO: 2536 - protein, 60 aa, Artificial Sequence
  Synthetic sequence.
SVLEEFKKRIEELHRRDRKVLEDHRRRLKEWEEELKRVLDEHRESLKRIKERVDRVKKDL

SEQ ID NO: 2537 - protein, 56 aa, Artificial Sequence
  Synthetic sequence.
SDALRELLREWDKLSKELEKELRDLNREVERSIREAKKKLEKANEEMRRTLEKDRK

SEQ ID NO: 2538 - protein, 60 aa, Artificial Sequence
  Synthetic sequence.
STEEDAERALEELKEELRRVEKENRDSLKRIREKLKEVEDEHRKTLEELKKELDDVMRKI

SEQ ID NO: 2539 - protein, 56 aa, Artificial Sequence
  Synthetic sequence.
KDSLKRLLDEARKKLEELKRRLEKLDRDLDESLKRLKEDLDRLDRELRRLLDELDK

SEQ ID NO: 2540 - protein, 60 aa, Artificial Sequence
  Synthetic sequence.
SVEEEARKALDDLRRRLEEVTRRHRESLKELREELDEVRKENEKSLKKIKDDLEAVRRRI

SEQ ID NO: 2541 - protein, 56 aa, Artificial Sequence
  Synthetic sequence.
EEELRRLLKKLEDDLRRLKKRLDELDRRLRELVKRLLEDLKRLDDELKKLLEETER

SEQ ID NO: 2542 - protein, 57 aa, Artificial Sequence
  Synthetic sequence.
SAEEELKRLLEEHKKESEDVKRRLRDLLRELEDIHRRMTERLRELLKRLDDILRRRN

SEQ ID NO: 2543 - protein, 55 aa, Artificial Sequence
  Synthetic sequence.
EEILKKLEEISRRVREKVKKELDELKELIRRHARKLEKILEEIRRLIEDLERRAR

SEQ ID NO: 2544 - protein, 61 aa, Artificial Sequence
  Synthetic sequence.
SEAEEVLKRIRDILETLRREHERILKEIRELNEEFKKEVEKALRKIKRELEELEKDAEREG

SEQ ID NO: 2545 - protein, 59 aa, Artificial Sequence
  Synthetic sequence.
ERVEKKIEELLREIRKVNDEVHKRIRKLLEDHRRTVDEARRRIEELLRRLKKTLDDIDK

SEQ ID NO: 2546 - protein, 57 aa, Artificial Sequence
  Synthetic sequence.
SDKDELKRLLDDHERTSTRARESLEKLSREHRKTSREVEERLKRLVDAIRDTARRVD

SEQ ID NO: 2547 - protein, 59 aa, Artificial Sequence
  Synthetic sequence.
EEVVRRILRELRELNERAKEMLERILRKLEELNREYKKKVREILERIKELLRDLRRKAN

SEQ ID NO: 2548 - protein, 61 aa, Artificial Sequence
  Synthetic sequence.
SADDEIRKLKKEAEDILRKAREDRERLKEKNRKIDEDMRRTLKKLHEETRELEKKVRREKG

SEQ ID NO: 2549 - protein, 55 aa, Artificial Sequence
  Synthetic sequence.
EELVKEIRELLRRLEEKIEELRRRYEKKLEELKRKVDELIRRYKRKLERVAEEVK

SEQ ID NO: 2550 - protein, 60 aa, Artificial Sequence
  Synthetic sequence.
SEEEELVRRVEEKIKASEKHARELVEETRKKLDESRKKWKDLARRSRRLLEELKDKVDKG

SEQ ID NO: 2551 - protein, 55 aa, Artificial Sequence
  Synthetic sequence.
EELRRLEKELRDLNKRVKEESRKLEEDLKDIHERAKEDSKRLKRELEKIKEEVER

SEQ ID NO: 2552 - protein, 59 aa, Artificial Sequence
  Synthetic sequence.
DAERILRELEERLKRLLDEHREISKELRKRNKDLLKEHKERSKRVKEELKELVKEVEDG

SEQ ID NO: 2553 - protein, 56 aa, Artificial Sequence
  Synthetic sequence.
IEELVKEVEKLIKELREKSREVEREVDKMIRDNARKSEKIVRDAKRLLEKLEREVR

SEQ ID NO: 2554 - protein, 59 aa, Artificial Sequence
  Synthetic sequence.
RSEDILRELRERVKRSEERHEKISRDLERKNRELLKEHRERSEKLKRELEELVKRVEDR

SEQ ID NO: 2555 - protein, 56 aa, Artificial Sequence
  Synthetic sequence.
AEDLARRVDETIKDHERHSEEVKRDVTEKIKENEKLSRDIVRRVEKLLRDLEREVR

SEQ ID NO: 2556 - protein, 59 aa, Artificial Sequence
  Synthetic sequence.
SREDILRDLRRRLEELLRRHKRISDELRKRNKKLLDDAEKRAKELREELEKLVREAERR

SEQ ID NO: 2557 - protein, 56 aa, Artificial Sequence
  Synthetic sequence.
IEELVKRVDKLIKELKRKSEEVMKRVDELIRRNERLIREIVKEVEKLLEDLEREVR

SEQ ID NO: 2558 - protein, 59 aa, Artificial Sequence
  Synthetic sequence.
SAEETIERLKEEIEKLLREAEEILRRLRERNRRLLEEHKDISRKLEEELRKLMEKVRRG

SEQ ID NO: 2559 - protein, 56 aa, Artificial Sequence
  Synthetic sequence.
VEELVRRVRELIKRLRDMAKEIEERVDETIRRNRRLSEKVARDVERLLRELEERVR

SEQ ID NO: 2560 - protein, 59 aa, Artificial Sequence
  Synthetic sequence.
DAERILKELEERLDRLSEEAKKILDELRRENEELLREHDERVKKLKEDLKRLEKKVEDG

SEQ ID NO: 2561 - protein, 56 aa, Artificial Sequence
  Synthetic sequence.
VEELVKRVTKLIEDLRRLAKKISDEVRKLIEENRRASKRVEDEARELLKRLEDAVR

SEQ ID NO: 2562 - protein, 56 aa, Artificial Sequence
  Synthetic sequence.
SEIEKMVKDVRDLLKRLKDEVKKISERWEDSLRKLKKRSEDTVKRVKEILEELRRR

SEQ ID NO: 2563 - protein, 56 aa, Artificial Sequence
  Synthetic sequence.
RDALRELERELDKLRKEIKKELDRLRKENREVNERHKELSKRLEEELERVKRELDT

SEQ ID NO: 2564 - protein, 57 aa, Artificial Sequence
  Synthetic sequence.
DEVRELVKTVKKVLDDIRREVEETLRRYEKLVEDLKRRSDKSVKDVDDEIKRAEEEG

SEQ ID NO: 2565 - protein, 56 aa, Artificial Sequence
  Synthetic sequence.
EELIKRLREEAEKLIRRAKEEHERLEEESKRLLEENEELLDRLDKKVRTLLDKLEK

SEQ ID NO: 2566 - protein, 60 aa, Artificial Sequence
  Synthetic sequence.
SEEDRVRETVKKLLEDHRRKTEKVTEDVRRLLKENREKVEDAVDKARKLLKRLEELRREG

SEQ ID NO: 2567 - protein, 55 aa, Artificial Sequence
  Synthetic sequence.
EKLKRIEEELRKSRERTKRLLEEIRKELEDSKKEVEDLLRRLREELKRLKDEIER

SEQ ID NO: 2568 - protein, 63 aa, Artificial Sequence
  Synthetic sequence.
SEVEELVKRAEELIRELKKLSEDSVRELEKLLDEYRKTTEKLKRELEELLKEVEDVVRKLRDQ

SEQ ID NO: 2569 - protein, 56 aa, Artificial Sequence
  Synthetic sequence.
EKLLRKIEEDVRRLKETNERLLKRVDEELKRLDEESRRVLKEAKERLKELKDRERK

SEQ ID NO: 2570 - protein, 57 aa, Artificial Sequence
  Synthetic sequence.
DEVEKVLDELEKVIREVEERIKTTNKRLREVVERVERRIDKSDRELEEMIERVERKL

SEQ ID NO: 2571 - protein, 56 aa, Artificial Sequence
  Synthetic sequence.
SEEVRKEVRRLDKRVKEIVEESRKLVKELAERVEEIVEESKRLVEKLAREVDETRR

SEQ ID NO: 2572 - protein, 57 aa, Artificial Sequence
  Synthetic sequence.
SEIEKALKEAREAIEDAKKKIDDTDRENEKASRDAERRIDKSDKEAEEAVRRAEEEA

SEQ ID NO: 2573 - protein, 56 aa, Artificial Sequence
  Synthetic sequence.
KDEVTKAARKAADDAREAAERSRKLAEENARRAKKAADDSRKLARELAKEAKKAAD

SEQ ID NO: 2574 - protein, 57 aa, Artificial Sequence
  Synthetic sequence.
KELEDVLDTVRRAIERVKRESKKINDELEKELKKVKDELDKSHEEVRRAVEDVARKL

SEQ ID NO: 2575 - protein, 56 aa, Artificial Sequence
  Synthetic sequence.
VKDIEKLVRDVVRRAEKVVDDDRKLVRDIVRDAKRVVRDSERTVRDIVKKADENTK

SEQ ID NO: 2576 - protein, 57 aa, Artificial Sequence
  Synthetic sequence.
SKLEKILKDLERAVREVARELERTHRELEEAVKKVKKRLEDTNRRLTEALKRVKDKL

SEQ ID NO: 2577 - protein, 56 aa, Artificial Sequence
  Synthetic sequence.
VSEIKKLVDDIVRRLRKVVKDSEREVREIMKRADDVVRTSEKTVEDIVKEAEDDAR

SEQ ID NO: 2578 - protein, 57 aa, Artificial Sequence
  Synthetic sequence.
SELEEAAKRAREAAKKAKEALKRSLKEAEDAAREAEEDLKRSNDKNRKATREAEERA

SEQ ID NO: 2579 - protein, 56 aa, Artificial Sequence
  Synthetic sequence.
AEEAKKAADDLARKAKEAADESKRLSEELAKKAKEAAKTSDKLAKENAEEAKKAAK

SEQ ID NO: 2580 - protein, 57 aa, Artificial Sequence
  Synthetic sequence.
DELERVLEDLKRVMEEVERKLRESNKELEKAVRRVEELLKRSNEKNRKVTREVREKA

SEQ ID NO: 2581 - protein, 56 aa, Artificial Sequence
  Synthetic sequence.
AKDVEDLVRRLMEKLERIVEESERLSDELRRRAEEVVKTSEDLVRENAKRVDDAAK

SEQ ID NO: 2582 - protein, 57 aa, Artificial Sequence
  Synthetic sequence.
DELEEIEKKLRDVVREVEEKLRETNRRLREVVKRVEERLKKSNEDLRRAVRKVEESV

SEQ ID NO: 2583 - protein, 56 aa, Artificial Sequence
  Synthetic sequence.
AKDVEKLVKELMEEAEKIVEESRERVDRLMKRLDDIVRESERLSKELADRADEVEK

SEQ ID NO: 2584 - protein, 58 aa, Artificial Sequence
  Synthetic sequence.
RELEEILRTLEEMIERVKEKHERSKRELEKVITEVKEELRRSNEELRRVIEEVERKLG

SEQ ID NO: 2585 - protein, 56 aa, Artificial Sequence
  Synthetic sequence.
VDEVRKVVEDIVREAEKSVRENEELVKAIMRELKRVVKEAEELSEEIVRRLEERTR

SEQ ID NO: 2586 - protein, 61 aa, Artificial Sequence
  Synthetic sequence.
KELEDVKRRLEKVHRDVNEASKEIVTRLREVHKRANDESKKIIERLDTVLREVARRLADRR

SEQ ID NO: 2587 - protein, 56 aa, Artificial Sequence
  Synthetic sequence.
AEEVERRVRELEKDVRRLVEDIRRLVEELMRNAKEIVDTAEKLVRELERKLEEVVR

SEQ ID NO: 2588 - protein, 61 aa, Artificial Sequence
  Synthetic sequence.
DEVEDIIRRLEKFHREVNEESKRIIEELERVHREVNRKSEEIVRKLEKVLDEVREKAKRRS

SEQ ID NO: 2589 - protein, 56 aa, Artificial Sequence
  Synthetic sequence.
AEEVEEVVRRLVRHAEAVVERIERLVEELVRNAEKLVEEVKRKADRLVEEADRTVR

SEQ ID NO: 2590 - protein, 57 aa, Artificial Sequence
  Synthetic sequence.
DELEEVKRRLDEVNKRVEDEHRRVEEELRKVLEDVAREHEEVIKELERVLEKVRRAK

SEQ ID NO: 2591 - protein, 56 aa, Artificial Sequence
  Synthetic sequence.
SDEARKLVKENERRVEETVRRSEKLVRDAMKKAKDTVRRSAELVKELMDRVERVVR

SEQ ID NO: 2592 - protein, 57 aa, Artificial Sequence
  Synthetic sequence.
SEVEKVKKEAREMLKRVTDLLKEVNDRLKEVNKRVREEIRRVIERVREVLKRVAREV

SEQ ID NO: 2593 - protein, 56 aa, Artificial Sequence
  Synthetic sequence.
LEDLRRVVEELEKRARDVVEESRRLVDEDRKHVEDVVRRVRDVVRELEERAERITR

SEQ ID NO: 2594 - protein, 59 aa, Artificial Sequence
  Synthetic sequence.
SEVEKVVEENKKSVKTVRERVTELVKRNRDSVEEVKRRAEEMVRRNRKSVEEVRELLAR

SEQ ID NO: 2595 - protein, 59 aa, Artificial Sequence
  Synthetic sequence.
EEAKRRVDRVSEELEEVLRRVEEELRRVSKDLRRVLDEVKKEVDRVSEDLERVLRKDTT

SEQ ID NO: 2596 - protein, 60 aa, Artificial Sequence
  Synthetic sequence.
DEVDEIVRRIEEIVRESEEMAERIVRDIKRVVEKSRKDVEDNVDELRKIVEKVEETAKRT

SEQ ID NO: 2597 - protein, 59 aa, Artificial Sequence
  Synthetic sequence.
RDAERKVRDLLRDLERVNTEADEKSKKLIKELEKVNKEAEDKSRKLIKELEDVLREARR

SEQ ID NO: 2598 - protein, 60 aa, Artificial Sequence
  Synthetic sequence.
SSVDEIVKEAEKVVEDSREEAREIVERAEEIVRDSARKVDENVRRLEEIVRKVKEVADRT

SEQ ID NO: 2599 - protein, 59 aa, Artificial Sequence
  Synthetic sequence.
RDAERKVREVIERLKKVNDEVRKKLDELTRRLEDVNRKANERSTDLVRKLRRVLEEARR

SEQ ID NO: 2600 - protein, 59 aa, Artificial Sequence
  Synthetic sequence.
SADRKIEEMRKEIKRSTDEARRLVEELIRKIERSNEKVKRDVEKLIEDIRRVIRRVRED

SEQ ID NO: 2601 - protein, 55 aa, Artificial Sequence
  Synthetic sequence.
EELKKKLEDIVREDEKLVEELTRLAEDIVRRDTKLVRELLERAKRVVDRVREEVK

SEQ ID NO: 2602 - protein, 60 aa, Artificial Sequence
  Synthetic sequence.
DAEELVRELEERIKRSHERLEELLREVKRLIERSHEELKRLNEEVLRELDRVLDEVRKRK

SEQ ID NO: 2603 - protein, 55 aa, Artificial Sequence
  Synthetic sequence.
KDVVRELERIVKENSELAERVFREVEKIVRENTKLAEDSVRELKRLVEELKKRVK

SEQ ID NO: 2604 - protein, 59 aa, Artificial Sequence
  Synthetic sequence.
SDVEDVVRKLRELVKTNLKKVEDRVRKLKEEVEENVRRAEKIVRELEEEVERLLKLVAD

SEQ ID NO: 2605 - protein, 56 aa, Artificial Sequence
  Synthetic sequence.
REVAEEVERRLERSHRESRKLADEVRRALEKSNRKTRELLRRVDERVEEVREELDR

SEQ ID NO: 2606 - protein, 59 aa, Artificial Sequence
  Synthetic sequence.
SMEELVDKVEKELEESSRRSKELLDEVRRLLEESNKKTEDLLREVEELLKDVEREAEEK

SEQ ID NO: 2607 - protein, 53 aa, Artificial Sequence
  Synthetic sequence.
VVRDVERLVEENRERVKRIADEMRKLVKENEDRARDVVRRLRELVKRLRERVE

SEQ ID NO: 2608 - protein, 59 aa, Artificial Sequence
  Synthetic sequence.
KELEDIARDLERLLRENKKLIKEIVDRLRRLLEDNTRKVKKIVDEVKKLLDDLDKLRKD

SEQ ID NO: 2609 - protein, 56 aa, Artificial Sequence
  Synthetic sequence.
KEVADKVREDLERSNDEMRRVIEKIREDLRRSLKEAKERLDEIKERIDRLLDAARK

SEQ ID NO: 2610 - protein, 60 aa, Artificial Sequence
  Synthetic sequence.
KLEELLTEVRRRIEEVSRDLERVLREVEEDIKRTSDELDRVNRKVETEIKEVTERAEEKG

SEQ ID NO: 2611 - protein, 59 aa, Artificial Sequence
  Synthetic sequence.
EELVREVIERLKELVKKDKKLVEDVLRELKRLVDEDRKLVEDSLRRAKEIVDRARERVK

SEQ ID NO: 2612 - protein, 60 aa, Artificial Sequence
  Synthetic sequence.
SIEDVLREVERLLREVIERNRKVHEEVNERSREVERELKRVHDEANRESEEVIREAKRKG

SEQ ID NO: 2613 - protein, 56 aa, Artificial Sequence
  Synthetic sequence.
VEELERRAREIVKRVRELVDTHRENLERIVERAKELIKELEENLRDIVREIRERVR

SEQ ID NO: 2614 - protein, 58 aa, Artificial Sequence
  Synthetic sequence.
KEVEEVADRSRRVVEESKRRLDDVVRRVKEDSDRLRRDIERMVKRIKEIVKRVREEIG

SEQ ID NO: 2615 - protein, 56 aa, Artificial Sequence
  Synthetic sequence.
RKILKELLDRDRKSVKESEDEVKRLLDSNHELSRRIREELKRLLEKVKELVDRVRT

SEQ ID NO: 2616 - protein, 58 aa, Artificial Sequence
  Synthetic sequence.
KEVEDVKRKLEKIARDSEEALRRVVDELRKIVTESKKKLDKAVKEVKDDSKRVEETIG

SEQ ID NO: 2617 - protein, 56 aa, Artificial Sequence
  Synthetic sequence.
RDIMRKLLEEVKRSIDESKKRVKELVDEVRDSVRRSEEEVERLLRSNHRLSDEVRK

SEQ ID NO: 2618 - protein, 58 aa, Artificial Sequence
  Synthetic sequence.
DDVERVIEEVKRVVDDSKRRAEEVVEESRKIVTDSERKVREMVRDVRRIVKEVEERIG

SEQ ID NO: 2619 - protein, 56 aa, Artificial Sequence
  Synthetic sequence.
RRIVKKLLEDVRKSVKESKDTVDKLVEENKRSVDRSLRELEKLLKEVEDLIREVTR

SEQ ID NO: 2620 - protein, 58 aa, Artificial Sequence
  Synthetic sequence.
DEVDEVVKRSRDVVTESEKRLRDVVRRSKEIAEDSRRRVREVVERLKEIVREVEERIG

SEQ ID NO: 2621 - protein, 56 aa, Artificial Sequence
  Synthetic sequence.
RRVVEELLRRDEKSVEDSLRRVEKLVEDNRKTSEDIEREVRRLEEEVRKLVEDVTK

SEQ ID NO: 2622 - protein, 58 aa, Artificial Sequence
  Synthetic sequence.
REVDEVVERMKELVATVKRENDEVVKELKKLVKELEDDNRRVVEESKKSVEDLARRVG

SEQ ID NO: 2623 - protein, 56 aa, Artificial Sequence
  Synthetic sequence.
RDLVREVEKRVRDIVEESRKLAEETRKKVEDIIEKSKRIAEDTLEKNKEMVERLER

SEQ ID NO: 2624 - protein, 59 aa, Artificial Sequence
  Synthetic sequence.
REDELVERLVDKVRRSSKEVRDRAEEMVRRNEKLVRDVEEDLDRLVEENKKLVDSVSRL

SEQ ID NO: 2625 - protein, 55 aa, Artificial Sequence
  Synthetic sequence.
KEVVDRLRELVERSEKDVRKVVEEDKRITDKLEKRVREVVKRNEEITDELRERVR

SEQ ID NO: 2626 - protein, 60 aa, Artificial Sequence
  Synthetic sequence.
SSIERVAKLVEEVERHVRKSIKDVEKLVRDVERHIEESVKTVSKLVEDVKRAVEELRRKV

SEQ ID NO: 2627 - protein, 62 aa, Artificial Sequence
  Synthetic sequence.
EDVERLVREVVKRLEEIVERSERLVREVEERLKEIVERSRRLSKENEDELRKIEKEVRDRVK

SEQ ID NO: 2628 - protein, 55 aa, Artificial Sequence
  Synthetic sequence.
KDVEDAERRLKELLDRLKRFVEESVKTSKKIVDDSKRVVEESAKRSRDIVREVKD

SEQ ID NO: 2629 - protein, 56 aa, Artificial Sequence
  Synthetic sequence.
REKIEELVKEVDKLIKDVVRRMEKLNREVKKSADDSAREVEELNRRVREVVERVRT

SEQ ID NO: 2630 - protein, 57 aa, Artificial Sequence
  Synthetic sequence.
DEVEEVEKELRELVKRSEEVAREVKDRLRKLVEESERVVRESRRKSREIVEEIRKKV

SEQ ID NO: 2631 - protein, 56 aa, Artificial Sequence
  Synthetic sequence.
KDEARRLVEEVKRSVEKSVKELEDLVEEVKRSVEESVKEAKELNDRVDETVKRRAT

SEQ ID NO: 2632 - protein, 57 aa, Artificial Sequence
  Synthetic sequence.
RSVDEVEKELRELVERITRFVEKSVRDSRKIVEDSKREVEKVKDDLRKIVEEIRRKV

SEQ ID NO: 2633 - protein, 56 aa, Artificial Sequence
  Synthetic sequence.
EEDAKRLVKEVAELIKRVVEEMKKLNDEVEESARRSVEEARRLVEEVKRLVDEVAT

SEQ ID NO: 2634 - protein, 59 aa, Artificial Sequence
  Synthetic sequence.
EVEELVERVLRELERLVRENKESSDRIKEELRKLVEDNEKSVRDTKRTAEKLVDDLRRK

SEQ ID NO: 2635 - protein, 59 aa, Artificial Sequence
  Synthetic sequence.
ERVVRKVREDVKRVERLSKEIVDDSKREVEKVVETSRRIAEKSTDVVRRVKRELEEITR

SEQ ID NO: 2636 - protein, 59 aa, Artificial Sequence
  Synthetic sequence.
SMKELIKRVKDLVDEVRKKVERLIEEVSKLVDDVKRHIRELIETVKRLVKEVADLLRAG

SEQ ID NO: 2637 - protein, 59 aa, Artificial Sequence
  Synthetic sequence.
EEARRLVEKVERDLKDIVRRVEELSRRNVERLKEIVKESRELVKEVVERLKRIAEEVTT

SEQ ID NO: 2638 - protein, 56 aa, Artificial Sequence
  Synthetic sequence.
KEKEDVKRRLEELIRRLEEHSKKVKRDLERVIKELDDEVRRVKERHEDVIRRLKDR

SEQ ID NO: 2639 - protein, 55 aa, Artificial Sequence
  Synthetic sequence.
DDVVRRVKELLRRVLEHTRKVVEDVRRLLKRIREKLEEISRKLDELLRRIEEKRR

SEQ ID NO: 2640 - protein, 58 aa, Artificial Sequence
  Synthetic sequence.
DREDEVRKDIERIERELRRVVDELRKEVEDSMRKLDEEVKRLEEHIRESVERLEERVS

SEQ ID NO: 2641 - protein, 55 aa, Artificial Sequence
  Synthetic sequence.
EKVLRDLKRVVDEVRKELKDVLDRHNKVVREVERKLEEVIDKHRKAVEKVKRDAK

SEQ ID NO: 2642 - protein, 59 aa, Artificial Sequence
  Synthetic sequence.
SREEELKKEVERLVREAEKHVEDNRKHVEDSVRELEKLVKELADKARESADRLDKKVKE

SEQ ID NO: 2643 - protein, 55 aa, Artificial Sequence
  Synthetic sequence.
ERVLEELKRVVDDIRKKHKDILKRHRDVVRKVEKELRDILREHNEVIREVKDKLE

SEQ ID NO: 2644 - protein, 60 aa, Artificial Sequence
  Synthetic sequence.
SEVERILKEAKRRLDEVVERLRKSAETLRRMLERVSRELKKSHDELDRVLRRVEDALRKR

SEQ ID NO: 2645 - protein, 56 aa, Artificial Sequence
  Synthetic sequence.
AEELRKEVEDMVRDLERLVREHSDRVRKIVTDLDRLVKEHNEEVRKIVERLDEEVK

SEQ ID NO: 2646 - protein, 60 aa, Artificial Sequence
  Synthetic sequence.
SELDEILERLKEVLERVKRKLEESNRRLEEVLDRVLKKLTESVKRLEDELRRVLKELREN

SEQ ID NO: 2647 - protein, 56 aa, Artificial Sequence
  Synthetic sequence.
IEEIKKDVERIVRELEDLVRRHEKRVEDIVRELEKIVRDHNERLKEIVRRAEEDVR

SEQ ID NO: 2648 - protein, 60 aa, Artificial Sequence
  Synthetic sequence.
RELEEILKRLEEVLERVLRELRKSVERLRKELERVLKELRDSNRKLDKVLREVLEELRKK

SEQ ID NO: 2649 - protein, 56 aa, Artificial Sequence
  Synthetic sequence.
AEDLERRVKEIERRLKRLVDEHNRRLREIVRELEEIVKRHKERVEEIVRELKRRVD

SEQ ID NO: 2650 - protein, 60 aa, Artificial Sequence
  Synthetic sequence.
SELDDIVRRLDEMLKRVEDELRKSDERLDELLKRVKKELEKSNRDLERALREVLKELEDR

SEQ ID NO: 2651 - protein, 56 aa, Artificial Sequence
  Synthetic sequence.
ARELEEEVERIVRELEKLVEEHKEELERLARKLEEIVRRHEERVRRIVKELEDRVK

SEQ ID NO: 2652 - protein, 60 aa, Artificial Sequence
  Synthetic sequence.
RELDEILRRLREELKRVREELEKSLKRLEDELRKVEEDLRESNERLERMLERVLRELRKR

SEQ ID NO: 2653 - protein, 56 aa, Artificial Sequence
  Synthetic sequence.
VDELRKELEKIAREAREYVKRNKDDLRRIVEELRKIVKKHKDKVEEDVRRLKKDVD

SEQ ID NO: 2654 - protein, 56 aa, Artificial Sequence
  Synthetic sequence.
RELEEILKKLEEVVRTVEELHKRTNEKLEKAVDEVRELHRKTNEDLKRAVDEVEKA

SEQ ID NO: 2655 - protein, 56 aa, Artificial Sequence
  Synthetic sequence.
KDRLDEEVKRLVEEARRSVEDDDRNIRRLVEEAKDSVRRDEETIKKLVDELREATR

SEQ ID NO: 2656 - protein, 56 aa, Artificial Sequence
  Synthetic sequence.
SDLERILKRLREVIKRAEELHRKTNEEDERVVREVIELHRKTNEDLREVIERVARG

SEQ ID NO: 2657 - protein, 56 aa, Artificial Sequence
  Synthetic sequence.
KEELRKAVEELEEKLERSVREDKKTSDDSARRAKKSVEDDRRTIEKLVEEAERSRK

SEQ ID NO: 2658 - protein, 61 aa, Artificial Sequence
  Synthetic sequence.
KDLEKLLDDIRKVLEEVTRRLKRISDELRRVLEEIKKRLDKDNEDLKRVIDEVKKLLDKKV

SEQ ID NO: 2659 - protein, 56 aa, Artificial Sequence
  Synthetic sequence.
REEIEKEIRDVEEELRRAVEENAELVKRVKEDAERVVRDSEKKSKEVAEELKDAVR

SEQ ID NO: 2660 - protein, 57 aa, Artificial Sequence
  Synthetic sequence.
SELEKILKELKDASREVEKRLRDILREDKKMLKKVVEELEEILRRLDEEVKKVKERL

SEQ ID NO: 2661 - protein, 60 aa, Artificial Sequence
  Synthetic sequence.
REEVVDRAKKEVDDHVKKAEDVVREVEKRSRESVKRLRDIVEELERLVKRLVDEAEREVK

SEQ ID NO: 2662 - protein, 60 aa, Artificial Sequence
  Synthetic sequence.
SETEKLLEEVRRIIEEIKKRIDRSLEEVRRSVEEAKRRIEKSLEDVEKSVRRVKKILDEG

SEQ ID NO: 2663 - protein, 56 aa, Artificial Sequence
  Synthetic sequence.
DRVLKEVEDLAREVKKRIDEVDKRVAELHKEVEDRLREVDKTVEELHRRVKKRADD

SEQ ID NO: 2664 - protein, 60 aa, Artificial Sequence
  Synthetic sequence.
SIEDVEREVKRLIERTKRHNDRVLETIRRLLEETKKHNEKVLREIRELIKRVEDTMRRRG

SEQ ID NO: 2665 - protein, 59 aa, Artificial Sequence
  Synthetic sequence.
EETIKRLLDEVREYVRKSEEDSERLLRDVERYVKESKERSERILKEARRLVKEVEDKIR

SEQ ID NO: 2666 - protein, 59 aa, Artificial Sequence
  Synthetic sequence.
SIEEVLEEVRDLLRKTKEDTKRILDEIRRLLEETKKRLEEVLREATKLLREVEDLVRKS

SEQ ID NO: 2667 - protein, 59 aa, Artificial Sequence
  Synthetic sequence.
EEEVKRLLEKARKLVEESKRESKEILDRARKYVKESLEEIERLLDELRKLIEELRRRIE

SEQ ID NO: 2668 - protein, 59 aa, Artificial Sequence
  Synthetic sequence.
SSEEILKEVKELIEESNRASEEVLKEVKKLLDESKKRSDEVLEEVERELKRLEESASRI

SEQ ID NO: 2669 - protein, 53 aa, Artificial Sequence
  Synthetic sequence.
VVREMRRLVEEDKRRIKEALDRLRKLVEDDKRRIEEVLREMRELIRELEERIR

SEQ ID NO: 2670 - protein, 61 aa, Artificial Sequence
  Synthetic sequence.
KEIEDILERLKETIKEIEDHIRRDLEELKKVIEELKRSLEEWKKRAERLIEELERLIRETG

SEQ ID NO: 2671 - protein, 56 aa, Artificial Sequence
  Synthetic sequence.
ERVLREAEERIRRLEEKLKEVNKRSEEMLRRLKEEHERVLREVKELIREIDDKARK

SEQ ID NO: 2672 - protein, 59 aa, Artificial Sequence
  Synthetic sequence.
GEDEVLRKVEKLLREVKERAEKSVERVERLLKDVEDKLKESHDRAKRLLEEVKKAADRG

SEQ ID NO: 2673 - protein, 56 aa, Artificial Sequence
  Synthetic sequence.
LKDLDRRIEEVVKRLEDEVRRHTKEVEEMVKRLRELVREHTERVKKIVEDLKREVD

SEQ ID NO: 2674 - protein, 59 aa, Artificial Sequence
  Synthetic sequence.
SEVEDVERRIREIIERLRRIVERHKEEVKKIIEKLEKLVRDHTERAKRIIERLKEVVDR

SEQ ID NO: 2675 - protein, 56 aa, Artificial Sequence
  Synthetic sequence.
EEVLKEVERLLEEVKELVERSHKEAEDLLKRVLDAMKRSVDEVEKLLEELKRRADK

SEQ ID NO: 2676 - protein, 59 aa, Artificial Sequence
  Synthetic sequence.
SKVEKVEEDIDKIIRRLEELVEEHRTEAEKTVKKLDDDVRRHNEKVEKIIRDLEEVVRR

SEQ ID NO: 2677 - protein, 56 aa, Artificial Sequence
  Synthetic sequence.
RKVLEDAKRLLERVMDEVRRSNEELKKLLEEVKRKLKKSVEDAERLLDEVRKRVEK

SEQ ID NO: 2678 - protein, 59 aa, Artificial Sequence
  Synthetic sequence.
SEVEEVDKRIREIVTTLKRLVEEHNDRARKIIEKLRRLVKKHEDEVEEIVRRLDEAVER

SEQ ID NO: 2679 - protein, 56 aa, Artificial Sequence
  Synthetic sequence.
EEVLKKVKELLKEVKRRLERSLEELERLLEEVLKLMKESNDKAKELLERVREKVER

SEQ ID NO: 2680 - protein, 57 aa, Artificial Sequence
  Synthetic sequence.
DFVERVKEEIKRIVERLKRLVKEHEDEVKRILDELRKLVETHKELSKDSLRKLEEVG

SEQ ID NO: 2681 - protein, 56 aa, Artificial Sequence
  Synthetic sequence.
ERVLEELRRLVKEVKERADRSSEKLNELLRKAEEDAKRSSEENNRRLEEVERRVRK

SEQ ID NO: 2682 - protein, 60 aa, Artificial Sequence
  Synthetic sequence.
DEERKIEEIIDKSRRDWERLLREAREIIKRSEDEWRELLERIKRLIEETRKRAKDLKKAD

SEQ ID NO: 2683 - protein, 59 aa, Artificial Sequence
  Synthetic sequence.
EEIRRLLEEMDKLSREASKRVEDILRELEERSRRMADEVRKLNEENKKLLEEAKKELKD

SEQ ID NO: 2684 - protein, 58 aa, Artificial Sequence
  Synthetic sequence.
DKEEIKEKLEELVERVVRELEKLLKELEDLSREVARRIKKIARDLEKLTKEVEEKLRR

SEQ ID NO: 2685 - protein, 56 aa, Artificial Sequence
  Synthetic sequence.
EEELERLIKELVDRARKLLEEVKKLIEDHREKLKRVLDEIKDLLRKHKETLDRTDT

SEQ ID NO: 2686 - protein, 58 aa, Artificial Sequence
  Synthetic sequence.
SKEDILRELRDRVERIKREIEKIFRDAKRLSEEVKRRIEDLLRKLKKVSDDVRERLAR

SEQ ID NO: 2687 - protein, 56 aa, Artificial Sequence
  Synthetic sequence.
EEELKELIKRLVEDAKRILEELKKLLDDHERKARRILERIEKLIKEHEDKARERER

SEQ ID NO: 2688 - protein, 60 aa, Artificial Sequence
  Synthetic sequence.
SEVEKLEEEVERSVRDLERELRDSEEKSKELMRRLDELVRRAKDHVRRSVEELRKTLSKG

SEQ ID NO: 2689 - protein, 58 aa, Artificial Sequence
  Synthetic sequence.
EEVRRILRDAERVIEEIKRRLEEDHKRLEEVIRRVEEKLRRILDEHDKVVKEIKEALR

SEQ ID NO: 2690 - protein, 60 aa, Artificial Sequence
  Synthetic sequence.
SEVEEAEKEVEDIMRRLKRKVEENKRHVDESVKEAEKLLRDSETRTRDIARRLKEELDKG

SEQ ID NO: 2691 - protein, 58 aa, Artificial Sequence
  Synthetic sequence.
KELTRILTRLREVIERVKRALEKSHDDHRRAVEEVRKELKRDHDDLRRVIEKVRRDLK

SEQ ID NO: 2692 - protein, 60 aa, Artificial Sequence
  Synthetic sequence.
SEVEEAKRRVDDIVRKLEELLKDSRRESERIMRELKRLLEELKRHVEDSVRKLREVLSRG

SEQ ID NO: 2693 - protein, 58 aa, Artificial Sequence
  Synthetic sequence.
RELREILRRAKEVIDKIREDLERDHDRLREVIEEIKKTLDRIHEEHRRVVKEVEDTLK

SEQ ID NO: 2694 - protein, 60 aa, Artificial Sequence
  Synthetic sequence.
SEVEEAEKEVREIMKELDKLLEDSKRESDDIRRDLDRVLEENKRHVDKSVTDLERVLSRG

SEQ ID NO: 2695 - protein, 58 aa, Artificial Sequence
  Synthetic sequence.
KELRRILRELEEVIKRVERTLREDHKELKRVIDRMKEDLERSHEEHERLVEEVERKLR

SEQ ID NO: 2696 - protein, 60 aa, Artificial Sequence
  Synthetic sequence.
SEVEEAKKDVERIMRELEKLVRDNKKHVDDSVRKLKKLLDDLRKHVEDSREELERVLRRG

SEQ ID NO: 2697 - protein, 58 aa, Artificial Sequence
  Synthetic sequence.
RDLRKILEDLERIIRRVEEELRRSHERHKEVVDRIKKVLDEIHRRHREVVKEVEKELR

SEQ ID NO: 2698 - protein, 60 aa, Artificial Sequence
  Synthetic sequence.
KEVEEAEDKVRRIVEDLKRKLEDLERHVEESVRRLEDLLRRSKKKSDDIMEKLTRTLSKG

SEQ ID NO: 2699 - protein, 58 aa, Artificial Sequence
  Synthetic sequence.
KELRRILKRMKDAIERVERELRRIHTRHKEAVDRVREELKRNHDELAKVIRKVREDLK

SEQ ID NO: 2700 - protein, 60 aa, Artificial Sequence
  Synthetic sequence.
DEVERADEDVERIVRELRRVLEENRRHVKESVERLERLVRKSKKDSKKIMEDLKRVLDRG

SEQ ID NO: 2701 - protein, 58 aa, Artificial Sequence
  Synthetic sequence.
TELRKILKKMKDAIREIKRTLDESHREHRRVVEEVKEELERNHKELKEVIDKVAKDLE

SEQ ID NO: 2702 - protein, 58 aa, Artificial Sequence
  Synthetic sequence.
DEVEDILRRVREAVERARESLERIHREHKKVVDEVRKALEKVLEDHARVVDEFRRKSG

SEQ ID NO: 2703 - protein, 56 aa, Artificial Sequence
  Synthetic sequence.
KDELKKEVEKLEEELKKELKRLKDHVKKSKEDLRRKLEDLKRHVERSVKRAEEEAR

SEQ ID NO: 2704 - protein, 58 aa, Artificial Sequence
  Synthetic sequence.
SEVEKVLRDLERAVKEVSERHRRNHEELRKVIKRVKEEHDRIHDEHRKVVEDLKRKIG

SEQ ID NO: 2705 - protein, 56 aa, Artificial Sequence
  Synthetic sequence.
REEIKKEVDRLKKELDENLKRLERDSERLKKELEDNLKRLEEHVRRSKEEAERDAK

SEQ ID NO: 2706 - protein, 58 aa, Artificial Sequence
  Synthetic sequence.
SDLEEVLKRLEDVVRRLEEELRRIHKEHRDVVRRVTEEHKRILEELKRVVERAREKDG

SEQ ID NO: 2707 - protein, 56 aa, Artificial Sequence
  Synthetic sequence.
RDRVTKEVRDLEEELRELLERLRAHVKRSEKKIEENLRRLEKRVEDLKKKIDDRTR

SEQ ID NO: 2708 - protein, 58 aa, Artificial Sequence
  Synthetic sequence.
RELEDIKRKHKKVVDDVREKLKESHRRLKEVIEEARRRLDEVRKKLEKVIREILTSAG

SEQ ID NO: 2709 - protein, 56 aa, Artificial Sequence
  Synthetic sequence.
IEDLKRYVEEVKRDLDDLIRRSEELVRRIKEDLDRALKELEELVRRIKKKLEEDRK

SEQ ID NO: 2710 - protein, 60 aa, Artificial Sequence
  Synthetic sequence.
SELDELRERVERHSRELRRTLEEAKKLVDDHKRTLREVLERIKKRVEDVKRELEKLVRDG

SEQ ID NO: 2711 - protein, 59 aa, Artificial Sequence
  Synthetic sequence.
REELKKIIDELRRVNEEAAKTLDEIIKRLEDVNREVNRTSKEVIDRLRKVLEEAERRTK

SEQ ID NO: 2712 - protein, 60 aa, Artificial Sequence
  Synthetic sequence.
EELDRIRKEVEDHERKLREVVKDIERKVEEHAKRLKKVIEDDERRVKEWKDTLEELIRRG

SEQ ID NO: 2713 - protein, 59 aa, Artificial Sequence
  Synthetic sequence.
KDEVRRVIKELRDVNRKVADALRKVEEKLKRVNDEMNKESKRTLDELDKALEEAERRAR

SEQ ID NO: 2714 - protein, 60 aa, Artificial Sequence
  Synthetic sequence.
DLLRELEARVRKHKRDLEEVLKKIEEEVRRHKKKLEDVLEELRRLVEDLMRELKELLEKG

SEQ ID NO: 2715 - protein, 59 aa, Artificial Sequence
  Synthetic sequence.
REELKRIIDELREVNERVNDESRKVIKELRDANKEADKKVRDIIRRLEDILRKAAEDTR

SEQ ID NO: 2716 - protein, 60 aa, Artificial Sequence
  Synthetic sequence.
KDLERLEKEVKEHKEDLERIVREAEKLVEDHERELEKVLRELEKTVRDVKRELEDLLRRG

SEQ ID NO: 2717 - protein, 59 aa, Artificial Sequence
  Synthetic sequence.
KEEVDRVLDELRKVNKKAADDLERVIRELEDVNRRVNERSREIIETLKRVLDEVREKTR

SEQ ID NO: 2718 - protein, 60 aa, Artificial Sequence
  Synthetic sequence.
DELRELKRKVDEHTRELERILKEIEDRVRRHKEKLDETVKRDKDRVDEWLRRAEELVRRG

SEQ ID NO: 2719 - protein, 59 aa, Artificial Sequence
  Synthetic sequence.
REEVEKIERRLREANKRAADALKKVIDELRRANEEVNRKSEETLKTLDKILEDVERKTR

SEQ ID NO: 2720 - protein, 60 aa, Artificial Sequence
  Synthetic sequence.
DDLERLAEEVKRHSEDLDRIVEEIRDRVRRYKEKLDEVVKEDEKRVREWRDRLEKLVRAG

SEQ ID NO: 2721 - protein, 59 aa, Artificial Sequence
  Synthetic sequence.
KDELDKIITRLEEANRKAAEDLRRVVEELRKAHEEMNRKSEKTKKDLDEVLEEAERRTR

SEQ ID NO: 2722 - protein, 60 aa, Artificial Sequence
  Synthetic sequence.
DDLERLKRRVEEYRRKLEEVLKTIEEEVRRYKKEAEKVLDEDRRRVEDWKRKLDEMVRRG

SEQ ID NO: 2723 - protein, 59 aa, Artificial Sequence
  Synthetic sequence.
EEDVRRIIDELRRVHKRANEDSKRVVDELRDVHRKVNETSEETKKRLDKVLKEAEDRTR

SEQ ID NO: 2724 - protein, 60 aa, Artificial Sequence
  Synthetic sequence.
KKLDDIRREVERLTDKLEKIVKRIKELVDRYRRKLERVLEEDDRRVKEWKRRMEELLRRG

SEQ ID NO: 2725 - protein, 59 aa, Artificial Sequence
  Synthetic sequence.
KEEVDKVLKDLDRALKKAADDLKRVIDELREVHERINRTSERTLTKLDRALEELEKRLR

SEQ ID NO: 2726 - protein, 60 aa, Artificial Sequence
  Synthetic sequence.
KELDEIRELVKRHKDKLKKIVDEVKERVDALKRKLKEILDEDRERVKKWVRDMEELVRRG

SEQ ID NO: 2727 - protein, 59 aa, Artificial Sequence
  Synthetic sequence.
KEDVDRVIRDLERVNEEANRRAKKVIDELRRVLEEAERTLRKTLEDLDRALEELARATK

SEQ ID NO: 2728 - protein, 58 aa, Artificial Sequence
  Synthetic sequence.
DEAEKILEELRKVVRELEEELRRNHEELKRVIEDVERKLRESNRRVEKVIKEVTDEKG

SEQ ID NO: 2729 - protein, 59 aa, Artificial Sequence
  Synthetic sequence.
EDVVRELEKLVEELKRRVTEVVETVARDSERLREELRRIVEESKRLVEELKRRAEEASR

SEQ ID NO: 2730 - protein, 61 aa, Artificial Sequence
  Synthetic sequence.
SELERVVEDLRRAAKKLADDLKRVIEEHRKYARDNKERLKKVLERLKRLAEELKKELERDG

SEQ ID NO: 2731 - protein, 55 aa, Artificial Sequence
  Synthetic sequence.
REVLEDVRRLIEDLERLITELRKENERVIRESEKLSRDIEREVERVIRELEETIR

SEQ ID NO: 2732 - protein, 56 aa, Artificial Sequence
  Synthetic sequence.
KEVEDVKREIDKVLEDARRLLKESDDTLKKILDKARRDLEESDRRLKEILDKVRKD

SEQ ID NO: 2733 - protein, 56 aa, Artificial Sequence
  Synthetic sequence.
FEELKDTVDKLRREIERRITESRRHVEELRRRVEEMLERSERNVREAEKKLEEDKK

SEQ ID NO: 2734 - protein, 57 aa, Artificial Sequence
  Synthetic sequence.
DEVERVEEELKKSDDELRRRMEEVKRALDKDNEDAKRMLDEVKKELEKILRKVEKEV

SEQ ID NO: 2735 - protein, 60 aa, Artificial Sequence
  Synthetic sequence.
KKEVVERLDKLVKEHHERNKRIVEEAKRLVEDSREKTRRIAERAKELVRRLKELVDRLSK

SEQ ID NO: 2736 - protein, 58 aa, Artificial Sequence
  Synthetic sequence.
DRIEDVKRKVKEIKEKVDRLLEESSKKVDDLNKKVRDLLTESNKRIEDIVRELRELAK

SEQ ID NO: 2737 - protein, 58 aa, Artificial Sequence
  Synthetic sequence.
EEAKEVLERLKRILEESRRASEENKKKLEKSHEELKRASDENKRKLERILDELREALR

SEQ ID NO: 2738 - protein, 56 aa, Artificial Sequence
  Synthetic sequence.
SAKEKIDKTLKDIYRKHEEVVRRVEKKHRDIHREHEEVVRRVEEEHRRILDELRKA

SEQ ID NO: 2739 - protein, 56 aa, Artificial Sequence
  Synthetic sequence.
EEEAKKFLDKLDKEVRDSMKRLEDHVRETKKRVEESVRRLEEHVKRTEEEVRETAT

SEQ ID NO: 2740 - protein, 56 aa, Artificial Sequence
  Synthetic sequence.
SVEDEVRRDLKRIYEKHEEAVRRVEERHERSNERLEDVIRKVEDKHREILKKLEDE

SEQ ID NO: 2741 - protein, 56 aa, Artificial Sequence
  Synthetic sequence.
EEDVKRVLDKLDEEVKDSVRELEEHVEKNERDVEEIAKDLERHVEETRKEVDKTAK

SEQ ID NO: 2742 - protein, 56 aa, Artificial Sequence
  Synthetic sequence.
KVEEKVRETLRRIYERHRKIVKEVEEKHRESNERLRREIERVKRKLDEILKKLEEA

SEQ ID NO: 2743 - protein, 56 aa, Artificial Sequence
  Synthetic sequence.
EDRVAEVLKKLKDDVDKSAEELERHVKRNRDEVRKIVEDLDRVLEELRTKVDEEAR

SEQ ID NO: 2744 - protein, 56 aa, Artificial Sequence
  Synthetic sequence.
SVEDKVRESLERIYKKHEKVLRDVERTLKEIHEEHREAVERVRRELERIKRKLEEL

SEQ ID NO: 2745 - protein, 56 aa, Artificial Sequence
  Synthetic sequence.
DKDVERVLKKLDDDVRKSVKELTDVLKRLREEVKRSVEELEDVLRKLDKEVDDTAK

SEQ ID NO: 2746 - protein, 56 aa, Artificial Sequence
  Synthetic sequence.
DVEDRIRKSLEEIYRRHETEVRKIKRKHDESHRRHEKVVREVTEDLERIKRRLEEL

SEQ ID NO: 2747 - protein, 56 aa, Artificial Sequence
  Synthetic sequence.
EEDAKRVLDELEEKVRRSVKKLREHVEENEKRVEDSVEELKRILEELRKAVDETTR

SEQ ID NO: 2748 - protein, 59 aa, Artificial Sequence
  Synthetic sequence.
SKKDEVEKLLKESERHSKKLVEDAKRLSDESKKHVEELVRRAEEELEKSDRDVKKVKDD

SEQ ID NO: 2749 - protein, 59 aa, Artificial Sequence
  Synthetic sequence.
EEVMDRVRRRLERDIRELRKALKRVEDTNEEITRELEKAMKEVKDTSDRILEKLRRARK

SEQ ID NO: 2750 - protein, 60 aa, Artificial Sequence
  Synthetic sequence.
SVKDKLKELLKDSKRNSDRLVERAKELLDRSRKHSKELEDRARKLLEDSRRKVEELERAN

SEQ ID NO: 2751 - protein, 59 aa, Artificial Sequence
  Synthetic sequence.
REVLEKARRDLERDLRENKKALDEVRRTLEEDSRRLREVLEEVKRISTKIIERLREIRR

SEQ ID NO: 2752 - protein, 56 aa, Artificial Sequence
  Synthetic sequence.
SEKEDAEKKLRDILTDLARIVREVEEALKKILDDIRKVSEESKRASDESLKRARDA

SEQ ID NO: 2753 - protein, 56 aa, Artificial Sequence
  Synthetic sequence.
GEELEELLRRLEEAVRRIAERLRKLLKELEEKARRLAEESKKLLEKDKEDVKRAAE

SEQ ID NO: 2754 - protein, 56 aa, Artificial Sequence
  Synthetic sequence.
SEKERIKEESKKSLDDLRRASERSKEELDRILKRIDEASKRSKEESDRSLKEVKDR

SEQ ID NO: 2755 - protein, 56 aa, Artificial Sequence
  Synthetic sequence.
GEELKDVLRELRETNRKLVEDSRKLLEELDRDVERLADESRKLLEDDKRKVREVAR

SEQ ID NO: 2756 - protein, 56 aa, Artificial Sequence
  Synthetic sequence.
SDEERIDELSKKSLEDLKRVSDDSKRKLDDILKKIEDASRESEDKLRRILEKARRD

SEQ ID NO: 2757 - protein, 56 aa, Artificial Sequence
  Synthetic sequence.
GRELERILEELRTDNDRLAKESDKLVKELEEEVRELIKRSETLLEELRKDVEELAK

SEQ ID NO: 2758 - protein, 57 aa, Artificial Sequence
  Synthetic sequence.
DAKERVDDALKKILDDHRRVLKKVEDDHRDSHREHRRVVEEVKRELEKVLKKLRDAG

SEQ ID NO: 2759 - protein, 56 aa, Artificial Sequence
  Synthetic sequence.
KEDLDRMLEKLREIVERSRDKLRRHLEKNKREVDDSKRRLEKMLRDLEKKVRDAER

SEQ ID NO: 2760 - protein, 57 aa, Artificial Sequence
  Synthetic sequence.
DDEERVKRKLEEVLRKHKEVVDEVIERHRRSHKRHRDMLREVDKKHRRILTELEKAG

SEQ ID NO: 2761 - protein, 56 aa, Artificial Sequence
  Synthetic sequence.
VEDLKRVLEDLDREVRESKERARKHVEDNERKVEESKKRADDNLRRLERKIREAAR

SEQ ID NO: 2762 - protein, 57 aa, Artificial Sequence
  Synthetic sequence.
SVEETVDEELKKIHETHKRVVDKVRREHEKSHKKHRDILKRVEEVHRRILTDLERAG

SEQ ID NO: 2763 - protein, 56 aa, Artificial Sequence
  Synthetic sequence.
KKDLDEMLRRLKRKVDESERDLKKHLDDNKRAVEKSREDAERNLKELRDKIREVKR

SEQ ID NO: 2764 - protein, 63 aa, Artificial Sequence
  Synthetic sequence.
REEEEARKVLEELKRDVERNERESKEILDKDKRDVEEWVKELEKMLEESKKLVDDVRKAKKDL

SEQ ID NO: 2765 - protein, 55 aa, Artificial Sequence
  Synthetic sequence.
EELKKAVEDIIRTLREVLEKSRKTLKDSNDRLRRALEKAREDSKRSIRRLREELR

SEQ ID NO: 2766 - protein, 59 aa, Artificial Sequence
  Synthetic sequence.
SVREDAKRLLEELERAVRELVERLKKLIERHRRASEDTRRELEKLLRELEKAVEELKRG

SEQ ID NO: 2767 - protein, 58 aa, Artificial Sequence
  Synthetic sequence.
KALEDVKEALDRILERVKRAIEEARKKLDDVDEHNREVIERVEKEIDRILKDVEDAAR

SEQ ID NO: 2768 - protein, 59 aa, Artificial Sequence
  Synthetic sequence.
SVEEEARELIERLRKLSEDTMRRLTELLKEHERLSRETKKEAERLLDELRKKVDDLTRD

SEQ ID NO: 2769 - protein, 58 aa, Artificial Sequence
  Synthetic sequence.
EVLERVKRELDRILDHNKKVVDEAERALRRVDKHNEDVLREVEKTLERILDKVKESAR

SEQ ID NO: 2770 - protein, 57 aa, Artificial Sequence
  Synthetic sequence.
SVEEKLEKIVRDLERRVRKSEEDLRRMVEEVERTVEKHREELKRVVDTLRKIVRDKG

SEQ ID NO: 2771 - protein, 59 aa, Artificial Sequence
  Synthetic sequence.
EKVARDIKDKVREIIRRNEEVLEEVDRRARELIERLERTIEKSERDVERIIRELRERAK

SEQ ID NO: 2772 - protein, 59 aa, Artificial Sequence
  Synthetic sequence.
SKEEEAEKLVRDLEDSSRKHKDRLRKLVRDLEELVKEHERDLKRIVEELKKLVDDASRS

SEQ ID NO: 2773 - protein, 55 aa, Artificial Sequence
  Synthetic sequence.
KELEEELRRNLKEVREVTEDAKRKLRDILRKVEDASRRVKEMLDKILKRVEEEIR

SEQ ID NO: 2774 - protein, 57 aa, Artificial Sequence
  Synthetic sequence.
KLDEDIRKLLKEALDRNKEMLERLKKTLDEALEKVKKLLEDLRRVNKEVEDELRRAG

SEQ ID NO: 2775 - protein, 59 aa, Artificial Sequence
  Synthetic sequence.
EDVLREVIRRIRKVIEDTDRTWKRLIDEIRKEVKDVLDKARRLIRESEKLMEDIKRRTK

SEQ ID NO: 2776 - protein, 56 aa, Artificial Sequence
  Synthetic sequence.
DMEKRIEKLLKDMLDRVRELHKRVREVNKEVNKRVKELHDEVRKVNEKVNKAVKDR

SEQ ID NO: 2777 - protein, 59 aa, Artificial Sequence
  Synthetic sequence.
EEVLARVIERIRKDVEKVLREAEKHIEESRRLARKVLEELRRHIEENRRLLEEVDRRRR

SEQ ID NO: 2778 - protein, 57 aa, Artificial Sequence
  Synthetic sequence.
EVEKKVEELLKRIEDDNKRVADRSRKLLRELKKRLEDVVRESRELLRRILKKLKEAG

SEQ ID NO: 2779 - protein, 56 aa, Artificial Sequence
  Synthetic sequence.
EDEVADRLRKLRKESEEVVERSDRHLKDLERRIEEMAERSRRHLKRLEDKIREDAR

SEQ ID NO: 2780 - protein, 59 aa, Artificial Sequence
  Synthetic sequence.
SMEDRVREMLRTIKRVIEEAHERSKKILDEDRKVLKAVEDAVRDVLTKIKKLLDDARRR

SEQ ID NO: 2781 - protein, 55 aa, Artificial Sequence
  Synthetic sequence.
EEVVKRAKKLLEEIEKLARESLERLRDNLRKTEKLLKDLLDEAKRLLEEIKETVD

SEQ ID NO: 2782 - protein, 60 aa, Artificial Sequence
  Synthetic sequence.
DIEEEVKKILDEIRERIKKMKRDLERLSKEDEDVLRKVKKDVDEVLKRAEESLRDVKRRG

SEQ ID NO: 2783 - protein, 55 aa, Artificial Sequence
  Synthetic sequence.
EEVLRKLEEILRDIKRKADELRKRYRENIEETERLLEELLRRAEELLRRLDETAR

SEQ ID NO: 2784 - protein, 61 aa, Artificial Sequence
  Synthetic sequence.
SEAEKLLEDIRRIIKEVKENVERSLEKIKRLIEELEKNARDLVRRIRKLIEDLERKVRRDG

SEQ ID NO: 2785 - protein, 59 aa, Artificial Sequence
  Synthetic sequence.
EKVIRDIEKLIEDLKRISEKANEDNKRLIDDMRRISKEVARTIKELIERLRKIVEEARK

SEQ ID NO: 2786 - protein, 61 aa, Artificial Sequence
  Synthetic sequence.
SEAEELLERIKKLIEDLKRDAERLLREIEEMIKDIRRHVEEDLRRLREVIKEIKRLVDERG

SEQ ID NO: 2787 - protein, 59 aa, Artificial Sequence
  Synthetic sequence.
EEVEREIRRLIEEMKRISEEVRKEIKRLIDELEEIVRRAKEALKKLNEELKRIVDEAKR

SEQ ID NO: 2788 - protein, 59 aa, Artificial Sequence
  Synthetic sequence.
SKVEEVLKRLERLIRELKRLMDEVREDNREVLERLERYAERNERENRELLKKLEDVARR

SEQ ID NO: 2789 - protein, 56 aa, Artificial Sequence
  Synthetic sequence.
KEELDKMLKTAERVLREIEKDIEKLDRDLKRVVERIRDRSRRLDEAAEEIVRRIED

SEQ ID NO: 2790 - protein, 59 aa, Artificial Sequence
  Synthetic sequence.
SKMEEVLKRLEKLLRELEEYVERNERENRKLLEELEDYVRRNEKRNKEILEELRDVVRR

SEQ ID NO: 2791 - protein, 56 aa, Artificial Sequence
  Synthetic sequence.
DEELRKALERLRRVVEKVEDISRELDDRLRRVVEKAEEISRRLDEEIKEVVDRAEK

SEQ ID NO: 2792 - protein, 59 aa, Artificial Sequence
  Synthetic sequence.
SKVEKVLDDMRRIIEEAERLLEEVKRRHDEIIERVKRYAEENRRRNEELIEDLKRVAEK

SEQ ID NO: 2793 - protein, 56 aa, Artificial Sequence
  Synthetic sequence.
KDDVRRLLEELRKVVEDVKRLSKKMNDRIEKIAKEIEEESERLDRTIAEIVKEIEK

SEQ ID NO: 2794 - protein, 59 aa, Artificial Sequence
  Synthetic sequence.
DEVEKVLEELRRLLKEDEDIVRELLKRLKELLEDIDRIAKETEKEWRKILREIEELRRK

SEQ ID NO: 2795 - protein, 59 aa, Artificial Sequence
  Synthetic sequence.
EDAEREVDRVVRTIEESTKDAREKVKRMADEIERIIKEVEDLNRKLVEEIERVIREVER

SEQ ID NO: 2796 - protein, 56 aa, Artificial Sequence
  Synthetic sequence.
DSEETLRELVKTIEDSSRKVKKRNEELARELRRRIEEAREANDRLVETIRKEIREL

SEQ ID NO: 2797 - protein, 56 aa, Artificial Sequence
  Synthetic sequence.
REELEKTARKLIEDDEKKARDTEREWEELIRDIERLVRESLEAWKRLREEIRETVR

SEQ ID NO: 2798 - protein, 56 aa, Artificial Sequence
  Synthetic sequence.
KSEEELRKLVRELEELIERMERTNEKLLRELKEVLDRARERNEELVRRLEDLIRRL

SEQ ID NO: 2799 - protein, 56 aa, Artificial Sequence
  Synthetic sequence.
EEELRKEAEDLIREIEEKVRRSKRNLEELIREIRELVERSEDEWRKLIKRIADAVK

SEQ ID NO: 2800 - protein, 56 aa, Artificial Sequence
  Synthetic sequence.
SSEETLERLLREIERVLEEARKRNEDLVRKIREVIKEALERNKRMLEEIKKEIDRL

SEQ ID NO: 2801 - protein, 56 aa, Artificial Sequence
  Synthetic sequence.
SEELLRTAKRLLEDIERIVRETLKKWRDLEREIRKLVRESTENLKRIIEEIRERAR

SEQ ID NO: 2802 - protein, 55 aa, Artificial Sequence
  Synthetic sequence.
SKVDEVIRDLARLLDELRRHVDDSVRRMDEVVKRSTREADELAKRLDELVKEVEK

SEQ ID NO: 2803 - protein, 56 aa, Artificial Sequence
  Synthetic sequence.
KEKIDRIIRELERILEEAKKKHEDVLRRLEDSLRRVAELLKAALDRLREIVDRLRR

SEQ ID NO: 2804 - protein, 55 aa, Artificial Sequence
  Synthetic sequence.
SKADDVIRKLRELLEELRTHVEKSIRDLRKMLEDSTRHAKRSIEELERLLEEVRK

SEQ ID NO: 2805 - protein, 56 aa, Artificial Sequence
  Synthetic sequence.
EEKLKDLIRKLRDILRRAAEAHKKLIDDARESLERAKREHEKLIDRLKKILEELER

SEQ ID NO: 2806 - protein, 55 aa, Artificial Sequence
  Synthetic sequence.
SKVEEVVRTLDELLKRLEEHVKESIRRIKKVIDDSNREADELIRDIDRLLKELEK

SEQ ID NO: 2807 - protein, 56 aa, Artificial Sequence
  Synthetic sequence.
KDRVERIIRELRRILEEIRDLHRKLEEELRRSLKEVEDRLRELLKKLEDILRELRR

SEQ ID NO: 2808 - protein, 59 aa, Artificial Sequence
  Synthetic sequence.
DEVEDLLRKLKDTIRRLKAHADRDLKKLEEILEKLRRHVEKNLRDLERILKELKDLSRT

SEQ ID NO: 2809 - protein, 59 aa, Artificial Sequence
  Synthetic sequence.
EEVAERVRRVIKELRKLLEEIARALEDVNKKAKEINDKADEDSKRVNDELKRIIKEIRD

SEQ ID NO: 2810 - protein, 60 aa, Artificial Sequence
  Synthetic sequence.
SEVDELRRRAEESSKKIRKIAEELTKRLKDLLETIRRLMRKIEEDMKRTSEEIKDLIRRG

SEQ ID NO: 2811 - protein, 59 aa, Artificial Sequence
  Synthetic sequence.
DRLRDVVKKLHKKNKDILDEIRDIVRRLKEEVDTILKEIKERLEELHKNNERLLREAKR

SEQ ID NO: 2812 - protein, 60 aa, Artificial Sequence
  Synthetic sequence.
SAKEKLEDLLRKLKRILDELEKTSREMKERVERIIRELEKTVREVHERIKRLIDEALKRN

SEQ ID NO: 2813 - protein, 55 aa, Artificial Sequence
  Synthetic sequence.
EELKKELEDLLRKIEKLIKESEEKWRRLLEEIKREIERLRETYAEILRDVKRRDK

SEQ ID NO: 2814 - protein, 60 aa, Artificial Sequence
  Synthetic sequence.
SAEETVRKLLEEIKEIIKRMEDRVREVLEENRKSIEDLEERVRRLHEEVERIIREALEDL

SEQ ID NO: 2815 - protein, 55 aa, Artificial Sequence
  Synthetic sequence.
DEVKRELKRILEEIEKLIEELLRRMKESNKKIRKLAEDLTREYKRLLDEIRKRRK

SEQ ID NO: 2816 - protein, 55 aa, Artificial Sequence
  Synthetic sequence.
REVEEVVKRAEEVIRRLEKEVEDIVRRVAKHLKDNEDHARRSVERLRRDIEELKK

SEQ ID NO: 2817 - protein, 56 aa, Artificial Sequence
  Synthetic sequence.
DELVKEVKKKIDDVLKKAEDLARKLKKEHDEVVARITEAHDEVKKRVEKVLKELED

SEQ ID NO: 2818 - protein, 55 aa, Artificial Sequence
  Synthetic sequence.
SKVEDVIREIRELIKRLEKHVKDSVREVRKHIEDNKRKVEKLVKEVEDVIRELRK

SEQ ID NO: 2819 - protein, 56 aa, Artificial Sequence
  Synthetic sequence.
RELAEELRRRLDEVLEKATRLHRELEKRHDDVLREAEKRLRDLKREIDKVLDDLRR

SEQ ID NO: 2820 - protein, 56 aa, Artificial Sequence
  Synthetic sequence.
EEVERVVKELRDHLAETKKKIDEIIKRLDDHIEENRERVERMVEELRRILKEIRDS

SEQ ID NO: 2821 - protein, 56 aa, Artificial Sequence
  Synthetic sequence.
REVVDEVRKEHRDVLREAEELIKRVEKDHEKSHREVKKLIEDVERRLREVLKELRD

SEQ ID NO: 2822 - protein, 56 aa, Artificial Sequence
  Synthetic sequence.
KEAEDTIRKVSKHIEDNKRKVEEMIKKLKEHLKETEEKIRRIVKKVRDEVRKLEEN

SEQ ID NO: 2823 - protein, 56 aa, Artificial Sequence
  Synthetic sequence.
EKLVRDLKRRHKESHDEARKLIEEVRREHEEVLKRAEDLIRELDKRLKEVLDKLRK

SEQ ID NO: 2824 - protein, 57 aa, Artificial Sequence
  Synthetic sequence.
SEAEEVVRRVEKHIRDTEKKIRDIVRRVKEEVDRNSERVREMVERVRKEIEELERAQ

SEQ ID NO: 2825 - protein, 56 aa, Artificial Sequence
  Synthetic sequence.
KEVVDELKKRHREVLEEARRLIEELKERAERSHRESKKLIDELREEIRRVLEERRR

SEQ ID NO: 2826 - protein, 57 aa, Artificial Sequence
  Synthetic sequence.
SEVEDIVTKLRDKVERHREEVKRIIDTLKKLVEEHKRRVDDEVKKLDDTVKRLREAN

SEQ ID NO: 2827 - protein, 59 aa, Artificial Sequence
  Synthetic sequence.
KRVDDLLREVEERLERSNREARKLLEEVKREMEESHRRLKKLLDEVREKVRRVVEELRK

SEQ ID NO: 2828 - protein, 60 aa, Artificial Sequence
  Synthetic sequence.
KVEELVKEVDERIKKVLDDLRRALEDVRKKAEDSVRRMEELSEKVKRDLDRVIAKAEEKG

SEQ ID NO: 2829 - protein, 55 aa, Artificial Sequence
  Synthetic sequence.
EEVVKRLEEILRRLKETIDRVLERLKRRVEDHDRKVEKRVRENEKAVEDLKRRID

SEQ ID NO: 2830 - protein, 60 aa, Artificial Sequence
  Synthetic sequence.
SVEEVLEEARKDIDRLIRRMEEISERAKEKIERLIDELRKISEEANKKNEEVLRELREKG

SEQ ID NO: 2831 - protein, 56 aa, Artificial Sequence
  Synthetic sequence.
REDIKREVDRLLEEIRRLIERLRENVKKLLDEIRKLIEELDENVKRSLKKLRDDIR

SEQ ID NO: 2832 - protein, 60 aa, Artificial Sequence
  Synthetic sequence.
SLDDILREVRRTSRELNEESRRIVDRAKRESEELLKELETILRDATRRLDDLLRKLDEKR

SEQ ID NO: 2833 - protein, 60 aa, Artificial Sequence
  Synthetic sequence.
RETVVKELEDKVREHLRTNRELIERLEKEMRDHLREIKRKIEELERRIRKLVEEVKRRID

SEQ ID NO: 2834 - protein, 61 aa, Artificial Sequence
  Synthetic sequence.
DELEDLVRKAEKLVRESEKKIKEIVDDARRLIEDSEREIREIVKKLRELSKRVEEELRRDG

SEQ ID NO: 2835 - protein, 56 aa, Artificial Sequence
  Synthetic sequence.
KDLLKELRDKSKRVLEKLRRLLEEINKRSRDVLEKLKRLADEVRESNREVLDRARK

SEQ ID NO: 2836 - protein, 56 aa, Artificial Sequence
  Synthetic sequence.
RELEEIVKDAERLVKKDTEDIRDKVRRAEEVVKKDTEDLEESVKRVKDKVKELEDA

SEQ ID NO: 2837 - protein, 56 aa, Artificial Sequence
  Synthetic sequence.
EELLREIEERIKRSLDESRKLVREIEKKVDESNERSRKLVEDVEREIEEVLKRLAD

SEQ ID NO: 2838 - protein, 59 aa, Artificial Sequence
  Synthetic sequence.
SSEDILREVKKLLDDSLDKLRRLIEKIKEDLDRSVDRHRKLSEEIRRRHERVREAVERR

SEQ ID NO: 2839 - protein, 55 aa, Artificial Sequence
  Synthetic sequence.
EDVARKLRELVREHSKEVEDKVRRAARLVEEHTERSDRVADKLRKHIEETKKRID

SEQ ID NO: 2840 - protein, 59 aa, Artificial Sequence
  Synthetic sequence.
SKEEILKEITDRVRESRKRTKKLLDDVREELERSHRRLEKLIREVEKRLREVKRKVDES

SEQ ID NO: 2841 - protein, 53 aa, Artificial Sequence
  Synthetic sequence.
VVRDLRRLVKEDTDRARKVVRELEREVERDKEEVERIVDKAEKKVRELEERIR

SEQ ID NO: 2842 - protein, 56 aa, Artificial Sequence
  Synthetic sequence.
DEVEKAVADLRRLNEEHTRDIDKAARDLERLVKKHTDEVRKLVRDLEKLVKDLKDA

SEQ ID NO: 2843 - protein, 59 aa, Artificial Sequence
  Synthetic sequence.
EKLEELLKEVEETTRRSLRRLEELLRKVERAVRESHKELKKLLDEVREKVKKVLEELRR

SEQ ID NO: 2844 - protein, 56 aa, Artificial Sequence
  Synthetic sequence.
DEVEKAVRDLEKLNEEHTRRVEKVVTDLRDLVRRHTEEVRKLVDELRELVERLRRA

SEQ ID NO: 2845 - protein, 59 aa, Artificial Sequence
  Synthetic sequence.
KKLEKLLDDVRKTTETSHERLKRLLEEVEERVRRSHEELKDLLRKVKELVEKVLRELKE

SEQ ID NO: 2846 - protein, 56 aa, Artificial Sequence
  Synthetic sequence.
SEVEKLAKELRDLVREHTKRVRELIDELKKRVEDHTRKVEEIVKRLKKLVDDLRDA

SEQ ID NO: 2847 - protein, 59 aa, Artificial Sequence
  Synthetic sequence.
KKLEKLLKEVRELVKRSHDELKKLLDRVREAVEKSKRRLEKLLDTVRRLLEKVVRDLER

SEQ ID NO: 2848 - protein, 56 aa, Artificial Sequence
  Synthetic sequence.
SEAEKLVEELRRLNERHTRRVEEVVRRLDEEVKKHRKDVRELVRELRKLVDELRKA

SEQ ID NO: 2849 - protein, 59 aa, Artificial Sequence
  Synthetic sequence.
EKLEELLREVEETTEKSHRDLKRLLDRVREKVEDSHKELEELLKEAKDRVDRVLEELRR

SEQ ID NO: 2850 - protein, 60 aa, Artificial Sequence
  Synthetic sequence.
SLEDKVRDDVRKLLAEAKKVADDLRKVVEDHRKTVEDVIREIRRRVEEHLKKLKELIDAG

SEQ ID NO: 2851 - protein, 56 aa, Artificial Sequence
  Synthetic sequence.
DRVLKRIEEEIRRLLKELREIVKDLERLDRELTDELRKLVEEVRRLSETVLDEARK

SEQ ID NO: 2852 - protein, 59 aa, Artificial Sequence
  Synthetic sequence.
SLDEDVAEKMKELEKENKDLLDTIRRLIEELEKHARELLKRIEDLIRELTEDAKRLEDS

SEQ ID NO: 2853 - protein, 56 aa, Artificial Sequence
  Synthetic sequence.
RRILEEIRRTNEELTERVRDLVEEMRKTSEELLKEVRKIADEVRRTVEEALKRLEK

SEQ ID NO: 2854 - protein, 61 aa, Artificial Sequence
  Synthetic sequence.
DEAEKILRDAKRLVEELSKKLEDNLREIKEVIDRLSEELDRNLKEHRDLIRKLEEDMDRKG

SEQ ID NO: 2855 - protein, 55 aa, Artificial Sequence
  Synthetic sequence.
EERAREVEEDIKRAEEEVERSIRESKKRTRDAEREVRESKKKSEDHIREVEKRIR

SEQ ID NO: 2856 - protein, 61 aa, Artificial Sequence
  Synthetic sequence.
SELEELLKELKEIVERSADHLRRSNDDLRKIIEEVTKTLEKILEDLKRIVEEVVDRARKKV

SEQ ID NO: 2857 - protein, 56 aa, Artificial Sequence
  Synthetic sequence.
EEELKKKLKELKDRAKETNERHRRDVERLMEKLRRDLERLDREVKDLEKKLREEEK

SEQ ID NO: 2858 - protein, 56 aa, Artificial Sequence
  Synthetic sequence.
SDREEIKRRVEEEAKKSRENLKETLREVDERVRDSERNLKRHHEEVKKAIDDLRRS

SEQ ID NO: 2859 - protein, 56 aa, Artificial Sequence
  Synthetic sequence.
KRILDDVRRLLEELKERYRRIVDEIKKLLERLKEAYKRNLDRVRELIERIEKEIRD

SEQ ID NO: 2860 - protein, 59 aa, Artificial Sequence
  Synthetic sequence.
SELEEVKERIERLVRRHKEELEKVRREIEREVKKHEKDLEDLERRSREHIETAERLLAE

SEQ ID NO: 2861 - protein, 56 aa, Artificial Sequence
  Synthetic sequence.
DRILEEARRLLDRLREENEKVLKEAEDMLKRLEDENRKMLEENEKLLKELKKEVDK

SEQ ID NO: 2862 - protein, 59 aa, Artificial Sequence
  Synthetic sequence.
SEVEEVLKTIEKKDEEHKRELERVKEEVDEDAKRHRERLKKVDRDVKEEIKRLRKLLED

SEQ ID NO: 2863 - protein, 56 aa, Artificial Sequence
  Synthetic sequence.
EKILEEIKRRLDELRKRNEDLLRRVKELLDELREENRRLLEDAKRLLEEVLKRARD

SEQ ID NO: 2864 - protein, 59 aa, Artificial Sequence
  Synthetic sequence.
SELEEVEKKVREDARRHKEELRRVEEEVKRNAEKHRDELRRVREDIERKIRTLRELLKE

SEQ ID NO: 2865 - protein, 56 aa, Artificial Sequence
  Synthetic sequence.
EEILRRVKKLLDELRDENRRLLERVRELLERLREENERVLREVKKLLDEVKREAEK

SEQ ID NO: 2866 - protein, 59 aa, Artificial Sequence
  Synthetic sequence.
SEREKLLKELKDNLDESRRRVEELLKRIKENLEEVKDRAKKTLDDLKRDIEELRKLVER

SEQ ID NO: 2867 - protein, 59 aa, Artificial Sequence
  Synthetic sequence.
EDVKRRLRDLSRRLAREHEKVIEKLRRLSDELEKIHREIEERLERLSDELRKEADKARK

SEQ ID NO: 2868 - protein, 61 aa, Artificial Sequence
  Synthetic sequence.
DEARELLKRLREINEKLKKDVEEIERRLEKYNRDVKRKLDDSIRELKEKLDRLRERIRDEG

SEQ ID NO: 2869 - protein, 59 aa, Artificial Sequence
  Synthetic sequence.
EDVRRAVEELVRRHKDTVKKIEESVRRLVEEHKRTVKEALDRSRRIAEEIKRVLDEAAR

SEQ ID NO: 2870 - protein, 60 aa, Artificial Sequence
  Synthetic sequence.
SEEEKLLTELKKLNDDLERRVRKSLDEIRRYNEKMREDVRRSDREVREEKKRLDEKLKKD

SEQ ID NO: 2871 - protein, 59 aa, Artificial Sequence
  Synthetic sequence.
EEALKKVRELVERHKRTVDEALEKSERLLREHERTVDEVLDRSRRAVEEVKKTLDDARK

SEQ ID NO: 2872 - protein, 60 aa, Artificial Sequence
  Synthetic sequence.
REAEEVRRRIEESHEEVRRRARKDERDLEESHKRLEEKAKELKDELRKILKDIDDLAKSN

SEQ ID NO: 2873 - protein, 59 aa, Artificial Sequence
  Synthetic sequence.
EDVLRDIEKLVRDNEEALDRILKRTKELVDRNLEAIDRILKEVEELVRRIKELLDRAKK

SEQ ID NO: 2874 - protein, 61 aa, Artificial Sequence
  Synthetic sequence.
SEVEEVLERLKRKLDEIERESRESAKKIRREIERIEKEARDSLRRLKKLIKEIEDRVRRDG

SEQ ID NO: 2875 - protein, 56 aa, Artificial Sequence
  Synthetic sequence.
REELEKLLKRLEEVVRESEKEIEDLLRRVRELIERIKREHEKILKEAEEVIRRVKK

SEQ ID NO: 2876 - protein, 61 aa, Artificial Sequence
  Synthetic sequence.
REVEEVLRELEEHIERSKRKSEESLKEIRRRIEEIEERSRRSLTELKKRIDDIKRRVEKDG

SEQ ID NO: 2877 - protein, 56 aa, Artificial Sequence
  Synthetic sequence.
KEDLKRLLDKVTEVHKESAKEIRKLLDEARKVIEDSLRAIRDILRKIKETIDRDKT

SEQ ID NO: 2878 - protein, 61 aa, Artificial Sequence
  Synthetic sequence.
EEVERVLEKLKRHIDDSRRKSKRSVDEIRKHIERSKRRSEESVERVKRELERIEEKVRREG

SEQ ID NO: 2879 - protein, 56 aa, Artificial Sequence
  Synthetic sequence.
EEELKKLLEEAEKVHRDSKRELRKLVKEARDVHRESMETVKRLLDELEREIRRAET

SEQ ID NO: 2880 - protein, 61 aa, Artificial Sequence
  Synthetic sequence.
SEDEEALKKLKEHIDRSREESKRSLDRVKREIERIREEIERDLRRLREELKKIEDRLRRDG

SEQ ID NO: 2881 - protein, 56 aa, Artificial Sequence
  Synthetic sequence.
EDELRKLLEDAKRVHKRSKDELKRLLEEAEKVIRDAKRKIKKLLDELRKVLEDARR

SEQ ID NO: 2882 - protein, 61 aa, Artificial Sequence
  Synthetic sequence.
DEVRRVLEELKEHIKRSEKRVRENEEEIRRHIEKSKRDSDESLKELARLIKKIEDDVRREG

SEQ ID NO: 2883 - protein, 56 aa, Artificial Sequence
  Synthetic sequence.
EEELKKILDEAEERHRRIEERHKDLLRKAEEVHRDSLRRLREILRRAEEVIRREKT

SEQ ID NO: 2884 - protein, 61 aa, Artificial Sequence
  Synthetic sequence.
KEVEEDLERLKKHTEDTRKRARDNLERIKEELEEIRKESEDSARKVRRDIEEIKRRVDETG

SEQ ID NO: 2885 - protein, 56 aa, Artificial Sequence
  Synthetic sequence.
ERELEKLLKEHEKTIRDIEEEHRRLLKELKDVVRESSRELEELLKEAEDVIRRVKK

SEQ ID NO: 2886 - protein, 61 aa, Artificial Sequence
  Synthetic sequence.
DEVREALKRLEDETRKNKKESDKSLERLKEESKKNKDESDKSVKNIEDKIKKLKEDLDRDG

SEQ ID NO: 2887 - protein, 59 aa, Artificial Sequence
  Synthetic sequence.
EEVKRALDELVKDHRRVLEESARRIDEIVERHRRLLDDSLRRIAELVRRVEETLREERR

SEQ ID NO: 2888 - protein, 60 aa, Artificial Sequence
  Synthetic sequence.
DEVEKALKELEDDLRELKKRSEESLKNVEEEIKRAKKELDESLDNLRKKIEELKRRLEKD

SEQ ID NO: 2889 - protein, 59 aa, Artificial Sequence
  Synthetic sequence.
EEVLRKLETIVRKIREELDRSKKKLEKLIEEAKRELERVLKEHEDLVKRVRDVLEDARR

SEQ ID NO: 2890 - protein, 61 aa, Artificial Sequence
  Synthetic sequence.
DDVRETLTRLRKETERNKRESDKSLENLKRKSEDNKRKIEESLKNMKRRIDEVKRRAEKDG

SEQ ID NO: 2891 - protein, 59 aa, Artificial Sequence
  Synthetic sequence.
EEVKKELDEILRRHKEVLRESERRLEKLLRDHRRRLEEALEEHKKLIDEAEETLKRIRD

SEQ ID NO: 2892 - protein, 61 aa, Artificial Sequence
  Synthetic sequence.
SEVEKALKELEDKTRKNKEDSERSLDKLRKDIEELRKKAERSIRNMRDKLRKLRDDVRKEG

SEQ ID NO: 2893 - protein, 59 aa, Artificial Sequence
  Synthetic sequence.
EEARRKLKELVDRHEEVLRRSLERLKRLVEEVRRTLEKILRDHERLLDELRRDLEKDRK

SEQ ID NO: 2894 - protein, 61 aa, Artificial Sequence
  Synthetic sequence.
DEVEERLRELEETTKENKRRAERSLENVRKKSRDNDKRIKESLDNIRREIKRLRDKVRKDG

SEQ ID NO: 2895 - protein, 59 aa, Artificial Sequence
  Synthetic sequence.
REVLEKLKEIVERHEEVLRRIKKKHEDLVREHRKRLEEARKRHEKLVREAEKTLDDVRR

SEQ ID NO: 2896 - protein, 59 aa, Artificial Sequence
  Synthetic sequence.
EEVERILDELRRRNEDMRRRSEENERELRKRNTELRKKVEDSLRRLREDLKRIKKLVEE

SEQ ID NO: 2897 - protein, 59 aa, Artificial Sequence
  Synthetic sequence.
EEVTKALEELVRRHRKTLEESLRKAEKVLRDHKESLERSEKKLKELMEEVKKLLDDARR

SEQ ID NO: 2898 - protein, 60 aa, Artificial Sequence
  Synthetic sequence.
SREDEIRKRLEESLERVKKIIEDIKRRIDESLERIKELLKEIDERSKRSLEKIRRKIERE

SEQ ID NO: 2899 - protein, 56 aa, Artificial Sequence
  Synthetic sequence.
EELLRRARKAHEDLLREVKRRIERAEEEHKRLLDELRKVVERSKTEIKKLLDELRK

SEQ ID NO: 2900 - protein, 63 aa, Artificial Sequence
  Synthetic sequence.
SRVEDVERKLRRKLEELKEDIERLREESRRSLEELERDSDRNRRESEDSLRRVEERIRRIKDD

SEQ ID NO: 2901 - protein, 56 aa, Artificial Sequence
  Synthetic sequence.
RETLRRVEREIERLLRELEETLKRSEEELKRIVDEHRKLLERSKRELEKLVDEVRK

SEQ ID NO: 2902 - protein, 61 aa, Artificial Sequence
  Synthetic sequence.
REIEEVLKRVEKVVRDDSRRNKEVLTRNRRKVERWKETLEDVLRRVEKAVRELRKDAEDRL

SEQ ID NO: 2903 - protein, 59 aa, Artificial Sequence
  Synthetic sequence.
EDILREVEKKLKELLDRSRELSDEVRKRSDESNKEIKKELDRARDELRRLLERIEEELN

SEQ ID NO: 2904 - protein, 61 aa, Artificial Sequence
  Synthetic sequence.
DEIEKVLEEVERVVEEDERRNRKVLEENKRLVDEWDRRVREVLKDVKRRVDELDTRARRDL

SEQ ID NO: 2905 - protein, 59 aa, Artificial Sequence
  Synthetic sequence.
KEILDRVKERLERLLEESRELSERVKREIEETNERIARELERVMETLKKLLKDIEDELK

SEQ ID NO: 2906 - protein, 61 aa, Artificial Sequence
  Synthetic sequence.
KEAEDVLKKVDTDVTRDDEDNRKLLEDNRRSVEEDERRNRRVLEEVEKRVRDLAERVKRDL

SEQ ID NO: 2907 - protein, 59 aa, Artificial Sequence
  Synthetic sequence.
REILKRVTEELERLLAESERLSEEAEERVRRSDDTSRRLSEEVRKELEELLRRIEERLR

SEQ ID NO: 2908 - protein, 61 aa, Artificial Sequence
  Synthetic sequence.
REVEEVLKRVKETVEKDREDNTRVLERNRESVKEDDDRNRKVLKRVRDEVRKLLEEAKRDL

SEQ ID NO: 2909 - protein, 59 aa, Artificial Sequence
  Synthetic sequence.
EEILKRIEEELKRLLEESRELSKEVEDRVRKSDKKSRDLSEKVKKDLKELTDEIRKRLK

SEQ ID NO: 2910 - protein, 61 aa, Artificial Sequence
  Synthetic sequence.
SEIEDILERVREEVDKDRRKNDEVLRENERLVKKDDDDNAKADEDVRRKVTELEKRARREL

SEQ ID NO: 2911 - protein, 59 aa, Artificial Sequence
  Synthetic sequence.
EEILKRVAKRLKELLEESKRLSDEVTKRSRDTDEESERLSRKVDKEVKDLLKEIERELE

SEQ ID NO: 2912 - protein, 61 aa, Artificial Sequence
  Synthetic sequence.
SEVEEMEERLRKLDEDSRRLSEDVKRRLDKINKEIKDLLDDVRRKLKEMLDKLTKDLRDLK

SEQ ID NO: 2913 - protein, 62 aa, Artificial Sequence
  Synthetic sequence.
KRAEDKVRDVLRDNERTLKKDEDDNKRVLDEDEKRLREWEERARRVLEEVRRRLKELVEEVR

SEQ ID NO: 2914 - protein, 61 aa, Artificial Sequence
  Synthetic sequence.
REVDKAREDLRRVDDELRKILERVRRELEKLDKESEERSRRLARDLDRLLEELERDLKDNK

SEQ ID NO: 2915 - protein, 62 aa, Artificial Sequence
  Synthetic sequence.
REVERKVREVLKDNERTLRELRDTIRKVLEDNDKTLREDVRRNEEVLRRVDETLRELKKRVE

SEQ ID NO: 2916 - protein, 60 aa, Artificial Sequence
  Synthetic sequence.
SEVDKVKEDLDEVDKDSRRISREMEERLKELDKRSREISDRVVRELEKILKEIEDLLRDL

SEQ ID NO: 2917 - protein, 62 aa, Artificial Sequence
  Synthetic sequence.
KEARDKIRRVLEDNERTLREDIEDNRKVLEDNDKRLKDDERKNREVLKRVDETLKELDERVK

SEQ ID NO: 2918 - protein, 61 aa, Artificial Sequence
  Synthetic sequence.
DELRELEERLRRSVEEIKRDLKRIHDENREAVERSERKSKKILEELKREVEDVKRELREKL

SEQ ID NO: 2919 - protein, 59 aa, Artificial Sequence
  Synthetic sequence.
EKLVREIERRVRKMEEDVRELVKTIEKRSRDVIKKSEDILKRIKERVEELEKRVRDAVR

SEQ ID NO: 2920 - protein, 61 aa, Artificial Sequence
  Synthetic sequence.
DELRELLETLRDEVRKDDKRNEDIHRENRKRVEESRRRSEKILRDLREVVKRLEDELRKKL

SEQ ID NO: 2921 - protein, 59 aa, Artificial Sequence
  Synthetic sequence.
EELLKRIEKRVRDMIRRSRTLSARLEDLSRELDERSKRVVEDLKRRIDEAIKELEKEVE

SEQ ID NO: 2922 - protein, 59 aa, Artificial Sequence
  Synthetic sequence.
DETEEVAKKIKELIERSRELVKKVKEKIDRLNEEIEKLVREVEKTIKELTDRIEELRKR

SEQ ID NO: 2923 - protein, 58 aa, Artificial Sequence
  Synthetic sequence.
EEMKKLLDDLRKAVDESRRRSEEILKENRKRVEKWREDLRRLLEKVKEDLDRIRERLR

SEQ ID NO: 2924 - protein, 59 aa, Artificial Sequence
  Synthetic sequence.
SEVEEAKKTLDELNRDIAKKVEDVEREIKRMIEESERLTREVEERIRRLTKKIEDLRRG

SEQ ID NO: 2925 - protein, 58 aa, Artificial Sequence
  Synthetic sequence.
ERVKKILEENKRDAERWKRRLKKLLDDVRRLVKEDDDRNEELLREVTERVRRIEEKLD

SEQ ID NO: 2926 - protein, 59 aa, Artificial Sequence
  Synthetic sequence.
SEVEKVKEELKKLNKEIADSSDEVDKDIERLIRESRKLTEDVRREIKRLIERIDELRRA

SEQ ID NO: 2927 - protein, 58 aa, Artificial Sequence
  Synthetic sequence.
EEAKRILDENKKLVREWEEKSRAVLEKVKKLVKRDDDENKKLLDDVKKLVDEMRERAR

SEQ ID NO: 2928 - protein, 60 aa, Artificial Sequence
  Synthetic sequence.
DLEREIRKIIEEAKKELERVNDEIRRIIEEMRRRSEESNKRIREIIERARRRLEELIRRG

SEQ ID NO: 2929 - protein, 58 aa, Artificial Sequence
  Synthetic sequence.
EEVKKLLTDLKRLVDEIRKHNKRLLDELRKEVEKSERENRRLLEEVRRTVDEMRERAR

SEQ ID NO: 2930 - protein, 60 aa, Artificial Sequence
  Synthetic sequence.
SAEDKARKIAEDAKKEAEDSNRDAHRIAEEAKRRARKINEEARELIERAKKELTRLRREG

SEQ ID NO: 2931 - protein, 58 aa, Artificial Sequence
  Synthetic sequence.
EEAKKLLDELRKAAEDIRRNNEEALKDLRRAAEEIRRHNEELLRRAREAAKKARDDAE

SEQ ID NO: 2932 - protein, 60 aa, Artificial Sequence
  Synthetic sequence.
SAEEAVKRVEELVRRVKERNKRLVEDVEREVRRVKKRSEETNRRVKKLVERVKEDLDKRV

SEQ ID NO: 2933 - protein, 59 aa, Artificial Sequence
  Synthetic sequence.
KDKLEEVLREVRDRLADVERKSERVVEEVERLLREVVRKNEDVLRRIEELLRDVEEKAR

SEQ ID NO: 2934 - protein, 60 aa, Artificial Sequence
  Synthetic sequence.
SVEELVREVEKRARKVKRDSDKTNKDSTKLVKEVKDRSRRTNEEVKKEVERVKEDLEKRV

SEQ ID NO: 2935 - protein, 59 aa, Artificial Sequence
  Synthetic sequence.
EDKLKEVVDRIRKLLEDVKRENEDVKRRSRELAERVREENDKVSKEIRELLEEVERRAK

SEQ ID NO: 2936 - protein, 60 aa, Artificial Sequence
  Synthetic sequence.
SAEEMREEVKRLVDKNRKDNREVEKKSTRLAEDVKRKSEETNRKIREEVERVKKDLEERV

SEQ ID NO: 2937 - protein, 59 aa, Artificial Sequence
  Synthetic sequence.
EEKLKEVLDEVRRLIKEINDHSREVSKTSEKLLRDVLKKNEDVLREIERLLEEVRRRIK

SEQ ID NO: 2938 - protein, 60 aa, Artificial Sequence
  Synthetic sequence.
REVEEITKEIREMNEESKRLLEEVREKIERLSRESNRLLEDSKREIDEAIRRVEELLDKE

SEQ ID NO: 2939 - protein, 56 aa, Artificial Sequence
  Synthetic sequence.
KDIITEIERTNDETEERVRDIERRIKESSDRNDKRAKEISERIKRLLEEVDKKVKE

SEQ ID NO: 2940 - protein, 60 aa, Artificial Sequence
  Synthetic sequence.
DLEELVKEVERRVRRNKTETDRLVEEVERSVRENRRRIEELVRRVEKEVRRIKEDLKRKL

SEQ ID NO: 2941 - protein, 59 aa, Artificial Sequence
  Synthetic sequence.
KDVLEKVAREIKRLIEESNRLDKEVEDEVREMSKDVNRELERIAEEIEKVLRDVERKLR

SEQ ID NO: 2942 - protein, 57 aa, Artificial Sequence
  Synthetic sequence.
SLEELLKEVKKLVEDVHRKNKKNVEDVRRLVERLRKENEENVEEVRREVKKVKEEIG

SEQ ID NO: 2943 - protein, 56 aa, Artificial Sequence
  Synthetic sequence.
LEEVRRRVEELVTDVDRSSKENHRRIRKVVREVERTTEENHRRIRDIVRRVREEAK

SEQ ID NO: 2944 - protein, 56 aa, Artificial Sequence
  Synthetic sequence.
SEIEKAVRELEELVKDNERKSKKSVEDSERIVKEIRDRVRRVVERVRKVVEDIARA

SEQ ID NO: 2945 - protein, 59 aa, Artificial Sequence
  Synthetic sequence.
DDELRKVVERARDLIRKIREESKRSHDRITKLAEDIKRELEKIERRLEKLAEELERKAR

SEQ ID NO: 2946 - protein, 56 aa, Artificial Sequence
  Synthetic sequence.
SEVDELRKEVEEMVKRNKDETDKSVKESKEIVDEIRKRIKEVVDEVRRFVEDIRRE

SEQ ID NO: 2947 - protein, 59 aa, Artificial Sequence
  Synthetic sequence.
SRALEDVARRLRELLKRINDKTRESHKEIKRLADEIRKKLEDIVRELEKLLREIKERAR

SEQ ID NO: 2948 - protein, 56 aa, Artificial Sequence
  Synthetic sequence.
SEVDEVRERLERVVRRIEREVEKSERDSERIVEKNKRDTDRVDREIEKVVKKIRDR

SEQ ID NO: 2949 - protein, 59 aa, Artificial Sequence
  Synthetic sequence.
SRALEEIEKRARELLKRITELLRESHERIKRLAEEINKKTEKVVRDIRKLLKEIEDKVT

SEQ ID NO: 2950 - protein, 57 aa, Artificial Sequence
  Synthetic sequence.
SEIERLREELERVVRAIERTVTESVRESKEMVDRNKRATEKSVRDSEDMVREIEERG

SEQ ID NO: 2951 - protein, 59 aa, Artificial Sequence
  Synthetic sequence.
SRELERVAKEARDLLREIKKLLDESTETIRRLVKEINDETERSHRKITELAKRLKEEAK

SEQ ID NO: 2952 - protein, 56 aa, Artificial Sequence
  Synthetic sequence.
DEVRELVEEVERVVKRNKDESKKSEEESREIVREIEKRVEDLVRTVEEVVKEIERK

SEQ ID NO: 2953 - protein, 59 aa, Artificial Sequence
  Synthetic sequence.
SRELEKVADTLRKLLKEINEKLERSVRRIRELAKEIKDELRRIEEELRKLAKELDDEAK

SEQ ID NO: 2954 - protein, 59 aa, Artificial Sequence
  Synthetic sequence.
DRTREVMERIERLLEDSRRKTDKVRREIRKLLEDVHDKTRRVAKEIRDLLDEIRRLLES

SEQ ID NO: 2955 - protein, 55 aa, Artificial Sequence
  Synthetic sequence.
EEVVKKARKKVRENAEEAEEVRRRIRRSVEENRKELRRLEKELKDVLDEIRERVR

SEQ ID NO: 2956 - protein, 59 aa, Artificial Sequence
  Synthetic sequence.
RELEEVRKDIERLLKEVEDTNRRAKERVKRLLEEVHDDTRRAVERIRKLLDEIRKLLEG

SEQ ID NO: 2957 - protein, 55 aa, Artificial Sequence
  Synthetic sequence.
EEVVKEIEKMLEKIARHARKSDKEAKESVEDNRRRLEKVRKEVEDMLDEIRERAR

SEQ ID NO: 2958 - protein, 59 aa, Artificial Sequence
  Synthetic sequence.
DREKEVADRIRKLLEEIREESERVAKEIRELIKEVHKRTKEVAEEIRRLLKEVEELLRN

SEQ ID NO: 2959 - protein, 55 aa, Artificial Sequence
  Synthetic sequence.
EEVVKEIERRLRENERKLRELEKEIKKLVEDNRTRLRELEDEIRRVLKKITDEVT

SEQ ID NO: 2960 - protein, 57 aa, Artificial Sequence
  Synthetic sequence.
SELEKAVEDSRRLDRRVEETLRDVTRRVRETNKEVEDMLEEVRERAERLLREIEEKL

SEQ ID NO: 2961 - protein, 59 aa, Artificial Sequence
  Synthetic sequence.
EDELRKVIDENRKSVETIEEELRRVEKEDEDTLREIEEKLRKAIEELEKKLKEILDRLR

SEQ ID NO: 2962 - protein, 59 aa, Artificial Sequence
  Synthetic sequence.
REREELVERVRELLKEVEDRDREMVERSERLNERIRERDKEVEDRSRKLDEDIERLLRA

SEQ ID NO: 2963 - protein, 55 aa, Artificial Sequence
  Synthetic sequence.
EEVLKEVKDAVDTLKKHSEDVIRKDEESVRDLRRHSEDVLRKNKEMVDDIKAKAE

SEQ ID NO: 2964 - protein, 63 aa, Artificial Sequence
  Synthetic sequence.
DEEDKLREVLKDVERRVREMLRENNELIREVAETSERLLRENNELIERVRKEVTRLLKELEKV

SEQ ID NO: 2965 - protein, 55 aa, Artificial Sequence
  Synthetic sequence.
REIVETIRKILREIEEHAERNKTRLEEENKKVREHVERNKKDLEETLKEVEDRAR

SEQ ID NO: 2966 - protein, 63 aa, Artificial Sequence
  Synthetic sequence.
SKEDKLREELKEVEKTVRELLKRNNELIERVREEVERRLEENNRLIKEVKDRIDDLLRKLKDD

SEQ ID NO: 2967 - protein, 55 aa, Artificial Sequence
  Synthetic sequence.
REIVKTIKEILDEIRRHLERNKDRLEKELTRVRETAEKNKRDLEKVLEDVDRKAK

SEQ ID NO: 2968 - protein, 60 aa, Artificial Sequence
  Synthetic sequence.
DEAEKLEREVRKELEENREELERSTEESERLLKHNEDELRKSEEESKKLLREVEKELRRV

SEQ ID NO: 2969 - protein, 59 aa, Artificial Sequence
  Synthetic sequence.
KRVLDEVVKEIRRLIEEVKRTTKEMNKKIRKLFEESNRKLEEAHRDIRRKAERVKRELK

SEQ ID NO: 2970 - protein, 60 aa, Artificial Sequence
  Synthetic sequence.
KELDEIREEVDRVLRENERRLRTVKKEARDVLEHNRKRLEELRRKIEEVLKEIEEELKRV

SEQ ID NO: 2971 - protein, 59 aa, Artificial Sequence
  Synthetic sequence.
EEVLRRVLERIRRLIERVKERTKRMTDDMRRLIEESNDKLRRAEERIRKLLEEVKRTLK

SEQ ID NO: 2972 - protein, 60 aa, Artificial Sequence
  Synthetic sequence.
KKVEDIKREAEKVIKESEESIRRNERELDEVIKESERSIRRNERELERVLKELRDSVARL

SEQ ID NO: 2973 - protein, 55 aa, Artificial Sequence
  Synthetic sequence.
DRIREELKKVADEIRETNKRIHEESKRVVDEVRRTNEEIHKRSAKVVKDIKDKIK

SEQ ID NO: 2974 - protein, 60 aa, Artificial Sequence
  Synthetic sequence.
EEVERITEDAKRVIDESRKTIKRNEDDLRRVIEESRETVERNRKRLEEVLRELEERVRRL

SEQ ID NO: 2975 - protein, 55 aa, Artificial Sequence
  Synthetic sequence.
KRIEEELKRVAEEVKKINEDIHRRSKEEVDRVREINEKIHRDSERVAEEVRRRIK

SEQ ID NO: 2976 - protein, 57 aa, Artificial Sequence
  Synthetic sequence.
EELERLKEEVEEIVRRLKRELERIEEEIAKMVRDSEKSLEEDEREVRKVVEELRRRG

SEQ ID NO: 2977 - protein, 59 aa, Artificial Sequence
  Synthetic sequence.
EEILRRVKEEVEKVARDIKAIIEKVAREVKEVLDRIREVNKRAHEETRKVADEIEKRAK

SEQ ID NO: 2978 - protein, 56 aa, Artificial Sequence
  Synthetic sequence.
DEVERIAKELTDVLDRIRKAVETDKEEIKRVLKEIEEAVRTNEEKLKDALRKIREG

SEQ ID NO: 2979 - protein, 59 aa, Artificial Sequence
  Synthetic sequence.
ERALERVEEKARELVRRVDELLRRSHERTKELAERVRRLLKKSDEETERLARDVERKIK

SEQ ID NO: 2980 - protein, 56 aa, Artificial Sequence
  Synthetic sequence.
SEVERITERLKEVLKEIKELVETNSEKLKRVLEEIKKAVEDNTRTIKKVLEEITRA

SEQ ID NO: 2981 - protein, 59 aa, Artificial Sequence
  Synthetic sequence.
EEMLKRVEDEARRLTERVRKLIEDSDRETEKLVRRVRELVKRSHEKVKELVDRVRKRIE

SEQ ID NO: 2982 - protein, 56 aa, Artificial Sequence
  Synthetic sequence.
SEVERIAEEVKRVLEKIRRDVEENRKRIEEALKRIEKELRDNERRLREVLDEIRKR

SEQ ID NO: 2983 - protein, 59 aa, Artificial Sequence
  Synthetic sequence.
EDALRAVEEEIRKLEDEVRRLIETSHKEVEDLAKEVTDLLRESNERTEDLRREVDAKRR

SEQ ID NO: 2984 - protein, 64 aa, Artificial Sequence
  Synthetic sequence.
SDEERLLRTITRVLEENKKSVDDDLKKNEDVLDENRRRVERWEEALRELLKRVEDKVKDLKKDG

SEQ ID NO: 2985 - protein, 56 aa, Artificial Sequence
  Synthetic sequence.
TDEIRRVLEKVKEELDRTDEKSRDLSRKVRDRIRESNREIEKLLEEVRERLERETK

SEQ ID NO: 2986 - protein, 64 aa, Artificial Sequence
  Synthetic sequence.
READELRTRAEKALRDNRESVERLKRELDRVLKENERTVRELKERVKEVLKDVDKKVKDLKKEG

SEQ ID NO: 2987 - protein, 56 aa, Artificial Sequence
  Synthetic sequence.
REEIRKVLEDVRREVEETDDRIRKVLERARRESEKVDRELKKELERVRKELEEETK

SEQ ID NO: 2988 - protein, 59 aa, Artificial Sequence
  Synthetic sequence.
DRERRVLEELRKLSEDSKRLLERIRERMRRLAEETKRRARDILREVEELSRRVKELLDG

SEQ ID NO: 2989 - protein, 55 aa, Artificial Sequence
  Synthetic sequence.
EEVKDDVRRSSEEVKEEVERLIREAKKSTDEVRELLKELEKRLRESIEESKRKAE

SEQ ID NO: 2990 - protein, 57 aa, Artificial Sequence
  Synthetic sequence.
EEVKRMEDRLEEVAKRADEESKKVMDELEKIVRDVLRESKRLTEELRRIADRVRKEL

SEQ ID NO: 2991 - protein, 59 aa, Artificial Sequence
  Synthetic sequence.
KKELDRIEKRVREIKKRSEDSVRTIRERVRDAKRKLERSVEEDKREVKEIKERLEREAR

SEQ ID NO: 2992 - protein, 57 aa, Artificial Sequence
  Synthetic sequence.
SEVDDLKRKLDEVVRRAKEESKEISERLEEIVRDAERLLKELHEEDERIVDRARKEI

SEQ ID NO: 2993 - protein, 59 aa, Artificial Sequence
  Synthetic sequence.
RDKLEKIRDAVRKVKEELERSLEKDRKRVTEIEEKLKKLVEENRRTSKRVKEELEEKVR

SEQ ID NO: 2994 - protein, 60 aa, Artificial Sequence
  Synthetic sequence.
RELEEIKKRVEDIMRRIEDLLRENEKKIDKVRKDIRKSLEENKRKVEEVRKDLKRLLDER

SEQ ID NO: 2995 - protein, 55 aa, Artificial Sequence
  Synthetic sequence.
EEVKKEIERLAKKLEEELERSNRESDRLVREARKHNEESDRRSEELARRVRERLR

SEQ ID NO: 2996 - protein, 60 aa, Artificial Sequence
  Synthetic sequence.
KREEDVKRDLKRVADESRKSDEDIKRRLDRLVKEIRELHKKTTDELKKVADEVRDRLRKV

SEQ ID NO: 2997 - protein, 55 aa, Artificial Sequence
  Synthetic sequence.
DELREDVKRVEDENRTSLREIKRAIEKVLDESRKLVEENRRRAEKIIKEVEDTLR

SEQ ID NO: 2998 - protein, 60 aa, Artificial Sequence
  Synthetic sequence.
REEEEVTEELKRLADKSRKSDEDIERTDRRVTEEIERLHEETTRELEKVRRDVDRELKKV

SEQ ID NO: 2999 - protein, 55 aa, Artificial Sequence
  Synthetic sequence.
DELKKEVRKILEENKRSLERIRRHSTRVEEKSRKLIKENDDRLKKVIEDVRRKLK

SEQ ID NO: 3000 - protein, 60 aa, Artificial Sequence
  Synthetic sequence.
SEKDKVTKELEDVARESRESDKEIKRELDEVVEESERLLREIRRRLEKVAEEVRRALEKV

SEQ ID NO: 3001 - protein, 55 aa, Artificial Sequence
  Synthetic sequence.
EELKRRVEEIIRENEESVRRIAKRADDSNREIERLVDEIRRRAEEAIRRVTEKVR

SEQ ID NO: 3002 - protein, 60 aa, Artificial Sequence
  Synthetic sequence.
KEEDDVRRKLEKVVREIDKLHKESTERDRKVREDSEETDRRIKEELKKVVKEVRDRLREV

SEQ ID NO: 3003 - protein, 55 aa, Artificial Sequence
  Synthetic sequence.
EELKDEVRKATEKSEDLVRRNEEHSRRVIEENERTLKDIADEAERVIKEVEDRLR

SEQ ID NO: 3004 - protein, 60 aa, Artificial Sequence
  Synthetic sequence.
REDEEVTKELEEVIREIEELHERSTRKLKEVVDRSRELLDRVRRRLKEVVDRIRELLERV

SEQ ID NO: 3005 - protein, 55 aa, Artificial Sequence
  Synthetic sequence.
EELRKRVEEAIRKSEELVKENTERAKKSNEELERRVRELEERAKRAIEEVKEKIR

SEQ ID NO: 3006 - protein, 60 aa, Artificial Sequence
  Synthetic sequence.
SREEDVDRKLDEVIERSRRIDEEILRRDKEVVDEIRKLHKESTDRLKEVVDRVDKELKEV

SEQ ID NO: 3007 - protein, 55 aa, Artificial Sequence
  Synthetic sequence.
EELKKKVTEAIEENRESVEEIRRHSEEVKKESEKRVKENRDRARRAEERVEEMLR

SEQ ID NO: 3008 - protein, 60 aa, Artificial Sequence
  Synthetic sequence.
DREREVKKRLDEVRERIERLLRRVEEESRRVAEEIRRLIEEVRRRNKKVTEEIRELLKRL

SEQ ID NO: 3009 - protein, 55 aa, Artificial Sequence
  Synthetic sequence.
KELREELKKLERKIEKVAKEIHDHDKEVTERLEDLLRRITEHARKSDREIEETAR

SEQ ID NO: 3010 - protein, 60 aa, Artificial Sequence
  Synthetic sequence.
DEEEKITRDLEKVEDEIRRLLEEVRRLSKKVKEEITKLLEDVNRESEKAVRKVRETLKRL

SEQ ID NO: 3011 - protein, 55 aa, Artificial Sequence
  Synthetic sequence.
ERLRKRVTDVIRKLEEVLKDIHRHDKEAIEEAERRLEDNHRRNRRVLEELKRRAD

SEQ ID NO: 3012 - protein, 60 aa, Artificial Sequence
  Synthetic sequence.
SEEETVEELVRRAEEKSRRILEDSKKKVRDIERENDEILKRSRDRVKKAEDDLRRVVEKR

SEQ ID NO: 3013 - protein, 55 aa, Artificial Sequence
  Synthetic sequence.
ERILRELERVVEEIDREHERTKEELKKVADESRKAHRESERDLERVIREVRERLR

SEQ ID NO: 3014 - protein, 60 aa, Artificial Sequence
  Synthetic sequence.
SEVERVRKTVEEIKEKNERILKTSKDEVRRILEESERMLEESKKRVDEVREEAADVVRKR

SEQ ID NO: 3015 - protein, 55 aa, Artificial Sequence
  Synthetic sequence.
DRILEKLEEAAKRSDELHKRSRDDLRRVAEEIKKLHEETRRKLKKVVDEIRKKLK

SEQ ID NO: 3016 - protein, 61 aa, Artificial Sequence
  Synthetic sequence.
STLEEVRERVDRVKKKLKKLLEEVTEINERSKKEIDEILKESEDRVRKVKEDLKRVVKEDK

SEQ ID NO: 3017 - protein, 59 aa, Artificial Sequence
  Synthetic sequence.
EEVLERVLRELEELTRRVEKEIRDLLKRIEDSSRRVRELATESRKKLEDLVREIKERLT

SEQ ID NO: 3018 - protein, 59 aa, Artificial Sequence
  Synthetic sequence.
SSEEKVREEVERVREEITRLLRENEDTVRRVDEKAEKALRENKERVDRLREEVRKLLEK

SEQ ID NO: 3019 - protein, 59 aa, Artificial Sequence
  Synthetic sequence.
DDFVRKVTEELKKVTDRIRKLLEESRKHTERVRREAEKLLKEIKDETKKVEEEVRRRAK

SEQ ID NO: 3020 - protein, 59 aa, Artificial Sequence
  Synthetic sequence.
SSREKIKDDLRKAVEENRRLLREVRELLREMLERDERILREIERRLDEARKRLEEVARN

SEQ ID NO: 3021 - protein, 58 aa, Artificial Sequence
  Synthetic sequence.
RAVEELKKELRRLEEESRRAVEDLKRLLDELKERTDRVVKKLDETLRKLKEDVDRKAK

SEQ ID NO: 3022 - protein, 60 aa, Artificial Sequence
  Synthetic sequence.
REIDELRKELDEIRKRIEKVIEELKRHLDEVDKRAEDLAKELDDLTKTIERDAERRIRED

SEQ ID NO: 3023 - protein, 59 aa, Artificial Sequence
  Synthetic sequence.
DKVIREVEERVKRIKEDVDRVLEDNSREVERVKRKVDKMLKRNKDEADRIRKKMDDDLR

SEQ ID NO: 3024 - protein, 60 aa, Artificial Sequence
  Synthetic sequence.
SVIERLKEELKKIEEDARDMAKKLNKETEDILRRARKLARELEKHLEDVKRKIDELIKED

SEQ ID NO: 3025 - protein, 59 aa, Artificial Sequence
  Synthetic sequence.
KKMIEEVERDVRRIKKEVDRLLEENTERIEEIKKEVDELLKRNTDEVEKVKKKVDEDRK

SEQ ID NO: 3026 - protein, 59 aa, Artificial Sequence
  Synthetic sequence.
KIEEDLERSLKKSEDELKELRDRLRKSNKEVTDDAERIKKEVEDSNREVEKRVRDLERR

SEQ ID NO: 3027 - protein, 59 aa, Artificial Sequence
  Synthetic sequence.
SEEARKVLEENEEVVRRIVKKVEDILDDHRRVVKEVRDRIERLLKEHKKIVEDADKDLT

SEQ ID NO: 3028 - protein, 60 aa, Artificial Sequence
  Synthetic sequence.
REEEEVAKKLERAAEESRRLHEESKRDHERATDEIRRKAEATLRELKRVIDEIERLADER

SEQ ID NO: 3029 - protein, 55 aa, Artificial Sequence
  Synthetic sequence.
EEIRRRVETLERENRKAEEESRDKVRKSERRLEELNKRHEDLVRELEERLERKRK

SEQ ID NO: 3030 - protein, 60 aa, Artificial Sequence
  Synthetic sequence.
DEEEKVLRELEEVIRTSRRLHKRSLEELDRVLEESKALHRESKRALEDVTREITKLADDR

SEQ ID NO: 3031 - protein, 55 aa, Artificial Sequence
  Synthetic sequence.
ERIRKLVDDLRKENEKALRESKKRVEEIRRRNEEAIKDSKKDVEDLERDLERKRK

SEQ ID NO: 3032 - protein, 60 aa, Artificial Sequence
  Synthetic sequence.
SDEERVLEELKKVIKESRDLHKESLDDLRRVIEKSRRLHEESLERLRRAIEEIERLMDER

SEQ ID NO: 3033 - protein, 55 aa, Artificial Sequence
  Synthetic sequence.
EEIRDLVRTLEEDNKRMEERSRRTVRKLEKENDDARKESERLVEELERRLEEKRR

SEQ ID NO: 3034 - protein, 60 aa, Artificial Sequence
  Synthetic sequence.
RDVEEVKKRSDTTLKRIEELIRRVNERSKKSIKEIRDRAKEVEDEVRELARKIEEDARRR

SEQ ID NO: 3035 - protein, 59 aa, Artificial Sequence
  Synthetic sequence.
DEVVRELEKINDKSRKRVEDAVRSNEKLLEDSERDIRRVIERLKKLLEDLKRKLEEIER

SEQ ID NO: 3036 - protein, 60 aa, Artificial Sequence
  Synthetic sequence.
SDAERVMEESRRTIEKIKKDAKEMNERSRKTVDEIRERLERLLRELERIAEEIRRELEKR

SEQ ID NO: 3037 - protein, 59 aa, Artificial Sequence
  Synthetic sequence.
EEFVRELKKLNDKSRKDVEDLKRSNEEINEDSKRKVEEIIRRLEELLKEIRRELEDVER

SEQ ID NO: 3038 - protein, 60 aa, Artificial Sequence
  Synthetic sequence.
SVEEDLKRLVDEIRRRVEKVKRDLERIVDENRKRVEESKEESKKSVEEIERRVREAAKRI

SEQ ID NO: 3039 - protein, 59 aa, Artificial Sequence
  Synthetic sequence.
EKVADEVRKRLRKMIRDLEEVAREVKRELERLHEETERSSRDAKRRSDKMARDLERTEK

SEQ ID NO: 3040 - protein, 60 aa, Artificial Sequence
  Synthetic sequence.
SSEEKLRELVKRIKRRVEEIIRRLEESVERDRDEVRRSKERLEALVEEIRRRVDDIEKRI

SEQ ID NO: 3041 - protein, 59 aa, Artificial Sequence
  Synthetic sequence.
EKAVREVEEELRDMERKLEKVAEEVTRRSKEVTEKLRESSDRVEKELRRIIEELERVAK

SEQ ID NO: 3042 - protein, 60 aa, Artificial Sequence
  Synthetic sequence.
SVREDLKRLVKEIEDEVRKSKKDLDDSVREDKREVRESKEDSKRSVKRSEEEVRKIKKRT

SEQ ID NO: 3043 - protein, 59 aa, Artificial Sequence
  Synthetic sequence.
EEVAKRVRELLEEIMRRLRKTSEEARRRSKKITDDLRESSKKVREDSERLRKRLEEEAK

SEQ ID NO: 3044 - protein, 60 aa, Artificial Sequence
  Synthetic sequence.
DAERKITRLLEEIRRESKRSSEEIKKSLKENEDEVRRVVEEIRKRLREIEKEVKEVLDRL

SEQ ID NO: 3045 - protein, 59 aa, Artificial Sequence
  Synthetic sequence.
EKLVEEVLREVKRIIEENRTLSERVKEHNEKSHRESEELAKRVKELLKEIERDIRRLEK

SEQ ID NO: 3046 - protein, 55 aa, Artificial Sequence
  Synthetic sequence.
SDAERVLKESKESLEELERRVTEALKRSRDSLRRLKEVADEARRRLEEVLERIAR

SEQ ID NO: 3047 - protein, 59 aa, Artificial Sequence
  Synthetic sequence.
SEVKERLKRSLEETEKRVREVEERLKKTVEDTRKVVEDIERELERLLREVEEVVRRIEK

SEQ ID NO: 3048 - protein, 55 aa, Artificial Sequence
  Synthetic sequence.
EEAERMLRESEASLRRIEKIVREALEASRRTVEELKKVVERVLREVRKLIEEIEK

SEQ ID NO: 3049 - protein, 59 aa, Artificial Sequence
  Synthetic sequence.
DEVRERLKKTVEDSKRVVEKAEEDLRRSLEDTERLVREASRRLRDLLRELRRIVEEIKR

SEQ ID NO: 3050 - protein, 55 aa, Artificial Sequence
  Synthetic sequence.
SEDEKALRESKKTTDEIRKRVTEMEKRSREVVKEIRDIIERVLREVRRVLEEIRK

SEQ ID NO: 3051 - protein, 59 aa, Artificial Sequence
  Synthetic sequence.
SEAKKRLKDSLDRTRKTVEEMTRRLEKTVKETEDLLREARERLEELLRELERVADEKRR

SEQ ID NO: 3052 - protein, 55 aa, Artificial Sequence
  Synthetic sequence.
SEDEKVLRDSRKVLREIEEVVKEVLKRSKKLVEELEDIARRVLKESEDSNKEARD

SEQ ID NO: 3053 - protein, 59 aa, Artificial Sequence
  Synthetic sequence.
DEVERRLRKTVRDTKEVVDRAREKLERTVRTTEETVKEIEKRLEESLRRSREDVKEREK

SEQ ID NO: 3054 - protein, 60 aa, Artificial Sequence
  Synthetic sequence.
RVEDALRKLLDDVRRLVEEAERRLRTSNDKSRRLVEEAKRRLEESNERSEKLVRDVRRRI

SEQ ID NO: 3055 - protein, 59 aa, Artificial Sequence
  Synthetic sequence.
SKVVEEVLKELEELIKTAKKIIEDVLRASEDTIRRLEEIIRKVEEDSKRIIEEIERAAR

SEQ ID NO: 3056 - protein, 60 aa, Artificial Sequence
  Synthetic sequence.
SAEDKLRKLLDDARRTVKEVEERLKKLNKKLEEDVKRVKRELRESNKKSRELVEKVKREV

SEQ ID NO: 3057 - protein, 59 aa, Artificial Sequence
  Synthetic sequence.
SEVVEEVLEELKKLIETVKRRAKEVLDRSEETIREIRKRAEDVLRESERIIEDIERMTR

SEQ ID NO: 3058 - protein, 60 aa, Artificial Sequence
  Synthetic sequence.
KVEKRLTDLLKTVADEVKRVEDELRETVRESKEVVDKSRRDLERTVEESEKTVKDAERRV

SEQ ID NO: 3059 - protein, 59 aa, Artificial Sequence
  Synthetic sequence.
EEVVKKVEKEIRELLERLKEEADRVRERSKKILTDLKKSSEDVKRESERMLKKLEDEIR

SEQ ID NO: 3060 - protein, 60 aa, Artificial Sequence
  Synthetic sequence.
SVEERLEDLLREVTETLDTSRRRLEKLDREVDKKVKEVEKRLRETLKESEDTVRDVERRV

SEQ ID NO: 3061 - protein, 59 aa, Artificial Sequence
  Synthetic sequence.
EEVARRVEKELEDILRKLRKSSEEAERRIEEMLRRLDKVVKEMLKRSRDLLRTLEETTK

SEQ ID NO: 3062 - protein, 60 aa, Artificial Sequence
  Synthetic sequence.
SIREDVERLAEELDRKSREIATRAKRELDEILRKDKEISDRARKELEEILKKLKEIADRD

SEQ ID NO: 3063 - protein, 59 aa, Artificial Sequence
  Synthetic sequence.
KEVEKRLDDALKRNAEEVEDVKRKLKDVLREVERTVRESEKDLRRVLEEVERAVREIRR

SEQ ID NO: 3064 - protein, 55 aa, Artificial Sequence
  Synthetic sequence.
SEVDEVLKRSRDVLKRIDEIVKKVLTDSKRVLEDLRRIVKEVLDESKKVLEEIRK

SEQ ID NO: 3065 - protein, 60 aa, Artificial Sequence
  Synthetic sequence.
AEEVERAMRKSSDDLRRKLEEVERRLRKSSEESKKVLKDAEREIRRSSDELRKVLEDIRR

SEQ ID NO: 3066 - protein, 55 aa, Artificial Sequence
  Synthetic sequence.
SEVEDVLTKSRKVLKEIEEIARKVLEESKRVLEEIRRVVEEMERRSEDVLRELRR

SEQ ID NO: 3067 - protein, 60 aa, Artificial Sequence
  Synthetic sequence.
ADEVRDEVRKSSEELRRVLEEAEERIRRSSKESKELLKRVKERIEELSRRLEKVLREIEK

SEQ ID NO: 3068 - protein, 59 aa, Artificial Sequence
  Synthetic sequence.
DAEDELKKAEDRLRKSDEEAKKSIEDVKRELRRLLEESKKEIEKLIEELRRLLERAKEK

SEQ ID NO: 3069 - protein, 59 aa, Artificial Sequence
  Synthetic sequence.
EEVVERVLRKVERLLEENERLVKEVEDELRKLLEDLKRSSKKVRDEVKELAKRLRDEVR

SEQ ID NO: 3070 - protein, 59 aa, Artificial Sequence
  Synthetic sequence.
SAEERIEEVKERLRRSDEEAKRKIDRLVEELRRLLEESKKEAEKVKKELRKLLEEVKRK

SEQ ID NO: 3071 - protein, 59 aa, Artificial Sequence
  Synthetic sequence.
EEVVKRVEDELRRLLEENKKLVDDILDEVRRLLEELEKSSRKVKEDLDRLLEELRREDK

SEQ ID NO: 3072 - protein, 59 aa, Artificial Sequence
  Synthetic sequence.
SAAEEVKKRITDLLRKDEEVVKRASEAVERLLEDDKRVVEDVRREIEEILRTLEKVTRE

SEQ ID NO: 3073 - protein, 56 aa, Artificial Sequence
  Synthetic sequence.
KDDVKRAEDEVRKSHKKVEDDLRRLKEEVERSLKDTEDKARRAKEEVERLLRESER

SEQ ID NO: 3074 - protein, 59 aa, Artificial Sequence
  Synthetic sequence.
DEDDRVRKEVEKMLRDDDRIVKEIEKRLKDLLDRDRKVVREVRELVEELLRRLEKVIKD

SEQ ID NO: 3075 - protein, 56 aa, Artificial Sequence
  Synthetic sequence.
EEDVDRLRREVDKSNKDTKKILDEVRKEVEDSLRKTKKIIDDALRRVDELLKEAER

SEQ ID NO: 3076 - protein, 56 aa, Artificial Sequence
  Synthetic sequence.
SVEERVEDIKRSNEESNKRLREEVEKIKEELKEINKRVEDTVREIEKRLEELLRRV

SEQ ID NO: 3077 - protein, 59 aa, Artificial Sequence
  Synthetic sequence.
ERVVEEIDKIAKEVNTRNKKVVDEIRKRAEEVKEESKESLKRLRKIAEEVLEELKKRAT

SEQ ID NO: 3078 - protein, 56 aa, Artificial Sequence
  Synthetic sequence.
DLAEEVRKDVEDLERTNEKVVRDIRKLLEDLNREHKRVSDEIRKRIEELKEKLKRI

SEQ ID NO: 3079 - protein, 56 aa, Artificial Sequence
  Synthetic sequence.
DDDVRRIKKRAEDSHDRVKKELDRIAKSNEELLRKTEEEVRRLLEELEEILRRTRK

SEQ ID NO: 3080 - protein, 59 aa, Artificial Sequence
  Synthetic sequence.
DEVEEALRRVEESNRRVKEEVERAVERVKRSDDDVRRLVEEMEREVRKLIDDIRRLAEA

SEQ ID NO: 3081 - protein, 56 aa, Artificial Sequence
  Synthetic sequence.
KDEITELKKHSERLLEEAERLVRDLKRHSDELLEEVEERLRRLREDLKRLLDEVET

SEQ ID NO: 3082 - protein, 59 aa, Artificial Sequence
  Synthetic sequence.
SAVEKAVRDVERTNEEIRRVVEEVRKEAEKTHRDIRRVVEEARETAERLLREIEELAKK

SEQ ID NO: 3083 - protein, 56 aa, Artificial Sequence
  Synthetic sequence.
EEAVKRLKDENKKTLDEVREIVKRLAEENKRLLEEVEKTVRDLKRELEKLLREVAK

SEQ ID NO: 3084 - protein, 60 aa, Artificial Sequence
  Synthetic sequence.
KEVEDVVKEIEEVLDRLRKEVKKIKEDSDRLNEEIEKVVTDLVKELDRLLREIDDLIRKL

SEQ ID NO: 3085 - protein, 59 aa, Artificial Sequence
  Synthetic sequence.
DRARKTLEDLKRRIEELLRRVDETNERLKRHSDDLLRDVKRRLDEVRERIDRLLDKAER

SEQ ID NO: 3086 - protein, 61 aa, Artificial Sequence
  Synthetic sequence.
DEVDEAVKRLREILRRIREIVEKVRKESEDVNDEIRRIVEEVTKRSEDALRELRELIRRNK

SEQ ID NO: 3087 - protein, 59 aa, Artificial Sequence
  Synthetic sequence.
ERVREELRKVEEDIDRLLKEVTELNERLKRHSEKLLRDVTRENRRSKEAVTRILEEARR

SEQ ID NO: 3088 - protein, 60 aa, Artificial Sequence
  Synthetic sequence.
SEVEELLDRLREVNKRIREEVRKVTEESKKAIEEIKRIVDDMVDKVRKILEKLKELIRDN

SEQ ID NO: 3089 - protein, 59 aa, Artificial Sequence
  Synthetic sequence.
DKAREDLRRVKEHSERLLREVTKLNKDVEKELKELLDEVRERLKDLKRRIDKILEEAER

SEQ ID NO: 3090 - protein, 59 aa, Artificial Sequence
  Synthetic sequence.
SVRERVKDEMEKVLRDDKEVSKRVTDEARKVLEEHRKITDEVRRRSKELIRELKKVRDE

SEQ ID NO: 3091 - protein, 59 aa, Artificial Sequence
  Synthetic sequence.
EEVRRTVDEVRRRIDKSLEESKKLVEDISREITELLRRTTERNKESKREVDKILEDARK

SEQ ID NO: 3092 - protein, 59 aa, Artificial Sequence
  Synthetic sequence.
SIVERAEKELRRLLKEDEEVSDRVRKEVKRLLKEDKEILDDVRRRIEKILREIEEVARR

SEQ ID NO: 3093 - protein, 59 aa, Artificial Sequence
  Synthetic sequence.
EDVRRIIKEIKERVKKSLDESREIIERAKREVDKSLEESKKVAEDAKRRIERLLREVER

SEQ ID NO: 3094 - protein, 60 aa, Artificial Sequence
  Synthetic sequence.
SEVEKVVREVEKLIREIERHSKEVNKRSKEDIDRIREKIERAIRRVEELIRKVKEVTERG

SEQ ID NO: 3095 - protein, 55 aa, Artificial Sequence
  Synthetic sequence.
EDLDRIRERLERLKKRTKELLERDEREVERVERELEELIRDIRRKIEKLKRDIEK

SEQ ID NO: 3096 - protein, 59 aa, Artificial Sequence
  Synthetic sequence.
SDLEDVIKKIEELLRRVEERLRDAVRKIEELLRASDERLREINEESRELLRRVKELKDA

SEQ ID NO: 3097 - protein, 56 aa, Artificial Sequence
  Synthetic sequence.
RKLVDDIRKEVERIVEEARKLLERIKREVKESSERAERLHEEDRKRVEDALREVKK

SEQ ID NO: 3098 - protein, 59 aa, Artificial Sequence
  Synthetic sequence.
KEAEDVLEKAKRLLKRSDEVVEEANDESRRLLDKIRKLVDTVNEESKRLLDRVRELREA

SEQ ID NO: 3099 - protein, 56 aa, Artificial Sequence
  Synthetic sequence.
KDAVRDVEREVRRSSKRLKELHEEDKRRVRKILERLKRLHEKDRRDLEKVMKEVED

SEQ ID NO: 3100 - protein, 60 aa, Artificial Sequence
  Synthetic sequence.
DDLDEVIKDIERLLKESDDDVERVIREIKKLLDEVRKRVRDANEDSKRLLREVERLAEAG

SEQ ID NO: 3101 - protein, 56 aa, Artificial Sequence
  Synthetic sequence.
ERLVREIERRVRKSSEDLRRRLEEIRERVEDIERELRKLHEEDKKRVEDILTEVRR

SEQ ID NO: 3102 - protein, 60 aa, Artificial Sequence
  Synthetic sequence.
SEKERVVEEVRKKLEEIRRRTEEMIERVERLLDEIRRRNKELVERNKELNKRIAEIVRDR

SEQ ID NO: 3103 - protein, 56 aa, Artificial Sequence
  Synthetic sequence.
SELARDIKRKLEKILEDSERLVDEIRKRIEKIKRESDETVRESRESSRRLLEEVKR

SEQ ID NO: 3104 - protein, 58 aa, Artificial Sequence
  Synthetic sequence.
SEVERLLEDNRRTIREDEERNKRVVDTWRELTRRLEERIEKVLTDNKKTVEDLVRKRG

SEQ ID NO: 3105 - protein, 56 aa, Artificial Sequence
  Synthetic sequence.
DDELRKDLERLDEESKRASEKLEEEVRREIKRSKELIEEVERKVEEIDKRADERLN

SEQ ID NO: 3106 - protein, 58 aa, Artificial Sequence
  Synthetic sequence.
SEVERVLEKLKRDVEKNERDNRRVLKKLREDVKKDADDNRKVLEDLRRAVEELRREVG

SEQ ID NO: 3107 - protein, 56 aa, Artificial Sequence
  Synthetic sequence.
TKDLVDEARKVLETSKRLSDELKKEVEKMLRESREMSKRLKEEVDRILKEVRDKAR

SEQ ID NO: 3108 - protein, 57 aa, Artificial Sequence
  Synthetic sequence.
DELEEVIDRNRKSLKEIEERNKKVIEDLRRAIKEIEDRLKEVLDRVKKRIEDIERRV

SEQ ID NO: 3109 - protein, 55 aa, Artificial Sequence
  Synthetic sequence.
EELRKKIEDVDRKVRKESEDLKRELKKLLDEIRRKVRELEERAKRVEEEVDREAK

SEQ ID NO: 3110 - protein, 57 aa, Artificial Sequence
  Synthetic sequence.
SELEEVIRDNERSLKEIEDKNREVTKTVREEIKRIAKKLKEVLDRNRETVRDIERRV

SEQ ID NO: 3111 - protein, 55 aa, Artificial Sequence
  Synthetic sequence.
DELRRRIKEVDKEVEEKSEKLKREVKAVLDRVEKLAEEIRKKVEDVDRTVEEKAR

SEQ ID NO: 3112 - protein, 59 aa, Artificial Sequence
  Synthetic sequence.
KEMEDLEREVERVLKRLEELVRELLETVRRTLTRLKRKLDEKKKELDKVNEDLDRVTRE

SEQ ID NO: 3113 - protein, 55 aa, Artificial Sequence
  Synthetic sequence.
ERVVKKLEDAIEEIKRKLEKVHDEHRRTVEKIEEDIRRVEEEHRRTIKEIKEKLK

SEQ ID NO: 3114 - protein, 59 aa, Artificial Sequence
  Synthetic sequence.
SESERLAKEVEKKLKDAERLVKELHEEVDRMNRDLERKLREISERAKKTTEDVERVAER

SEQ ID NO: 3115 - protein, 55 aa, Artificial Sequence
  Synthetic sequence.
EEVIKKVRKDIEEITRKLERSNREHERTLREIKKRAEKVHEDHRREIDRIREELK

SEQ ID NO: 3116 - protein, 59 aa, Artificial Sequence
  Synthetic sequence.
RESEELEREVERVLRELEELVKRLHDDVRRVDEELDRKVRDLHKKVRDVLRRVEKLVRD

SEQ ID NO: 3117 - protein, 55 aa, Artificial Sequence
  Synthetic sequence.
DRVVDRLRRKIEEIARRLRKSNEDHRRSLKEIKDKLEESNERLRRALEEIAERLR

SEQ ID NO: 3118 - protein, 60 aa, Artificial Sequence
  Synthetic sequence.
SEKDEVITRVETELRRVKTEDRDVARRVKEELEDLKRRLERVIEDNERTLRELKKELKER

SEQ ID NO: 3119 - protein, 55 aa, Artificial Sequence
  Synthetic sequence.
EDVVRELEKLLRDWEKRSREVEEKLRRLLDELRETLKEIEKELRRLDKEIKERLR

SEQ ID NO: 3120 - protein, 60 aa, Artificial Sequence
  Synthetic sequence.
DREEKVKRRVEEELDRVRRTDDRVLKRVEERLREDEKRNEEVIRRNEKTLRELEKRLRDN

SEQ ID NO: 3121 - protein, 55 aa, Artificial Sequence
  Synthetic sequence.
EDVVRELEELLKRWKETSERVKRELTDLLRKSEETSKEVTKTLRELDKRIEDELR

SEQ ID NO: 3122 - protein, 59 aa, Artificial Sequence
  Synthetic sequence.
SREEDLKRKIDEVDKEWKKLTKKLEEEIREVEKEWRKLSKELERKIREVEKRLKEAKDR

SEQ ID NO: 3123 - protein, 55 aa, Artificial Sequence
  Synthetic sequence.
EEVIKTLRERVKDIHREDKEIIDRLREKAERIKEHDRKLLEDLKRTLDKLRREME

SEQ ID NO: 3124 - protein, 59 aa, Artificial Sequence
  Synthetic sequence.
DEREEIKKELDRIIRESEELVKKIKDVIRKLIEESKRLVEKIREDIKRSNDKLDEVTRR

SEQ ID NO: 3125 - protein, 55 aa, Artificial Sequence
  Synthetic sequence.
EEVKRRAEDLLRRSDEKSKRIAEEAERRLDRSDEESEKILRDNEDMVRKWREKEK

SEQ ID NO: 3126 - protein, 59 aa, Artificial Sequence
  Synthetic sequence.
DETEKITKDLEDLIREDEKLVKDARDTLAKSNEDSRRLVEDLRRLIKESNEELERVVRE

SEQ ID NO: 3127 - protein, 55 aa, Artificial Sequence
  Synthetic sequence.
EDVVRRLERLSEESRERLERILRDNKRRLDKSLEDSKRLVEKNDRDLKKWKEDRR

SEQ ID NO: 3128 - protein, 59 aa, Artificial Sequence
  Synthetic sequence.
DERETVREELKELIERLRDLNRKIEELLRRSNEEIRRLVEEIRRRLKEMNDEIRRVLKK

SEQ ID NO: 3129 - protein, 55 aa, Artificial Sequence
  Synthetic sequence.
DKVLKEAKELLDASEKHLRDLIETNERVLKRWEEELDKIAEENERVLRKWEEEAK

SEQ ID NO: 3130 - protein, 61 aa, Artificial Sequence
  Synthetic sequence.
SEREEVLKKIREMSKRDNEKNKRILDDVRRLSKEDNKDNDRLVEEHRRKITELEDRVRKEG

SEQ ID NO: 3131 - protein, 55 aa, Artificial Sequence
  Synthetic sequence.
EVLREVEELSRRDEKRSKEILEEVSKLSKDDEDRSRDLLRKAEEENRRLEEKLRK

SEQ ID NO: 3132 - protein, 61 aa, Artificial Sequence
  Synthetic sequence.
SEKETVLEDIRRMSKEDNEKNERIVERARRILEKIEEKNRRVKEEAKKMLERIKKLVKDRG

SEQ ID NO: 3133 - protein, 55 aa, Artificial Sequence
  Synthetic sequence.
RVVDEVRKRSEEDERRSRELLEEVRRAVKRVEDKSRTTVREIRERVKEVKKRLDD

SEQ ID NO: 3134 - protein, 60 aa, Artificial Sequence
  Synthetic sequence.
SEVEDVVRKVRKLVEKSTRDNKRVLEKVRKLVKESSDKNKKVLDEVEELIERLREKLERI

SEQ ID NO: 3135 - protein, 56 aa, Artificial Sequence
  Synthetic sequence.
RDALEEIRKRVEDNKRRSDESLEEIRRLVEENKRRSEKTLKEIREKAKRLKDEIDR

SEQ ID NO: 3136 - protein, 60 aa, Artificial Sequence
  Synthetic sequence.
SEVEKVEREVDEMVRDSTKENEDILREVRERLKKIKEDLDRTVTEVRRLLKELEEKAREV

SEQ ID NO: 3137 - protein, 56 aa, Artificial Sequence
  Synthetic sequence.
KDMLDRVREKVKRNKEESDKSLDEIRRIAEEVKRRIDELLKEIKKRAEELKRKLRK

SEQ ID NO: 3138 - protein, 60 aa, Artificial Sequence
  Synthetic sequence.
SEVEEVLKRARELVERSTRENRKILERARKMLEDARKTNEDVLRDVERLLDELRRELEKI

SEQ ID NO: 3139 - protein, 56 aa, Artificial Sequence
  Synthetic sequence.
KEVLDEIRELVKENKKRSDDSLREAEKRLRELKEESDKTLDEIRRKLEKLKEEIDR

SEQ ID NO: 3140 - protein, 60 aa, Artificial Sequence
  Synthetic sequence.
DEVETVRKDVERLVRTSNDENRRILETARKLIKEVREKNKEVTDRVRDLLRRIEEEVKKV

SEQ ID NO: 3141 - protein, 56 aa, Artificial Sequence
  Synthetic sequence.
ERILEEIRRRVEENKKRSDESLKEARELLRDVERESDETLKEIEEEARRLKEEIDR

SEQ ID NO: 3142 - protein, 59 aa, Artificial Sequence
  Synthetic sequence.
DEVKKVVDEARKLVEDDKRTNEEVLRRTRELLERDERKNEEAVKRIRDLLKEIKKLVEA

SEQ ID NO: 3143 - protein, 56 aa, Artificial Sequence
  Synthetic sequence.
EELLKRIDELIKESKRRTKEAHRESEELARKTKKSTRDLLREVEKRLREIKEEIKR

SEQ ID NO: 3144 - protein, 59 aa, Artificial Sequence
  Synthetic sequence.
SDVEKVVDEVREKVKRDKEDNRRVAKEARELVKESSEKLERLVTEVKKLIKTIEKLVRD

SEQ ID NO: 3145 - protein, 56 aa, Artificial Sequence
  Synthetic sequence.
DELLKEIDKLIKESKKETDDLLKEIKDLIDENKRRIDKLLREIEKLARKVKRDIEK

SEQ ID NO: 3146 - protein, 59 aa, Artificial Sequence
  Synthetic sequence.
SDVEKVVEELRRLVRKDEEDNRRAVEETRRLVEDSSRKLEEMVRRVRDLIRKVEELVKS

SEQ ID NO: 3147 - protein, 56 aa, Artificial Sequence
  Synthetic sequence.
ERLLREIEKLIRESKKKTDDLHRESKKLIEDNKKRIDDLLKEIKDRVERVKEEIRR

SEQ ID NO: 3148 - protein, 59 aa, Artificial Sequence
  Synthetic sequence.
DEVKKVVDEVRKKVEEDKDDNRRAVKETRELVEESSRDLKRLVETSRRLIEEVERLVEK

SEQ ID NO: 3149 - protein, 56 aa, Artificial Sequence
  Synthetic sequence.
ERLLREIRKLITESKKTTRDLHRDSKRLIDENRKRIRDLHEETRKLVKEVLDKIRK

SEQ ID NO: 3150 - protein, 59 aa, Artificial Sequence
  Synthetic sequence.
SDVEKAVDEVRKLVKDSNEKVERVLREVRKLIEEDERKNREVFERVRKLIEDILRLVKG

SEQ ID NO: 3151 - protein, 56 aa, Artificial Sequence
  Synthetic sequence.
EKLLRDIREEIERNRRELEKALREIKKEIEKTKRKTDRLLETIKELIDRVVEEIKR

SEQ ID NO: 3152 - protein, 59 aa, Artificial Sequence
  Synthetic sequence.
DEVETVKRRVEELVKRSNEELKRIVEETRRRVEDDERDNERIIREIKKKLKDIEELVKS

SEQ ID NO: 3153 - protein, 56 aa, Artificial Sequence
  Synthetic sequence.
EEILKTIRRLIEKNREDIDRLHEESKREIDRTKERTDRLLDDVRRIAERIKEEIDK

SEQ ID NO: 3154 - protein, 59 aa, Artificial Sequence
  Synthetic sequence.
REVEEVLKEVDELVRKSNEDLKDIVRRTRDLLRKDKERNDEVVRRSEELIRRVEELVRR

SEQ ID NO: 3155 - protein, 56 aa, Artificial Sequence
  Synthetic sequence.
EEALERIKRKIDENEKEIRELHKESEKRIRDTLRATDKLHKDTRRRVEEVKEEIKK

SEQ ID NO: 3156 - protein, 59 aa, Artificial Sequence
  Synthetic sequence.
SDVERVVERARDLVRKSDDDLRKMVAETKRLVEESSKKLDKIVRESRELIRDVKRLVEE

SEQ ID NO: 3157 - protein, 56 aa, Artificial Sequence
  Synthetic sequence.
EELLKEIKKRIDESREKTKRLHEESRKLIEDNKRRIDELHKETKEEVERAKKEIED

SEQ ID NO: 3158 - protein, 60 aa, Artificial Sequence
  Synthetic sequence.
EEVKRALEELDELVKRIEEDSRRMVKEAEDLVEKIRKEIEDLLRRSRKLNEDIRRLIDRD

SEQ ID NO: 3159 - protein, 56 aa, Artificial Sequence
  Synthetic sequence.
EDILRRADELLKRLRRKDEELTKKIERLLEKVAKEVEDINRESKRSADEVRKRVRK

SEQ ID NO: 3160 - protein, 60 aa, Artificial Sequence
  Synthetic sequence.
SSVKEVRDELKRLVDEIRKESEDMVERLRRLVEEIRKRNEELVRRSEELNERARRLIERD

SEQ ID NO: 3161 - protein, 56 aa, Artificial Sequence
  Synthetic sequence.
DKILKEAEDLLRDLERRDRELTREVEKLLEELRRTSEETNKRSKESADRVEDEVRR

SEQ ID NO: 3162 - protein, 60 aa, Artificial Sequence
  Synthetic sequence.
KEVEEALKRVRELVKRAEDMNEELLRRSRKLNDEIRRRIEEMLRRLEEVVRRIKELVDRD

SEQ ID NO: 3163 - protein, 56 aa, Artificial Sequence
  Synthetic sequence.
EKILTEIEKRLKDLEKKSRDSNRESEESLERIRRKVEEIARRVRELLDRLRREVER

SEQ ID NO: 3164 - protein, 57 aa, Artificial Sequence
  Synthetic sequence.
SRLEEVTRRARKLVEDITRELRKAVEDSRRVVDKIRRLNEELTRRSRELVKEVKDKV

SEQ ID NO: 3165 - protein, 59 aa, Artificial Sequence
  Synthetic sequence.
EKVREILEEIRRLLEELEREVKELNEESKRRLDELEKRSEETNKESEDLLEKVRRDVEK

SEQ ID NO: 3166 - protein, 57 aa, Artificial Sequence
  Synthetic sequence.
SELEDVVRRLDELVKRIKEENRETLERSRRLVEEAKRTNEETEDRMRRLVEEIEKKV

SEQ ID NO: 3167 - protein, 59 aa, Artificial Sequence
  Synthetic sequence.
EEVRRLLEEIRRKLEDAKRHVEELSEESKKLLKELEEHVREVNKKSEKLLRELKDKVKT

SEQ ID NO: 3168 - protein, 57 aa, Artificial Sequence
  Synthetic sequence.
SELEKLVEDVRRLVEKIKRDNRKTLKELEELVREIVERNRDTLRRSRELVDRIKKRV

SEQ ID NO: 3169 - protein, 59 aa, Artificial Sequence
  Synthetic sequence.
EDVRRVLKEIKELLERVREHVERLNRDSERLLKDLEEHARRLSKESKELLRELEERVRT

SEQ ID NO: 3170 - protein, 60 aa, Artificial Sequence
  Synthetic sequence.
SEVEKIREDVKKLIEESKKLNRDILEEVRKMIERWRDTTRRIRERIRKLIEEAEEEIKRS

SEQ ID NO: 3171 - protein, 56 aa, Artificial Sequence
  Synthetic sequence.
SEVLEEVKRLVEESKRESDEILKRVKKLVDDLARTDDKVLEDIKREVDRLKKELED

SEQ ID NO: 3172 - protein, 60 aa, Artificial Sequence
  Synthetic sequence.
SEVEKIKKDVDRMITEWEKRSRDIAKTVDELIEDSRRLNETIRRDVDRVARELKERIKRT

SEQ ID NO: 3173 - protein, 56 aa, Artificial Sequence
  Synthetic sequence.
DDVLKKIEEALKRLADRDDDILRRIETLVRKTRRESEELLKEVEDKMRKLKEELRR

SEQ ID NO: 3174 - protein, 60 aa, Artificial Sequence
  Synthetic sequence.
SEVEKLTEDVKRLIEKSKRNNRDILRKVKEDIDEWRKRTKKIADEVRKTERDLEEKIKRT

SEQ ID NO: 3175 - protein, 56 aa, Artificial Sequence
  Synthetic sequence.
DEVLRRIEEDLKRSKKETDDILKEVKDLLTDLLRRDDEVLEEIKRRAERIKEEIDR

SEQ ID NO: 3176 - protein, 60 aa, Artificial Sequence
  Synthetic sequence.
REVEKILTDVRRLIEEWRKKTEDIKREVDKLIEEWRKRSDEIADRSRKLAEEIERLLREG

SEQ ID NO: 3177 - protein, 56 aa, Artificial Sequence
  Synthetic sequence.
ERVLRKIRRDLERLKKTDDDVLKTIEKKLRELEERDRRLHKESREIAEKLKEDIDR

SEQ ID NO: 3178 - protein, 60 aa, Artificial Sequence
  Synthetic sequence.
DEVETIMEKVERDVKRWEELTREIKRRSDKLIEDWKKRSEEVLRESTELIKTIEKLLREG

SEQ ID NO: 3179 - protein, 56 aa, Artificial Sequence
  Synthetic sequence.
ESVLRTIDELVRRLEEEDRKVHEESKELARRLEKEDKRLHEESKKLIDELEKKIRD

SEQ ID NO: 3180 - protein, 59 aa, Artificial Sequence
  Synthetic sequence.
SEVEKILDEVRKLVKKWDDETRKILEEIDKLIEDSERLLEKIERRSKKLADEIRDLLRK

SEQ ID NO: 3181 - protein, 56 aa, Artificial Sequence
  Synthetic sequence.
KSVLDEIRERVTRAKEKDKRVLERVKREVERTKEESKRVHEKSREIIERLKKEIDK

SEQ ID NO: 3182 - protein, 57 aa, Artificial Sequence
  Synthetic sequence.
DEVRKVRKELDDAVRKLRRDHERVIRESEKVSKEIEDRARDVERRLDKVVDELRKKD

SEQ ID NO: 3183 - protein, 55 aa, Artificial Sequence
  Synthetic sequence.
EEVMKRLRDMIRRLKEDAEKLKRELKRRHERVKELLDKVRRELEKLEKEVDDKVK

SEQ ID NO: 3184 - protein, 57 aa, Artificial Sequence
  Synthetic sequence.
DEVREVERESEELSEELRRRHEEVVKESEEVSKEIEERIREVIRDLRRVLRKLEEDG

SEQ ID NO: 3185 - protein, 55 aa, Artificial Sequence
  Synthetic sequence.
EEVVKELRELHDRSRKKVEDIAREARDMHRKAADKLRRLMEDLKRVLEEIRKKVE

SEQ ID NO: 3186 - protein, 56 aa, Artificial Sequence
  Synthetic sequence.
SRVDKIRRELRELLERDREDLERAMRELRKIDKDIDERLKEVVERLRRIDERIDRE

SEQ ID NO: 3187 - protein, 55 aa, Artificial Sequence
  Synthetic sequence.
KEVEKEVEDAIRETEKRAREVEEENRKSVEDVRRKMKKVEEENRKSVEDVRRKAT

SEQ ID NO: 3188 - protein, 56 aa, Artificial Sequence
  Synthetic sequence.
SRVDKIRKELEDLLREDEKRIRDMVKRLREIDEKIDRELEKVARELRELLKRVEDS

SEQ ID NO: 3189 - protein, 55 aa, Artificial Sequence
  Synthetic sequence.
EEVEKKVRELVERTEETVRDVERENKESVKRVREKAETVKREVEKRAKEVRDKAK

SEQ ID NO: 3190 - protein, 60 aa, Artificial Sequence
  Synthetic sequence.
SEMEEVEERLKELDDKDKRDVDEARKRLEKLDRDIDRRIKEVTKRLRDLNRRIEEELRRN

SEQ ID NO: 3191 - protein, 55 aa, Artificial Sequence
  Synthetic sequence.
EEVEKKNRKSADDSRETAKRVEEENERTIKRLEEELREVEEEDRKTVEDLRRTLK

SEQ ID NO: 3192 - protein, 60 aa, Artificial Sequence
  Synthetic sequence.
DEVREVTKELRDLDREDKKRVEEATKRLRDLNEEDKRLVKKVADDLREDLKRIRERLERN

SEQ ID NO: 3193 - protein, 55 aa, Artificial Sequence
  Synthetic sequence.
EEVEKENERSVKKSEEDLKRVKDEDEESVKESRKAVREVEEELRKRLKELREELK

SEQ ID NO: 3194 - protein, 57 aa, Artificial Sequence
  Synthetic sequence.
SEDETVRREVRELIRRLRKHSEDVKRESDKLLDEIRRRVKEVEDRVKEAVERLDRKK

SEQ ID NO: 3195 - protein, 55 aa, Artificial Sequence
  Synthetic sequence.
EDVVRKIRTVVKKIEEDNKKTADELRKLHKDIKKEVDDMEKRIRKVLDEIDKEIK

SEQ ID NO: 3196 - protein, 57 aa, Artificial Sequence
  Synthetic sequence.
DEEERARRELEDLLRRLREHSERVAKEVEEVVERNRRKSEEVEKRVREMLKRLDEKK

SEQ ID NO: 3197 - protein, 55 aa, Artificial Sequence
  Synthetic sequence.
KDVVKEIRDRVREAERRNREVVEEIRKLLKEIDKTTRDVEEEIRKLLKRIDEEIN

SEQ ID NO: 3198 - protein, 57 aa, Artificial Sequence
  Synthetic sequence.
DEERKARTEVKKEVDDLKKHVKDVADEVREAVKKNRRKSEEVSREVRDLIRRLKETK

SEQ ID NO: 3199 - protein, 55 aa, Artificial Sequence
  Synthetic sequence.
EDVVREIRELLKRIREENRRTVEEIRKLLKRIDEATEELVREIRRVVKEIEDKIR

SEQ ID NO: 3200 - protein, 57 aa, Artificial Sequence
  Synthetic sequence.
DREEKLRKELKKLIDDDRKKSEDVEREVRKLIKENEDKSRKVEEEVRKLAEELDTKK

SEQ ID NO: 3201 - protein, 55 aa, Artificial Sequence
  Synthetic sequence.
EEVIKEIRTVVKRVNEESEEMTKRIRDVVREADKTTEDVRRKIEDMVRRIDERTN

SEQ ID NO: 3202 - protein, 60 aa, Artificial Sequence
  Synthetic sequence.
DELRRIEEEVRRRFEEMARRHRKVKRDIEELVKEVTKRNKDTEREIEELVKRMKDEIDRI

SEQ ID NO: 3203 - protein, 59 aa, Artificial Sequence
  Synthetic sequence.
EEKVRRVVKKAREAVERSSREVEKVEREVKKLLDDLKKHSEEVEKKVRELLKRLEDRAR

SEQ ID NO: 3204 - protein, 60 aa, Artificial Sequence
  Synthetic sequence.
SELEEIVKTAREIMDRVRREHDRVATEIRELVKRLEEANRRVREEIKRLVKEVEERIRKI

SEQ ID NO: 3205 - protein, 59 aa, Artificial Sequence
  Synthetic sequence.
REEVEKVVKEIEDVVRESSERVRRVVEEVKKLLRELAKHSEDVEREVRELLKKLAREVD

SEQ ID NO: 3206 - protein, 58 aa, Artificial Sequence
  Synthetic sequence.
DELKEIRDRIKKRVEELRRENEEVREEIERIVRKAREDHRRVERELEDLVRRARDKVE

SEQ ID NO: 3207 - protein, 59 aa, Artificial Sequence
  Synthetic sequence.
EEEVRRVVKEVEELLEDLKRHSEKVKEEVKRLLEESSREVERVEEKAREMLERLRERAR

SEQ ID NO: 3208 - protein, 60 aa, Artificial Sequence
  Synthetic sequence.
SEAEKLRDEIRRIVEKAERDHEDVKKKIEDLVKRVEERNREVTKRIRDLVRDARRRLDEI

SEQ ID NO: 3209 - protein, 59 aa, Artificial Sequence
  Synthetic sequence.
KDKLKKVEEEVEELLKKSNRKVREVKRELKELLDRLAKHSDEVRREVEELLRDLARRAT

SEQ ID NO: 3210 - protein, 60 aa, Artificial Sequence
  Synthetic sequence.
SELEKIREDMRELVERLKEANDRMREKIRKILEDVDREHEEVRKRIEELVKRARETIERI

SEQ ID NO: 3211 - protein, 59 aa, Artificial Sequence
  Synthetic sequence.
KDKVKKVKEDVKRLLDELRKHSEKVIREVEKLLRESNEKVKRVKEKLEELLRRLRERSR

SEQ ID NO: 3212 - protein, 56 aa, Artificial Sequence
  Synthetic sequence.
DEIETIKKEIDDMLREIKREVERSKEEIDRALKRIREEVKKSEEEIDKALEELRRN

SEQ ID NO: 3213 - protein, 59 aa, Artificial Sequence
  Synthetic sequence.
EEIIKRLLEKIRREARKVKELIRTSNEEVRKRLKDLEELIRKSHEDVRRTLETLERETR

SEQ ID NO: 3214 - protein, 60 aa, Artificial Sequence
  Synthetic sequence.
DKERELDKEVRDMIDTLRDSNRRINERSERVLRELDESVKKNEEDIRRAIEELKAEVRRD

SEQ ID NO: 3215 - protein, 55 aa, Artificial Sequence
  Synthetic sequence.
EKVLKEIRDLARKIKEDNDRSLEDNDRLAKEIKERNKRVHDETRKMLEDIKRELT

SEQ ID NO: 3216 - protein, 57 aa, Artificial Sequence
  Synthetic sequence.
DEDKEIDERVKTVKEEIRRRSKKDKEEVDRVLKESDETLKRILEEVKKVLKEIEERV

SEQ ID NO: 3217 - protein, 59 aa, Artificial Sequence
  Synthetic sequence.
EEELRRIVERVRERVTELREKLKEIHKRTREVADELRKNNRRWEEDVRRLVKELREREE

SEQ ID NO: 3218 - protein, 57 aa, Artificial Sequence
  Synthetic sequence.
DEEERIRTKVEKVKRELEEKSERDKRALEKVEDESRRTSEEDERELERVIEEIIREV

SEQ ID NO: 3219 - protein, 59 aa, Artificial Sequence
  Synthetic sequence.
EEELRRIEREVDRAVKELDRLLRELHRRTREVVKELRDLDRRIHEDTRRVVREAREEVR

SEQ ID NO: 3220 - protein, 57 aa, Artificial Sequence
  Synthetic sequence.
SEREEIEERVERVERESEDTSRRDEEALERVLRESEDTSRKDREALRKALEDIEREL

SEQ ID NO: 3221 - protein, 59 aa, Artificial Sequence
  Synthetic sequence.
EDVLRRIMEDVKRVADKLRELDKKIHEETRRAVDDLRRLDKEIHDRTRKLVKELREEAK

SEQ ID NO: 3222 - protein, 59 aa, Artificial Sequence
  Synthetic sequence.
SEIEEITKDLRRLVEEIERLNKRVEDENERTAKELRDRVREAEKKNRKTVDDIRKLIED

SEQ ID NO: 3223 - protein, 55 aa, Artificial Sequence
  Synthetic sequence.
DEVRREVDELIKKSRETLKRIERRSEEVAEELERRLRDIKRRSEDMVRELEERAK

SEQ ID NO: 3224 - protein, 59 aa, Artificial Sequence
  Synthetic sequence.
DEKEKVTKKIEELLKAIEDKIREVEKRSRDSAKEIEDRNREVEKRNKDTVRRIRELIER

SEQ ID NO: 3225 - protein, 55 aa, Artificial Sequence
  Synthetic sequence.
EEVRKRLEDAVERIKKELKRIKDENDEVVKKSRDSLRRIKEDSERVVRELEERAK

SEQ ID NO: 3226 - protein, 59 aa, Artificial Sequence
  Synthetic sequence.
KRKEDIERRIEKLVRDDRRLVREAEKRSKESVDRLRDLVDKARKESDESARTIDKLIKD

SEQ ID NO: 3227 - protein, 55 aa, Artificial Sequence
  Synthetic sequence.
ERVRKRLEDVVRESKKRLDEIKKRNEDVVRELEERLRRIEERNRRVAEELKRKAK

SEQ ID NO: 3228 - protein, 56 aa, Artificial Sequence
  Synthetic sequence.
SEIEDIERELRESNKRHEDTLRKIKRDLEDSNRRHRETIRDIEARLEEVIKKLRED

SEQ ID NO: 3229 - protein, 56 aa, Artificial Sequence
  Synthetic sequence.
EEELRELVKRVHERAERVNRDLKRKVKEVHDRVREVNKELRRKVEELKRRAEERRR

SEQ ID NO: 3230 - protein, 56 aa, Artificial Sequence
  Synthetic sequence.
SEIEDIKRKLDDVIREHARTLKEIKDELKKSNERARERIEDIDRKLRDVERRLRES

SEQ ID NO: 3231 - protein, 56 aa, Artificial Sequence
  Synthetic sequence.
VEELEDLVRRLKKRVEEVNKRLREKVKRLHDEVDRVLRELEEEVKKLKEDVERAAK

SEQ ID NO: 3232 - protein, 56 aa, Artificial Sequence
  Synthetic sequence.
SEREKIEEDIKKALKEAREVVERIKKKLDDSNREHKRTLDEIKKKLDEVIDEVRKS

SEQ ID NO: 3233 - protein, 56 aa, Artificial Sequence
  Synthetic sequence.
EEEIREDLERIVTEVKKVLDELDKLVKDLHDEVRKVNEELDRKVKKLRKEAEEKTR

SEQ ID NO: 3234 - protein, 56 aa, Artificial Sequence
  Synthetic sequence.
SEIEEIKRRLEDSNRRAREVIKRIEDELRRSNEEHRRTLKEIKEELDRVLEELKRK

SEQ ID NO: 3235 - protein, 56 aa, Artificial Sequence
  Synthetic sequence.
EDELREVVKRVHDEVRRELKKLEELVKKVHEDAKRVNEELRRKVKEVKERAERDVR

SEQ ID NO: 3236 - protein, 59 aa, Artificial Sequence
  Synthetic sequence.
RREEEVEKRLDDARRRLEKSNRDDERLTRTVEEELKRSNDEIRKRLETAMRELKKLVKD

SEQ ID NO: 3237 - protein, 55 aa, Artificial Sequence
  Synthetic sequence.
EEVERRLEKVEEDSRRELKRSEKRSDEVARDSERLLDEWRRRLEEVIRRVKEETR

SEQ ID NO: 3238 - protein, 59 aa, Artificial Sequence
  Synthetic sequence.
SREETVRERLREVAERLKKSNREIEELLKKAAEELKESNTRDKKLSEDVSRRLEKLSRD

SEQ ID NO: 3239 - protein, 55 aa, Artificial Sequence
  Synthetic sequence.
EEVEERLKRVIEESERRLDKWRRDLDRVIKESEDLLKKSREDSERVVREVEKKEK

SEQ ID NO: 3240 - protein, 60 aa, Artificial Sequence
  Synthetic sequence.
SEIEEVERMLEDLERRVREADKRVREESKKLEDEIRREDKRVEEMIDEVRKKVDELDRDV

SEQ ID NO: 3241 - protein, 59 aa, Artificial Sequence
  Synthetic sequence.
KDEVRRIEEEVDRVIEENRETVKEIEERNRRVLEANRESLRELEERLKRILEEVRRRSK

SEQ ID NO: 3242 - protein, 60 aa, Artificial Sequence
  Synthetic sequence.
SEIDEVRREVEELERRAEEVDREVERRSKELKERVDDVDRRSRELSKRLKDTADEVRKRV

SEQ ID NO: 3243 - protein, 59 aa, Artificial Sequence
  Synthetic sequence.
KDKLETIRRRLEEVLKRNKETVDEIRRRNEDVIRRNEESLEKNERDLRRVLDEVRRSAT

SEQ ID NO: 3244 - protein, 60 aa, Artificial Sequence
  Synthetic sequence.
SELEKVDELVKRLMKEVRDVDRRSEKLTEELERKVREMDRKSKKLSEDLERDARRVEKEV

SEQ ID NO: 3245 - protein, 59 aa, Artificial Sequence
  Synthetic sequence.
KDALRAIEKKLEDILRRNEETLRRNEDKIRRIIETNKRSLEENRRRLEEVLRRVKESAR

SEQ ID NO: 3246 - protein, 60 aa, Artificial Sequence
  Synthetic sequence.
SITEKVERLIRELERKVKEIDDDLRRTSEEIMKRARKADEDSERLSERLRELVDRLDREV

SEQ ID NO: 3247 - protein, 59 aa, Artificial Sequence
  Synthetic sequence.
RESAERLKEELRRVLEENRETLERLREENERVLEENKRRVDENREKIKEVLRRVEERTR

SEQ ID NO: 3248 - protein, 60 aa, Artificial Sequence
  Synthetic sequence.
SITERVEEDIKRLMEEAKRVDDKVRKLVEELMRDVKRVDKELAELVEELERRVKDLTRRV

SEQ ID NO: 3249 - protein, 59 aa, Artificial Sequence
  Synthetic sequence.
REEAERLKEELRRVLEENRRTVEEIERRIKRVLEENEETVRRLEKRIEEVLRDVREKTK

SEQ ID NO: 3250 - protein, 57 aa, Artificial Sequence
  Synthetic sequence.
SKVEELKRRLKKVRDDDRRSVEKLRETLRRVLARDRDEIREAERELREALKRLEDAG

SEQ ID NO: 3251 - protein, 55 aa, Artificial Sequence
  Synthetic sequence.
EDVLRDVERVVREVLEKNKKILKEVKEVVEESLRNVRDLIRRAREIVKEIVDRVK

SEQ ID NO: 3252 - protein, 57 aa, Artificial Sequence
  Synthetic sequence.
KEVEDLRRELEEAKKRDKDLIDKLKRRAEEVKEEDERSIRENKKALRKAEEDLRRKG

SEQ ID NO: 3253 - protein, 55 aa, Artificial Sequence
  Synthetic sequence.
ERVLEEVRKTLKRSMENVEELEKELEELVTRVRDHNRRDHEETRRLLEEIKRRVD

SEQ ID NO: 3254 - protein, 57 aa, Artificial Sequence
  Synthetic sequence.
DEVERLKEKLEEVRRRDEEIIRKLEEDLERVKRDDDRLVRENEEELKRVEEKLERDG

SEQ ID NO: 3255 - protein, 55 aa, Artificial Sequence
  Synthetic sequence.
EEVLRRVEEAAKRSLDNVDKLEKDVADLVRRSMENVRDLHRRTRRLLEELKEKVK

SEQ ID NO: 3256 - protein, 60 aa, Artificial Sequence
  Synthetic sequence.
SEKEKVLEDAERVLREIKKKNEKALREAEEVARRIAEEVKRIHDRSKEVVDDIKRLADAG

SEQ ID NO: 3257 - protein, 55 aa, Artificial Sequence
  Synthetic sequence.
KDVERRVREAKKENDKSVDEIREEVKRVKDELDRLSERNEEELEKVERDLRRRAK

SEQ ID NO: 3258 - protein, 56 aa, Artificial Sequence
  Synthetic sequence.
DEEKKVLDKLRELATRLSRRVEEAHRESEKIAEEIRRRAEKVLRESRKTVEEIKRS

SEQ ID NO: 3259 - protein, 55 aa, Artificial Sequence
  Synthetic sequence.
ERIKDDVRRMKKELEDLIEENRRRVEKVKEDIRRLIRELEARNEDVDRELRRKED

SEQ ID NO: 3260 - protein, 56 aa, Artificial Sequence
  Synthetic sequence.
SRLEKVEKELEELAREDKERIKRVIDDIRRLVREDEERIKEMHKKTEDIVRAIEEE

SEQ ID NO: 3261 - protein, 55 aa, Artificial Sequence
  Synthetic sequence.
ERIKKRVEKLKRDSKRLIDELRKELEEVVKRSEDLIKENRDTVKEVSDRIREKAR

SEQ ID NO: 3262 - protein, 56 aa, Artificial Sequence
  Synthetic sequence.
DDEERVLKELKKLVEDDRKKIEDVIETIERLAREDVERIKRVIEELRRLVKELEDG

SEQ ID NO: 3263 - protein, 55 aa, Artificial Sequence
  Synthetic sequence.
EEIKEDVKRAADESEKLIRELRKAVKRVEEESRRLIEELEREVKEAEERLKRRTK

SEQ ID NO: 3264 - protein, 60 aa, Artificial Sequence
  Synthetic sequence.
EEVERLLEELKELVRRIEERLKRAHDEMEDLVRRIKEEIKKLHEDTKRVVEEIRKLIERD

SEQ ID NO: 3265 - protein, 58 aa, Artificial Sequence
  Synthetic sequence.
ERVKEAEDRVRDAVRRLKRLLEEHKKASEKVVRELERLLEENRKTVKEVVDRLREESR

SEQ ID NO: 3266 - protein, 60 aa, Artificial Sequence
  Synthetic sequence.
REVEELIKELRRLAEEIRDRIRKLHKEMEDLARDIERRIEELDRELERVATEIAKLIERD

SEQ ID NO: 3267 - protein, 58 aa, Artificial Sequence
  Synthetic sequence.
EDIKRLEEEVRKVEEELKKLLKEHRDANKEVVDRLKRRIEEHKRKTKDLKEELERRMR

SEQ ID NO: 3268 - protein, 60 aa, Artificial Sequence
  Synthetic sequence.
DEVEEVIERLRRLAERIEERLREMDRRLEELVERAKRTIERLHEELEKLVREAEELIRRD

SEQ ID NO: 3269 - protein, 58 aa, Artificial Sequence
  Synthetic sequence.
KDVTRLEEELRRVVKKLEDLLREHKEKSDRAVEDLERLLTEHKKRNEDVIRRLKEASD

SEQ ID NO: 3270 - protein, 57 aa, Artificial Sequence
  Synthetic sequence.
SEVEEIRKKAEDVMRRLEELDKRLDEVLKKVSRELEKSDKDLEDRIREVIRELEERG

SEQ ID NO: 3271 - protein, 55 aa, Artificial Sequence
  Synthetic sequence.
DEMERRLEEVVKEAERRSEEVLRRLEKVVKDIKKKSKEILDRLEELVREIRERVR

SEQ ID NO: 3272 - protein, 56 aa, Artificial Sequence
  Synthetic sequence.
SESEEIDREAKKVEREVREMSRRNDEELRRVAKESEDSVRRVEDRVREVSEEVEAR

SEQ ID NO: 3273 - protein, 59 aa, Artificial Sequence
  Synthetic sequence.
EKELTEILKRLKDLADELRKLLEDVHRRSKKAADEDRKLNEDILKELEDLARELRKKTK

SEQ ID NO: 3274 - protein, 56 aa, Artificial Sequence
  Synthetic sequence.
DEEKKVRDEIRRAEEESRRSSKRNEDELRKVKEEIERRLEEVRRKAKEVEEKVRRE

SEQ ID NO: 3275 - protein, 59 aa, Artificial Sequence
  Synthetic sequence.
EEELRRILERLKEMVERDKETNEEIHRRSKDVVDKLRRRIEDIKRRLDELAEKLKEDTR

SEQ ID NO: 3276 - protein, 56 aa, Artificial Sequence
  Synthetic sequence.
DDERRIRETLKRADEEVEKALREVREHTKDVERENEKLSKENKERLEEVKKRVDDS

SEQ ID NO: 3277 - protein, 59 aa, Artificial Sequence
  Synthetic sequence.
KDVLRKIEKEIEEMVKDLRRLLKEVEDKDRTLAEELRRINEDIHRRSEEMKKELDDRTR

SEQ ID NO: 3278 - protein, 60 aa, Artificial Sequence
  Synthetic sequence.
KEVEDVEEKIREIVERIRDEARKAEERNRDTVRRIEDVARKLHKRTKEIVDEIRDVLTKR

SEQ ID NO: 3279 - protein, 59 aa, Artificial Sequence
  Synthetic sequence.
KEMLETIKRKVEKVKEDLRKKIEDIEKHTRDVEDKVRKELERNEKKSRDVKEEVERRLT

SEQ ID NO: 3280 - protein, 60 aa, Artificial Sequence
  Synthetic sequence.
SELEKAEKENKDSADEIREVLKRLEEENRETAKRIEKHTRDAHRKTEDIVRRIEEVLRRR

SEQ ID NO: 3281 - protein, 59 aa, Artificial Sequence
  Synthetic sequence.
KEALKRIRDHVEEVRREVEELLRKIREHTKEVAEKVRRENEKNKKRSEDVRKKVEDDER

SEQ ID NO: 3282 - protein, 60 aa, Artificial Sequence
  Synthetic sequence.
SEVERVLEENRKSAKEIEDELRKVLRENEKSAEDIEREIDKAEKENRETVKDLRRVLTER

SEQ ID NO: 3283 - protein, 59 aa, Artificial Sequence
  Synthetic sequence.
KEKLETIERHVRKVEEDVERMLKEIERRTRDVMRKVDKLIKEIEKHTREVAKEVKEAED

SEQ ID NO: 3284 - protein, 56 aa, Artificial Sequence
  Synthetic sequence.
SLVEDLERKLEESTRRDEESMKRVREILKELEDRDRKSVKEIEDELRKARKEVKDS

SEQ ID NO: 3285 - protein, 59 aa, Artificial Sequence
  Synthetic sequence.
EEMAREVIKTLEKVSRELEETNRRVIDRIRKLAEEILRKNKEVLERLRKIVKEIKEKAK

SEQ ID NO: 3286 - protein, 56 aa, Artificial Sequence
  Synthetic sequence.
SLVETLKKILDDSTRRNEELIRRLEEELKRIKETNERTVRELERELKRAEEEIERQ

SEQ ID NO: 3287 - protein, 59 aa, Artificial Sequence
  Synthetic sequence.
EEAAKRVIERLRRLSERNVRTLEEIIKTLRDLARRSKERDDEVLEELKEMIRRIEEKSK

SEQ ID NO: 3288 - protein, 57 aa, Artificial Sequence
  Synthetic sequence.
DELEKVVRELEELAKEILKKLDEIIRDTERLVREAVKRLRELIERTRRLMDEVRKKV

SEQ ID NO: 3289 - protein, 59 aa, Artificial Sequence
  Synthetic sequence.
EKVMRELEDTVRRVREELRKLLEEHNRRVKKVLEDLDRLLDEHRKIVEDIKRDLDRREK

SEQ ID NO: 3290 - protein, 57 aa, Artificial Sequence
  Synthetic sequence.
SEIEKVLEELRELVKKAVTDLRRIIEESKRLADEAAKALKDIIRRSEELADRLRKEI

SEQ ID NO: 3291 - protein, 59 aa, Artificial Sequence
  Synthetic sequence.
EKLARELEDVVRKVKETLDRLLEEHKEIIERIKRTLDKLLKEHNEIVERIKRDLDRRRK

SEQ ID NO: 3292 - protein, 57 aa, Artificial Sequence
  Synthetic sequence.
DEMEKVIRDDEKLLEDVLRRLAEIIRRTEKRAEEMVRELEKLIEDSKRKADDVRKRV

SEQ ID NO: 3293 - protein, 59 aa, Artificial Sequence
  Synthetic sequence.
EEVVKRLDDIARDVNRTLDKLLKDHNEIVERIERTLDELLKEHNEIVKRIKEDLDRKRK

SEQ ID NO: 3294 - protein, 57 aa, Artificial Sequence
  Synthetic sequence.
DDAETVIERDRKLADEVAKELKRLIEETRDLARRIREELRRLIEELKTLAKRAKDEV

SEQ ID NO: 3295 - protein, 59 aa, Artificial Sequence
  Synthetic sequence.
RDVVRELREIARKINEDLDDLLRKHNEIVEKIKRDLDRLLEEARKILEEIKRELDETKK

SEQ ID NO: 3296 - protein, 60 aa, Artificial Sequence
  Synthetic sequence.
DEEERLRDSVRRSRELIKEIRKRLEESIRRSERINERVREELRRSVRESERSAEEARRRG

SEQ ID NO: 3297 - protein, 56 aa, Artificial Sequence
  Synthetic sequence.
TETVLEEHKERVKRILDRARDLLRKHRELVEDSRRHLEKLLRDHRKVVKEIEDKIR

SEQ ID NO: 3298 - protein, 59 aa, Artificial Sequence
  Synthetic sequence.
SEEERLRESLERSRKRLEEVKRELERKLEEWEEIVEESRRRAEKSLRESKERIDDLKRR

SEQ ID NO: 3299 - protein, 56 aa, Artificial Sequence
  Synthetic sequence.
TEEVLRRHEKVVRRIDEELEELLEELERVIREDTERNKKLLDEHREVVKEIEERVR

SEQ ID NO: 3300 - protein, 60 aa, Artificial Sequence
  Synthetic sequence.
SSEKRLRDSVRESRDRARKIEEDHRRLVEEWERLVKRSEEEVRKSVEESREEVEKAKKEG

SEQ ID NO: 3301 - protein, 56 aa, Artificial Sequence
  Synthetic sequence.
TDKVLEDHKRLVEKILKEAEDNLRRSRKMIREDEERNRDLLRRHREVVKEVKRKVD

SEQ ID NO: 3302 - protein, 59 aa, Artificial Sequence
  Synthetic sequence.
DKEERLRESLEKSDRDIRRIKEELERLLREWEKRVRDSEKELRDVLRKVTEEAKELKKQ

SEQ ID NO: 3303 - protein, 56 aa, Artificial Sequence
  Synthetic sequence.
TDDLLRRHKEVVEKILREIEELLRELREAIRRDKKRNDELLKRLAEVAEKIREDVR

SEQ ID NO: 3304 - protein, 60 aa, Artificial Sequence
  Synthetic sequence.
SEKETLERSIRESERILEEVLRELKKVLDEWRRRVEESEKRHRDLIEEVRRRAKKLREDG

SEQ ID NO: 3305 - protein, 56 aa, Artificial Sequence
  Synthetic sequence.
TDDLLRRHKELVEEIKELLERLLRELEEVIKRDKDKNDENLTRSKRLIEEIEERVR

SEQ ID NO: 3306 - protein, 60 aa, Artificial Sequence
  Synthetic sequence.
DSEERLKESVKRSEDDLKRLRDEHRKLVEEWRRRIDESERRHRKLIEDVRRRLTEFRKRG

SEQ ID NO: 3307 - protein, 56 aa, Artificial Sequence
  Synthetic sequence.
TDRLVEEHKKMVKEIRDRVKANLERSRRMIKRDKEKNDDNLRRSKELIDKLEEDVR

SEQ ID NO: 3308 - protein, 59 aa, Artificial Sequence
  Synthetic sequence.
SKEERLRESSRRSEKAVREVEKRHKESVERSKEEIRRLAEELRKSIEDSERRIKEIRER

SEQ ID NO: 3309 - protein, 56 aa, Artificial Sequence
  Synthetic sequence.
TDRLLEEHRKLVERILEELEKNLERHRRVVKEILDRVKELLDEHRRRVEEIERKIE

SEQ ID NO: 3310 - protein, 59 aa, Artificial Sequence
  Synthetic sequence.
SKEETLKRSSEESKKELKRVDEELEKIIREWEEDVKRSEKELEEVIERAKREAEKLRTR

SEQ ID NO: 3311 - protein, 56 aa, Artificial Sequence
  Synthetic sequence.
TDTLLERHKRLVEEVREKLERLLRRLRKVIKEDRERNKRLIKRLKEVIDEIRERVR

SEQ ID NO: 3312 - protein, 59 aa, Artificial Sequence
  Synthetic sequence.
SERERLEDSSRKSKERLERIARTLEKLLRDWRREVEKSEKRHRELVEKVRRDLDDLRRR

SEQ ID NO: 3313 - protein, 56 aa, Artificial Sequence
  Synthetic sequence.
TEKLLRDHKRLVDDLDRRAKELLEELKRVIDEDKKRNEKNLTDSRRLVEELKEEVR

SEQ ID NO: 3314 - protein, 59 aa, Artificial Sequence
  Synthetic sequence.
SSKERLEESSERSERSIERIDREHERSSEESERRLKKMVDDLRRSSEKSKDDLEKLKRE

SEQ ID NO: 3315 - protein, 56 aa, Artificial Sequence
  Synthetic sequence.
TDELVERHKRVVEEIEERAERNLRRHKKVVEDILREARKVLEDHKELVERLKERVE

SEQ ID NO: 3316 - protein, 59 aa, Artificial Sequence
  Synthetic sequence.
DAERRLKKSSEDSKRAIDELRKEHEDSSRESKERLDKIKRDHEELVRRARERAEELRRR

SEQ ID NO: 3317 - protein, 56 aa, Artificial Sequence
  Synthetic sequence.
AEKLVTDHKRVVETILDKARKNLDRHRRAVEDLLRKARENLKKTEELVRKLDEDVR

SEQ ID NO: 3318 - protein, 59 aa, Artificial Sequence
  Synthetic sequence.
DAERRLREILRRVTERLKEVKERHKRSSEKSKKSADDVRREHEKLAEELRRKVEELKRR

SEQ ID NO: 3319 - protein, 56 aa, Artificial Sequence
  Synthetic sequence.
TDTVIEELKRRIRELEKRLEENLRRHEELVRRIEEELKRNLKRSRDLLKEIEDKVR

SEQ ID NO: 3320 - protein, 59 aa, Artificial Sequence
  Synthetic sequence.
SEAEEVLRRLEELAKRDREENKKVLDDLEKLVREDEERNKEVLKDLEKFIDELDKELRS

SEQ ID NO: 3321 - protein, 59 aa, Artificial Sequence
  Synthetic sequence.
KDVVRELERLLREWERDNERSREEIDRVIEEARKRNEDSERELDRLIKEVKDRLDEKAR

SEQ ID NO: 3322 - protein, 59 aa, Artificial Sequence
  Synthetic sequence.
SDAEDVLRKLKELIDRDTKENDEVLRKHKRLTDEDRRKNEEVVRELRKIITRLDEKLRA

SEQ ID NO: 3323 - protein, 59 aa, Artificial Sequence
  Synthetic sequence.
KEVLDRIRDLLRRWRERNEESRRRAEKSIRDSDETNKRSREEIKRIIRKLREILKERKR

SEQ ID NO: 3324 - protein, 59 aa, Artificial Sequence
  Synthetic sequence.
SDVEKVLRELEELIDRDRRDVEKVIEELRKLIKEDEEENREVLKRAEKMLREIREKLRN

SEQ ID NO: 3325 - protein, 59 aa, Artificial Sequence
  Synthetic sequence.
EKFLRDIRETLKRWKERNEELTRRLREIIREVEERNEESKRRLDELIREAEEDMRRRRT

SEQ ID NO: 3326 - protein, 59 aa, Artificial Sequence
  Synthetic sequence.
SEAERVLEDLKRLIDEDRKKLREILEDHKRLTDEDRERNRRVLEELDKIIKELDERLRS

SEQ ID NO: 3327 - protein, 59 aa, Artificial Sequence
  Synthetic sequence.
KDVLDKIEKSLRDWERDNERMVKEADRSVKRSDETNEKSREDLERLIEEARRRLKERER

SEQ ID NO: 3328 - protein, 59 aa, Artificial Sequence
  Synthetic sequence.
SEVERVLEELEELARRDEEKNKRVEDRLRKLIEDDRRDLRRILERLREIAERLKEEAES

SEQ ID NO: 3329 - protein, 59 aa, Artificial Sequence
  Synthetic sequence.
EEFVRRIRDLLRRWKEEVDRSEDRIRRELEKWERENEEAEKRIRKIIEDLRREIKKKAD

SEQ ID NO: 3330 - protein, 59 aa, Artificial Sequence
  Synthetic sequence.
SKLERVLEELERLIREDEDENKKILDRLKKLIDEDKKENDEIMETLKEIARKLTEELRS

SEQ ID NO: 3331 - protein, 59 aa, Artificial Sequence
  Synthetic sequence.
EEVLRRIRELIKEVRRRNDESRERIERLLKEWRERVDASERTIREIIKEIKERVRRARK

SEQ ID NO: 3332 - protein, 59 aa, Artificial Sequence
  Synthetic sequence.
SKAEDVLRKLKELIDRDRDENRKVLDELRRLIERDREKNRRIMEKLKKIVRELEEALKV

SEQ ID NO: 3333 - protein, 59 aa, Artificial Sequence
  Synthetic sequence.
EDVLKRIEDELERWKEEVERSKREIEKLIKEARDENDKSRKTIEKIIREAEKILRDRDR

SEQ ID NO: 3334 - protein, 59 aa, Artificial Sequence
  Synthetic sequence.
SEAERVLEELKELIERDEEENRRILEEHKRLTEEDLRENREVMKRLEDIIRELEEKLRT

SEQ ID NO: 3335 - protein, 59 aa, Artificial Sequence
  Synthetic sequence.
EKVLTDIERLIREAEKRNRDSKREAEKSVKKSDELNERSRRRIEKIIEELRRLVDTRRT

SEQ ID NO: 3336 - protein, 60 aa, Artificial Sequence
  Synthetic sequence.
SDVEKFLDELRELIRRSKERVDRMLRKLEELIRRSSEDVERLLKELKELIDDIRRLLDEN

SEQ ID NO: 3337 - protein, 59 aa, Artificial Sequence
  Synthetic sequence.
DELRERIKRLLEEHHKRLREAVEELRKLVEDATEEHERLSERAKRLVEEVKKRVDERER

SEQ ID NO: 3338 - protein, 60 aa, Artificial Sequence
  Synthetic sequence.
DEVEKVLRDLEELIRRSETDIRRLLEELKKLIDDTRREVKKVLDDLRRRIKEVLDRIRRN

SEQ ID NO: 3339 - protein, 59 aa, Artificial Sequence
  Synthetic sequence.
DEARERLKDTVTKASRRHEKVERDLEKLLEEHHRAIEKLRKELRDLVRKAKEDIDRARK

SEQ ID NO: 3340 - protein, 60 aa, Artificial Sequence
  Synthetic sequence.
DEAEKVRREHRELVEDSLRKAEEALKRLDELIKRTEKRVKDVEEELKRLIKRVLDEVRKN

SEQ ID NO: 3341 - protein, 59 aa, Artificial Sequence
  Synthetic sequence.
DEVKRRLRTSDKKVSEKHKELLDRLRELLRRHHESLKRLEERIRKLVTDATRRIEEEEK

SEQ ID NO: 3342 - protein, 60 aa, Artificial Sequence
  Synthetic sequence.
DEVEELLKEHRELVKESKKTVEKMLRELEELIKRTRDEVEKVERTHEELVRRVDEVLKRR

SEQ ID NO: 3343 - protein, 59 aa, Artificial Sequence
  Synthetic sequence.
DELKERLKESDKEASDLHEKAREDLERLLKKHHDDLRKIMERLERSDKEAKKRLEEEKT

SEQ ID NO: 3344 - protein, 60 aa, Artificial Sequence
  Synthetic sequence.
DEVEKLLKELEDLRRKTREDLERVKKELEELVKRSKDRLREAEDELRRLVEDIERVIRED

SEQ ID NO: 3345 - protein, 59 aa, Artificial Sequence
  Synthetic sequence.
DELKKRIRELVKEHTDELRKVKRELEALVEKATEDHERVLRRLEELVERIKREVDKAEK

SEQ ID NO: 3346 - protein, 60 aa, Artificial Sequence
  Synthetic sequence.
SDAEDLLREHRELVERSKREVERVLDELRRLIEKSLREVEKVLKELEKLIREILDRVRKN

SEQ ID NO: 3347 - protein, 59 aa, Artificial Sequence
  Synthetic sequence.
DRVREELRRSDEKVSRDHEELVKEAERLVDEATKEHRKLKRRIRELVRRAKEEIEKLRK

SEQ ID NO: 3348 - protein, 60 aa, Artificial Sequence
  Synthetic sequence.
SKVEDILRRHRELVKKSLDEIRDLLRKLKRLIEESLRRVEEVLRDHERLVREIEDRVRKN

SEQ ID NO: 3349 - protein, 59 aa, Artificial Sequence
  Synthetic sequence.
DELKRRLRESDKRVSERHKRATEEIKKLLDRATEEHKKLVKRLRDSDKRVADELDKAEK

SEQ ID NO: 3350 - protein, 60 aa, Artificial Sequence
  Synthetic sequence.
DDVDRVRKEHEKLVRDSLDTARKLLEELEDLIRRDKEDVERVLEELKRLIEEIDDRVRRN

SEQ ID NO: 3351 - protein, 59 aa, Artificial Sequence
  Synthetic sequence.
DELIERLRRSDKRASEEHKRLMDEAKRLVEKAEKDVTELNKDIKRLVKEVEDRLREAER

SEQ ID NO: 3352 - protein, 60 aa, Artificial Sequence
  Synthetic sequence.
DEVKKVLDESRELVDRIRRKAKEVDDRDRKLIRDVLEELKKLLEENRKLVEDIRRLLEAG

SEQ ID NO: 3353 - protein, 56 aa, Artificial Sequence
  Synthetic sequence.
KETLRRLHEETERILRDLKRHNDELNDEARKRLKEVKERLDESHDRVRRELEAKER

SEQ ID NO: 3354 - protein, 57 aa, Artificial Sequence
  Synthetic sequence.
KDVEEILRKLKELIDEARRRLEKTLRDHEDIVRRAKRRLEELLKRHRDIMDEVRRKV

SEQ ID NO: 3355 - protein, 59 aa, Artificial Sequence
  Synthetic sequence.
EEARRRLEEEVRKVRKEIEDVNRRLEKSHKEAEETLRRVEEELKKSHDELERILREIER

SEQ ID NO: 3356 - protein, 57 aa, Artificial Sequence
  Synthetic sequence.
DDVEEILRTLRELIKKIKKDLKKVLDDHERIARRAKEELERILRRHREIVERVDRKV

SEQ ID NO: 3357 - protein, 59 aa, Artificial Sequence
  Synthetic sequence.
DEARKKIEDIVREVEDDLRRVAKAAEDSNRKLEKDLREVAERLRKSHEEAEKALRDREK

SEQ ID NO: 3358 - protein, 57 aa, Artificial Sequence
  Synthetic sequence.
DDVRRLEEELRRLMEEAERRLRKTLEDHKRIVEEAKRRLEEILREHKRILEEIDKRV

SEQ ID NO: 3359 - protein, 59 aa, Artificial Sequence
  Synthetic sequence.
EELKKRVEDLVREIRRRLDKVNEDLERSNRELEKVLRDVLRELKKSHDDLERSLRETRR

SEQ ID NO: 3360 - protein, 57 aa, Artificial Sequence
  Synthetic sequence.
DEAEKILDELRRLIDEIRRRLRKTLEEHKRILERIRRELEKMLEEHRRIVDEMRRKL

SEQ ID NO: 3361 - protein, 59 aa, Artificial Sequence
  Synthetic sequence.
EEVTRRLEKLVRDVDRDIKRVNKELEKSNRELEKDLRAVEKRLEDSNRDARKKLEDTRR

SEQ ID NO: 3362 - protein, 57 aa, Artificial Sequence
  Synthetic sequence.
DDAERILEELKRLMEEVEKRLKDTLDTHREIARRILERARESLKRHEDIAREIERDV

SEQ ID NO: 3363 - protein, 59 aa, Artificial Sequence
  Synthetic sequence.
EDVKRKIRELVERAKKRLKEINDELKKSDEDLDRKLEDLNRRLEESNEELKRRLDETRR

SEQ ID NO: 3364 - protein, 57 aa, Artificial Sequence
  Synthetic sequence.
SDAEKLLEDIRKLTEDVERDLRRSLEELKDLIRRLKKEIEDLLERHKRIVDKVVREV

SEQ ID NO: 3365 - protein, 59 aa, Artificial Sequence
  Synthetic sequence.
EEVKERVERLVREVEKRLDEVDKELEEEVDKARKELEKLLEDIDRSDKEARKRLEDKRR

SEQ ID NO: 3366 - protein, 60 aa, Artificial Sequence
  Synthetic sequence.
SKEDEIRRLIEDLERRNKEVEETLRELVRETRERIERIKRRLEELIKKSKDEVDDARRKG

SEQ ID NO: 3367 - protein, 55 aa, Artificial Sequence
  Synthetic sequence.
EELLERLERLIDKSRKNVEDIVKRHEDLSRELTERAKAILERHKELTDELREDVR

SEQ ID NO: 3368 - protein, 59 aa, Artificial Sequence
  Synthetic sequence.
SEEERIERLIDELRRDNDEVRKRLDKLVKDTERENEEAERRLRRLIEESRREVEKLKAE

SEQ ID NO: 3369 - protein, 55 aa, Artificial Sequence
  Synthetic sequence.
EELARELEKLIEDSRRNVKRIKEEHEELSRRNRKLLEDILERHRRLTEELRKKVK

SEQ ID NO: 3370 - protein, 60 aa, Artificial Sequence
  Synthetic sequence.
SKEREIEELIKELEEEVERLKEELRRIIKKLRDDNKRAEEELERLIRESKEDLDRARKEG

SEQ ID NO: 3371 - protein, 55 aa, Artificial Sequence
  Synthetic sequence.
EELRKELEDVRRKLKEEIDRILEEAKRVVDDSRRNAEEITRRHKEATKRLREEVE

SEQ ID NO: 3372 - protein, 60 aa, Artificial Sequence
  Synthetic sequence.
SIAERLKELIDRMREDNERAAKELRELIRKAKEESKEVEERLRRRLKELRDRVEELVRRN

SEQ ID NO: 3373 - protein, 59 aa, Artificial Sequence
  Synthetic sequence.
KEMLDRILEELKKLIKESRENLRRILEDLKRLLDESRRHAERITRRLEELIKELKEKAD

SEQ ID NO: 3374 - protein, 60 aa, Artificial Sequence
  Synthetic sequence.
KARERLKRLIEEAKRRNEEMEKELDRRLDELRRESKTLEEDLRRSLEELEERIRRLVKRN

SEQ ID NO: 3375 - protein, 59 aa, Artificial Sequence
  Synthetic sequence.
REMVEEILRELRKLVEDSLEVLERILDDLRRLIEESRKHLEEVKRRLEELKKRLEDEAR

SEQ ID NO: 3376 - protein, 60 aa, Artificial Sequence
  Synthetic sequence.
KEVEKILEEIERLIREIDREVKRVKTENEKTVRDIRKRVEEIKEEHKDLTRKLEKLARDG

SEQ ID NO: 3377 - protein, 59 aa, Artificial Sequence
  Synthetic sequence.
DEARKRAEDLLRDAKRRVDEVVEELKKTVEELKEEVRKVEEELKELVKRSEDKVRETER

SEQ ID NO: 3378 - protein, 61 aa, Artificial Sequence
  Synthetic sequence.
SEVDKVLKEHEDLVREDKKRLEEILRELKDRLRRDEEELRRIMEELEELLRRLKDVVDKRR

SEQ ID NO: 3379 - protein, 59 aa, Artificial Sequence
  Synthetic sequence.
KEMIDRLRRSDEELKKEADRANEEAKRIVEKIRDTLKKANDKLDEIVERIEDELRRAET

SEQ ID NO: 3380 - protein, 60 aa, Artificial Sequence
  Synthetic sequence.
KEAEDVEEEHKRLVEDDRRKLEEIKKTLERLVEEDRRRLEEVVRELKRLLDEITDVLTKR

SEQ ID NO: 3381 - protein, 59 aa, Artificial Sequence
  Synthetic sequence.
DEVRKRLRKSDKELRDEAREVNKELEAIVKRARDEVKKVNDDLRKIVDEVRETVKEARR

SEQ ID NO: 3382 - protein, 60 aa, Artificial Sequence
  Synthetic sequence.
DEVREVKKRLRDLIRDDERELRRVLEELKELVKDDVDKLRRLIEKLRKLLEELRRVATKR

SEQ ID NO: 3383 - protein, 59 aa, Artificial Sequence
  Synthetic sequence.
EKAREELKRIVEEVEEKSRRANKKLKDIVDEMRERVKRANEELDDIVKKITEDLERMRK

SEQ ID NO: 3384 - protein, 60 aa, Artificial Sequence
  Synthetic sequence.
REVDEVRKEHERLVKEDEDKLRKIIEDLKKLLREDEKRLREALKRHRELVEEARDVVRKR

SEQ ID NO: 3385 - protein, 59 aa, Artificial Sequence
  Synthetic sequence.
DKVKKELEESDRRVEEKSRRANETLKRIVEEIRKKAEEINRRLKESDDRAAEDIKRVEK

SEQ ID NO: 3386 - protein, 60 aa, Artificial Sequence
  Synthetic sequence.
DEARRVKEELDKLRREDEELLRRLMEKLKDLIRRDTEELKRIIDELRELVERLEDELRRR

SEQ ID NO: 3387 - protein, 59 aa, Artificial Sequence
  Synthetic sequence.
EKVREELRRIVDRVKKEVDRANRELEDIRREVEEISKRANEELERIVTEAADRLRKVAE

SEQ ID NO: 3388 - protein, 60 aa, Artificial Sequence
  Synthetic sequence.
SEAEKVIREHERLLEEDRRRLEEALRTLERLAERDEERLKEAEERHRDLLRKLEETVKKR

SEQ ID NO: 3389 - protein, 59 aa, Artificial Sequence
  Synthetic sequence.
DEVKRRLRKSDEDVKRRAEEINKEAKEIVDDVKKKSDEANKRLKDSDKRVAERLKEAED

SEQ ID NO: 3390 - protein, 61 aa, Artificial Sequence
  Synthetic sequence.
SEVEKVIEDHDRLLKRDEELLRKIAEDLKDLVRRDEERLRRATEKLKRLLETLEDVLRKRR

SEQ ID NO: 3391 - protein, 59 aa, Artificial Sequence
  Synthetic sequence.
KEVKDKLRRSDERVEKRSRDANRELEEIVRRARKKSEEANRRLEEIVERAEKRLKEAED

SEQ ID NO: 3392 - protein, 59 aa, Artificial Sequence
  Synthetic sequence.
SEVDKVVEESKTSMRRLERRHREATKESKKSIEEIEETVERVKRESEKSVKKLDDLVKN

SEQ ID NO: 3393 - protein, 59 aa, Artificial Sequence
  Synthetic sequence.
EEVRRRLRKIHKELEERLRRMNKRLRELHRELEEKVKEVKKELEDIHRKARERVEKAKE

SEQ ID NO: 3394 - protein, 59 aa, Artificial Sequence
  Synthetic sequence.
EELKEVRERSKESIKRIKEEHERVEEELKDIKRDIDRRHKEVVDESRESVKRVEDLSRA

SEQ ID NO: 3395 - protein, 59 aa, Artificial Sequence
  Synthetic sequence.
EEVRRELREIHDELRKRVEEANKRLEDILREIDKRLKELNEELKRIHDRARERLEEERR

SEQ ID NO: 3396 - protein, 59 aa, Artificial Sequence
  Synthetic sequence.
DEIREVIKESKKSVEDVKRRHEEAKRESERSLKEIRELAEEVKERLRDLLRRIRKLVKD

SEQ ID NO: 3397 - protein, 59 aa, Artificial Sequence
  Synthetic sequence.
EEVRRRLRKIHKEAEERLRRANDELRKLHEEIKKTVEKIKRELDKIVEEIERDVRRDRK

SEQ ID NO: 3398 - protein, 59 aa, Artificial Sequence
  Synthetic sequence.
SRVEEILRDSKRSMDEARKEHERVLRELRDRLRRLDERHRRLLEELKRLLREVRELTRA

SEQ ID NO: 3399 - protein, 59 aa, Artificial Sequence
  Synthetic sequence.
EEVLRRLDDIHRRIKRELKEVNDRLEEIVREIRKRLKEVNERLKEIVDAVEEVVRRAEK

SEQ ID NO: 3400 - protein, 59 aa, Artificial Sequence
  Synthetic sequence.
KRLEDVARESKKSIDEIRKRHKEATDESNKSIEEARRIHEEVLRTLKELLDRVRKLIES

SEQ ID NO: 3401 - protein, 59 aa, Artificial Sequence
  Synthetic sequence.
EEVRRDLRRIHERLREEAEEVNERLERNHEELEREARKVNEELRKIVEDARREVERAKD

SEQ ID NO: 3402 - protein, 59 aa, Artificial Sequence
  Synthetic sequence.
DDVEEIKRRLEELLERLKEDHKRMLEESRKSVEDAEKIVEEVKKESEDSIREIKKLLKD

SEQ ID NO: 3403 - protein, 59 aa, Artificial Sequence
  Synthetic sequence.
EKVKRELDEIVKRIEDEARKVNEELKRIHDDAERKVRKVKEDLERIHRELKKRVEDDRT

SEQ ID NO: 3404 - protein, 59 aa, Artificial Sequence
  Synthetic sequence.
KEDERVEEELRKLLKELEDRHKKASEDSRDSIRRIRERARTVLEELKRVLEDIDRLIKA

SEQ ID NO: 3405 - protein, 59 aa, Artificial Sequence
  Synthetic sequence.
EEVKRRLDKIVDDVRERLKEMNDRLRRLHEELKRELERIKEELDKILEEVKRRLEEARR

SEQ ID NO: 3406 - protein, 57 aa, Artificial Sequence
  Synthetic sequence.
ELEERLTRSNDELRKELKRMNEELRRKLEEIRKELERLNEKLREIIERIKEDLDRRA

SEQ ID NO: 3407 - protein, 59 aa, Artificial Sequence
  Synthetic sequence.
RELAEEFLRRHKELVERIREIHERLRERLEELLRRIEELHKRLEDELREVLKRIEDEIR

SEQ ID NO: 3408 - protein, 57 aa, Artificial Sequence
  Synthetic sequence.
KKEEDLDESNKRARDELKEMNDRLRKIVKEIEDELRRLNEEARRSNEELRRRVEERL

SEQ ID NO: 3409 - protein, 59 aa, Artificial Sequence
  Synthetic sequence.
DELAKKVIKEHEDLVREVLKRHEDLLRRARELLKKIKEIHDRLLDEHRKLVEDIEREAT

SEQ ID NO: 3410 - protein, 57 aa, Artificial Sequence
  Synthetic sequence.
DRERELEKSNRELERELREALKRVKEIIDRIRKTLEDMNRRLKRSNEEAERRLREKA

SEQ ID NO: 3411 - protein, 59 aa, Artificial Sequence
  Synthetic sequence.
DELAERVIREHRRLAEEIRRLIEKLKREIEELLERARRTHEDLLRKHKELVKKVDEEIR

SEQ ID NO: 3412 - protein, 57 aa, Artificial Sequence
  Synthetic sequence.
DDEEEVKRSNDELRKEIKEAEERLEKSNRELEEDLRRMNRELEESNKRLRELLEREA

SEQ ID NO: 3413 - protein, 59 aa, Artificial Sequence
  Synthetic sequence.
KELAEDMLRRHRDLVREIRELIDKLTRDHDRLVKEAREIHKRLTERHRKLVEDIKRETD

SEQ ID NO: 3414 - protein, 57 aa, Artificial Sequence
  Synthetic sequence.
SKEEELEKSNRKLKEDLERMNEDLKRILREVEDVLRRIEEELEKLVRELEEILKRRV

SEQ ID NO: 3415 - protein, 59 aa, Artificial Sequence
  Synthetic sequence.
DELAEEVIDRHRDLVRRIKDEHRKLTDELRKLLEDIERLAEEAKRKLEKLIEDVEREAN

SEQ ID NO: 3416 - protein, 57 aa, Artificial Sequence
  Synthetic sequence.
SSEERVKKVVEELEDLIRKIREEHKDSIRENRKVVEDIRERVKELITELKKELEDKL

SEQ ID NO: 3417 - protein, 56 aa, Artificial Sequence
  Synthetic sequence.
TEDLLRRLRKLIEDVFREARENLKRHKKMSKEAKEKLEELLKRLRDLIKEAREKIK

SEQ ID NO: 3418 - protein, 59 aa, Artificial Sequence
  Synthetic sequence.
SEADEVLRTHEELVRELEERAKEILRRHRKLSEESERKAREVLKTLRDLIRELKKLADE

SEQ ID NO: 3419 - protein, 59 aa, Artificial Sequence
  Synthetic sequence.
EEIARRIEESEDKSRRIIDEVRERVRKSIEENKRVVEEVRERVERLIKELDKIVEDIRR

SEQ ID NO: 3420 - protein, 60 aa, Artificial Sequence
  Synthetic sequence.
DELEKVIEELKRRIEEVKKELTELNKELKDVSKEIEDVIRDLNRELKKLSDRIKELADRD

SEQ ID NO: 3421 - protein, 59 aa, Artificial Sequence
  Synthetic sequence.
EEIRRRLDEVLRKAEEDLRRAEESNDEHLRKSKEDVERARKSNDKHLDDNRKTLEEATR

SEQ ID NO: 3422 - protein, 60 aa, Artificial Sequence
  Synthetic sequence.
SDVEDLLRRLRKLTKDIEERVKELNKKLEDVSRDIKRRVEEVLKKLEDVLRKARDEVRKL

SEQ ID NO: 3423 - protein, 59 aa, Artificial Sequence
  Synthetic sequence.
DRAEKELRKILEDHKEISDRVRRSNEKLLRDHRRTSETVKRRLEKVLEDIRKELEDAKR

SEQ ID NO: 3424 - protein, 61 aa, Artificial Sequence
  Synthetic sequence.
DVEERVKTIVDDIERTLDEVRRRLEESHKRLEDALKEVDDRLKKLLKETEEVLKRIEDERG

SEQ ID NO: 3425 - protein, 59 aa, Artificial Sequence
  Synthetic sequence.
KEKVEELLRRLREILERVTRRLEEVLKRHRDLVEEVKKELERVLEDHKRLSEDAERRAR

SEQ ID NO: 3426 - protein, 60 aa, Artificial Sequence
  Synthetic sequence.
SVEEALEKSVKESEEVLKKAEKELRESHEDAKRVLKEVRDELERLMEETKKELRDVERKR

SEQ ID NO: 3427 - protein, 59 aa, Artificial Sequence
  Synthetic sequence.
KEKVDRILKKDKDLIDRVRRELKKMLDRHRKLVEDVKRELEEALKEHKDDSKRVRDKLK

SEQ ID NO: 3428 - protein, 60 aa, Artificial Sequence
  Synthetic sequence.
DIEDRLERVVRDAKRVLADVEDKLRKLLEETERMLRRVKRELERSHEEAEEELRRVEEER

SEQ ID NO: 3429 - protein, 59 aa, Artificial Sequence
  Synthetic sequence.
KKLLEDILRKLRKIIEEVKRTLEEALKRHRDLTRKVVEELEDLLRKHRRIVEEVKKRLK

SEQ ID NO: 3430 - protein, 60 aa, Artificial Sequence
  Synthetic sequence.
DIEDELRKSVKRSEEVLREVEERLKRLLEETKEVLTRARETNEKSHRELEDKLRKIEEER

SEQ ID NO: 3431 - protein, 59 aa, Artificial Sequence
  Synthetic sequence.
ESKLRELLKRDKKEIDDVKRELERLLEDHKRLTEEIRRRLKRLNEKHREIVKRVEKELK

SEQ ID NO: 3432 - protein, 60 aa, Artificial Sequence
  Synthetic sequence.
DVEDRLRESEKRSEKTLKDVEERLRRSHEDLEKKLREVEKRLRDSHREAEKTLKRVKEEK

SEQ ID NO: 3433 - protein, 59 aa, Artificial Sequence
  Synthetic sequence.
KEVVRKILEDDKRLIEEVKKELERVLEEHRRLVEKVKRELEEVLKRHKEIVDDVRRRLE

SEQ ID NO: 3434 - protein, 60 aa, Artificial Sequence
  Synthetic sequence.
SIEDELRKIADEARKVLDKVRKDVERSHREAEKKLREIDKRLKDSARDSKRVLDEVREER

SEQ ID NO: 3435 - protein, 59 aa, Artificial Sequence
  Synthetic sequence.
EEKLERILRKLKKIIKDVEDELRKLLEEHRELVKKVEKDLRDLLERDRELIEEVERRLR

SEQ ID NO: 3436 - protein, 60 aa, Artificial Sequence
  Synthetic sequence.
DIEDRLRTSVKKSRDVLEEVERKLRDSHRRAKEVLDKAREDLRKSKEDSKRVLDDVRRKR

SEQ ID NO: 3437 - protein, 59 aa, Artificial Sequence
  Synthetic sequence.
KEKLEDVLRRDEELIDRVRRRLERILEEHEELVKRVEEELRRVLEEDRKLIKRVKEELE

SEQ ID NO: 3438 - protein, 60 aa, Artificial Sequence
  Synthetic sequence.
DIEDALRDSERESEEVLKRAREELEKSHKEVKKRLDEVEKTNKDSVDESKKVLDDVRRKR

SEQ ID NO: 3439 - protein, 59 aa, Artificial Sequence
  Synthetic sequence.
KELLKKILKEDKELIKRVEEILRRILEEHRELVRRMKKELDELNKRDKELIDRVREELT

SEQ ID NO: 3440 - protein, 60 aa, Artificial Sequence
  Synthetic sequence.
DLEEEAKKSVRESERALDEVRKRLDRVRKEVERELRKVEEDLRRSHRKLEDILRRVAEKR

SEQ ID NO: 3441 - protein, 59 aa, Artificial Sequence
  Synthetic sequence.
EEAARRILERDKALIEKAREDLKRILDEAREILKEAAKRLEDILRKHKKIVEDVARELE

SEQ ID NO: 3442 - protein, 60 aa, Artificial Sequence
  Synthetic sequence.
KIEEEVEKLIRDARRIIEEMRESTERLIERNEEVLETVRREVEKLLRDLERILEKIKREL

SEQ ID NO: 3443 - protein, 59 aa, Artificial Sequence
  Synthetic sequence.
EEVLRRILEEIRKIVEDVRRELDTLNRELEELTKESRRRAEELLRRLKEIVKKVERDAE

SEQ ID NO: 3444 - protein, 59 aa, Artificial Sequence
  Synthetic sequence.
REVEEILKEVETLIRENKKKLEEWLRTHEKLNEDLERKAREILTRHRRENEDLKRVADD

SEQ ID NO: 3445 - protein, 59 aa, Artificial Sequence
  Synthetic sequence.
DEVKRRIEELIKKSKRVNDEANRRVDKLVKDTRDKIREIEERIRKLIEESKKLLEDKRR

SEQ ID NO: 3446 - protein, 59 aa, Artificial Sequence
  Synthetic sequence.
REVEEILRRVRELIERNRKEVEDWMRRHRRVNEELKRKAREILERIKEMLKTLKEVLER

SEQ ID NO: 3447 - protein, 59 aa, Artificial Sequence
  Synthetic sequence.
DEAAKRIEKLIKESRERNEEVNRKIKKLIEDTRRVVEDVRRKVEELVKRLRTELDRARK

SEQ ID NO: 3448 - protein, 59 aa, Artificial Sequence
  Synthetic sequence.
SEAEEIAKRAKEAIERNRKLAEEWAKRARDAAERLKELYKRIAERHRKANEELRRAAER

SEQ ID NO: 3449 - protein, 59 aa, Artificial Sequence
  Synthetic sequence.
DEARKRIRELIERSKKANKEANDRARKLAEDAKRLNEEANERAKRLAEESREAIKEAER

SEQ ID NO: 3450 - protein, 61 aa, Artificial Sequence
  Synthetic sequence.
REVEEVAKELRELIKRTEDLIRRALERNRKLVKETRDLIEKVLRDLRDLLRRLEEEARRRG

SEQ ID NO: 3451 - protein, 56 aa, Artificial Sequence
  Synthetic sequence.
DKTLRDLLREHKELVEEAKRRLEESNDEHRREVEDAERRIEEIVRDAKRVVDEIER

SEQ ID NO: 3452 - protein, 61 aa, Artificial Sequence
  Synthetic sequence.
SEVEKVVTELRRLIERLEEVIRRALDTNRKLLEDTEKEAERMMRKLEELIKDLERDLREKG

SEQ ID NO: 3453 - protein, 56 aa, Artificial Sequence
  Synthetic sequence.
KETLRKLLKELREVLDKAREDLERSNRDHRRAVEEIKERLERLLKKLEDVVRKAKE

SEQ ID NO: 3454 - protein, 61 aa, Artificial Sequence
  Synthetic sequence.
KEAEEAAKKLKDLIKEDRERARRALEENKRLIDELRKAAKEALDRNRELLERLRDEARKRG

SEQ ID NO: 3455 - protein, 56 aa, Artificial Sequence
  Synthetic sequence.
KDTAEDLLRRATRDSEEAKKKLKKSNEEAAKAVEEAKERLKRSVDEATKAVEEAKR

SEQ ID NO: 3456 - protein, 59 aa, Artificial Sequence
  Synthetic sequence.
SEVEKALEESKESLKTIKKIAKDVLTESEESLRRTKKLIEEVLEASKRSIEELKRLSEA

SEQ ID NO: 3457 - protein, 56 aa, Artificial Sequence
  Synthetic sequence.
EDELRRLHEDVKRLVEEIAKRLDELHDRHRETVKRAKEELDKLHDRARKEVEDDKR

SEQ ID NO: 3458 - protein, 59 aa, Artificial Sequence
  Synthetic sequence.
SEVEKVLKDSEKSIEDAERIARDVLRKSEESIDRIRRIAEEVLKESEKSIRDAKKLAED

SEQ ID NO: 3459 - protein, 56 aa, Artificial Sequence
  Synthetic sequence.
ERELDRLHEKLRRVVEEIEKELRESNRKLEEVLRDIKRKLDDLHRKAREILERIRK

SEQ ID NO: 3460 - protein, 60 aa, Artificial Sequence
  Synthetic sequence.
SEVEEVLKRIRDVIKTMEDRAREVLKESEKSIKEIRDTIREVLKRSEDSIRRIDEELKKG

SEQ ID NO: 3461 - protein, 56 aa, Artificial Sequence
  Synthetic sequence.
KDRLDELLKRAEEVLRKIKEDLRRSNEKLREEVKEAKKRLDDLHRELEDVLREAKR

SEQ ID NO: 3462 - protein, 60 aa, Artificial Sequence
  Synthetic sequence.
KETEEAEKLAREAARRSEKLAEEAEKRAKEAIDESKELADRARDTARRADEDLERLAREG

SEQ ID NO: 3463 - protein, 56 aa, Artificial Sequence
  Synthetic sequence.
REKLDDLLRRHNEKVKRAKERLDRLLEEHEKRIRDAERDLERLERELKKKAEDKRR

SEQ ID NO: 3464 - protein, 60 aa, Artificial Sequence
  Synthetic sequence.
SETEEALERLRKMIEDSRRLAKKIREDLREMIERSRRLAEKVRRDDEKSSEDLRRVTEEG

SEQ ID NO: 3465 - protein, 56 aa, Artificial Sequence
  Synthetic sequence.
KDRLDRLLEEHNRIVKEIKEDLDRLLREHNEIVKRIKDDLDRLHEENRRLLEESER

SEQ ID NO: 3466 - protein, 59 aa, Artificial Sequence
  Synthetic sequence.
SKEDLVRELKKKLEEVVKRSREESERSLRKLEKVIRDFRRESERLKKESRDVVKKARED

SEQ ID NO: 3467 - protein, 55 aa, Artificial Sequence
  Synthetic sequence.
EEVLKEIDDLIRRDEERLRRVLRESEELIKEIKKRAEEMLTRSKKLTRDIEEKTR

SEQ ID NO: 3468 - protein, 59 aa, Artificial Sequence
  Synthetic sequence.
RDREELRRLEEELRRVFEESRRRSERSKKELDKIVKEAEKASKRSLDKLKRVFDELRRR

SEQ ID NO: 3469 - protein, 55 aa, Artificial Sequence
  Synthetic sequence.
EDVLRDARELIERDREELERVLRDSDRLVREIKKRIEEMLKRSEDLIEEIERRAR

SEQ ID NO: 3470 - protein, 61 aa, Artificial Sequence
  Synthetic sequence.
SEVERVLKEIEDLIEEIERRAKTVLEEIDKLTKEIEEVVKRMLDRDRELIKTAEDLLRKNK

SEQ ID NO: 3471 - protein, 58 aa, Artificial Sequence
  Synthetic sequence.
RVRKALEDLLRKVEEVVRRVREELKKLERKDREVVRKVEEDSERSLRELEKVADEARK

SEQ ID NO: 3472 - protein, 60 aa, Artificial Sequence
  Synthetic sequence.
SEVEKVLRELKELTRRIREEAERLLREDERLLREAERIARELLETNKRLIEEIERRLRER

SEQ ID NO: 3473 - protein, 58 aa, Artificial Sequence
  Synthetic sequence.
RVKKDLEEVRKRDREVVEEVRRRSEKSKEDVRRLVEKIRKDSEDSLKELKEVVEEARR

SEQ ID NO: 3474 - protein, 60 aa, Artificial Sequence
  Synthetic sequence.
DEVEKMLEELKRLTDKIREDAERLLKRSEELTEEIKRLIDELLKEIEELIKEARDIVRRN

SEQ ID NO: 3475 - protein, 59 aa, Artificial Sequence
  Synthetic sequence.
ERVRRELEKVEREDRKVVRDAEEELKKSRKKSEDVVKEAKERLEELLRRVKRVVDEVRR

SEQ ID NO: 3476 - protein, 60 aa, Artificial Sequence
  Synthetic sequence.
SEVERVLKEIEELTRRLREEAEELLERSERLTEKIRRRAEELLKRNEDLIEKIERDLRRN

SEQ ID NO: 3477 - protein, 59 aa, Artificial Sequence
  Synthetic sequence.
DRVKKALDELRRRDREVVKRLEEELEKSKKKSEDVVREVEEKSERSKRKLERVADEARR

SEQ ID NO: 3478 - protein, 57 aa, Artificial Sequence
  Synthetic sequence.
SEAEKLLKEDEDLIRKARDEIRKVLEDDERLIEEVERKSREMLKRIKEIIDDMRKRI

SEQ ID NO: 3479 - protein, 59 aa, Artificial Sequence
  Synthetic sequence.
KEVVEEVRKSRKKSEDVLREVERELKKSFEKSKRVNDDSKKKLDELKREADEVIKRLKD

SEQ ID NO: 3480 - protein, 57 aa, Artificial Sequence
  Synthetic sequence.
SRAEELLKRDEELIDTVRRRIEKMLREIKEIIDRVKRKSEKMLEDDERLIREVEKRV

SEQ ID NO: 3481 - protein, 59 aa, Artificial Sequence
  Synthetic sequence.
EEVLRELEKSRKKSEEVLERVKRELEKLERRAEEVNKESEDRLRESEKESKKVIDELRR

SEQ ID NO: 3482 - protein, 57 aa, Artificial Sequence
  Synthetic sequence.
RRAEELLRTIKEIIKRIDDELKRVLDDDDRLIDELRKESERLLEEIERIIRRIEREV

SEQ ID NO: 3483 - protein, 59 aa, Artificial Sequence
  Synthetic sequence.
EEVLRELRKLEEEAKAVIDKARRELERSERKSEELNRESKRRLEELSRRAKRVIDELRK

SEQ ID NO: 3484 - protein, 57 aa, Artificial Sequence
  Synthetic sequence.
DEVRRLLKEIEDIIRRIEEDIRRMLEKDRKLIEEVERKSKEMLDRDKRLIEELEKRL

SEQ ID NO: 3485 - protein, 59 aa, Artificial Sequence
  Synthetic sequence.
EEAVRELDRLRREAEEVLDRVRKKLDKSRKDSERVNEESERRLERSAEESKRVLDELRR

SEQ ID NO: 3486 - protein, 60 aa, Artificial Sequence
  Synthetic sequence.
DVREELKKVVDKAEKVSRKSRDDLDKVRKRVEEVNRDNERRLREIAKKVKEVLRDIDRKR

SEQ ID NO: 3487 - protein, 59 aa, Artificial Sequence
  Synthetic sequence.
KEVVKRLLEDVDRLIREVEKESKRLLDEIEEMIEELKRRAEENLKTIEDIIKDVTEKAT

SEQ ID NO: 3488 - protein, 59 aa, Artificial Sequence
  Synthetic sequence.
REVEEVLKTVRKLIEELERSSRKSLKEVKELLEKLEEDARRSLKRVKELLKELEDRSRT

SEQ ID NO: 3489 - protein, 59 aa, Artificial Sequence
  Synthetic sequence.
EEAKKRIEDLIRELEELLRESSDRHRKLDEELKKLLKDVTDAHRRLMEELRKLLEDIET

SEQ ID NO: 3490 - protein, 59 aa, Artificial Sequence
  Synthetic sequence.
DEVETILRDIKRLLREIEELARKSSKKFKELLERLEETARRSLTRIERLLEEVEDISRT

SEQ ID NO: 3491 - protein, 59 aa, Artificial Sequence
  Synthetic sequence.
EDAAREIEKLKRELERLLEEASRTHEELTRRLEKLLEDATREHERLKRELEKLLEDIKK

SEQ ID NO: 3492 - protein, 59 aa, Artificial Sequence
  Synthetic sequence.
REVEEILRKIRELLEELRKRVEESRRRIEELLKKLEEEVRESEKDVRRLLRELEEISRT

SEQ ID NO: 3493 - protein, 59 aa, Artificial Sequence
  Synthetic sequence.
EEAAKEIEKLVKELEELLKRASDKHRKLSKDLEDLLREVTERHRRLEKELEDLLREIER

SEQ ID NO: 3494 - protein, 59 aa, Artificial Sequence
  Synthetic sequence.
SEVEKLLEEARRLLKELEDSSRRSVEEAKRLLEELKRRVEESVRRIRELLKDLERLSSR

SEQ ID NO: 3495 - protein, 59 aa, Artificial Sequence
  Synthetic sequence.
ERAKEALRELEKRLRDLLRDSSRLHEDLARDLKRLLDEVTEEHDKLRRELRKLLEDIKT

SEQ ID NO: 3496 - protein, 59 aa, Artificial Sequence
  Synthetic sequence.
SEVEKVEEDVKRLLKEIEDSSRRSLEKAKRLLEELRRSSEESLKRIRDLLEELRELSRT

SEQ ID NO: 3497 - protein, 59 aa, Artificial Sequence
  Synthetic sequence.
EEAKKRIEELKRELEELLKKSSEEHKKLVKELKELLKKSTEDHEKLKRDLRKLLEEIRT

SEQ ID NO: 3498 - protein, 60 aa, Artificial Sequence
  Synthetic sequence.
DSEDLMRRVKEELDKLVKDSRKRSEDLKRENEELLRRSEEALEKSVRDADRLFEEIKRTK

SEQ ID NO: 3499 - protein, 55 aa, Artificial Sequence
  Synthetic sequence.
RDVLKTLKDLIRELKRHSEEVEREDKETTDRLRRHSEKALRTNEEIIRRIEERAR

SEQ ID NO: 3500 - protein, 60 aa, Artificial Sequence
  Synthetic sequence.
SVDEALRDIERKVEELMRESDERLRRVKKEVEDNVRRSEEELKRIADEMKELLDRARERG

SEQ ID NO: 3501 - protein, 59 aa, Artificial Sequence
  Synthetic sequence.
EDLVREVLKKLKELIDRWRDLSRRLKERLDTLIKEHHELSKRLLERLKRLIDEARKKLN

SEQ ID NO: 3502 - protein, 59 aa, Artificial Sequence
  Synthetic sequence.
SEVEELKREADDVNRRAEELARETLKKIEKVNREVKRRLEEALREIEELLRRAEEIVRR

SEQ ID NO: 3503 - protein, 59 aa, Artificial Sequence
  Synthetic sequence.
EEARKRLEEVVRHNKKLDDEHRKALDELRKHNEDLDRRSKEELDKLRKRLEDLLRKVKE

SEQ ID NO: 3504 - protein, 59 aa, Artificial Sequence
  Synthetic sequence.
REVEELLKEIEEVLKKSERLSRESLKKIREVLERIERLARENVKRMKEVIDRVRELAER

SEQ ID NO: 3505 - protein, 59 aa, Artificial Sequence
  Synthetic sequence.
EDARRALEELRKRVEEVNKKSRDDLERLTREAEELNRKNEEDLRRLEKEVKDLLDEIRR

SEQ ID NO: 3506 - protein, 60 aa, Artificial Sequence
  Synthetic sequence.
SSRETVKRLTEEARKLLEDWKDRNRDVERKVEEIIERIRRTNEKSERDARRKLEEVDKRR

SEQ ID NO: 3507 - protein, 56 aa, Artificial Sequence
  Synthetic sequence.
TEELKREIERILEELRRLMKEDKEELERILERLRRLAEEDKKENEEILDRVDKKAK

SEQ ID NO: 3508 - protein, 60 aa, Artificial Sequence
  Synthetic sequence.
STEETITDLKREAEEILRRWREENKRVSDEAAESVKESDKTNKKSKDDLKRVLDEVDTKE

SEQ ID NO: 3509 - protein, 56 aa, Artificial Sequence
  Synthetic sequence.
AKELEDEVREALKRIRKLIEEDRRKLKRILDEHRRLTEEDRERNERVLRELREDTR

SEQ ID NO: 3510 - protein, 60 aa, Artificial Sequence
  Synthetic sequence.
SVDESLEEIRKEVERLLRKWKEDNKEMRKRIRELLEDWRKKVEDSKKRAKDLIDEVKKRR

SEQ ID NO: 3511 - protein, 56 aa, Artificial Sequence
  Synthetic sequence.
TRELEKEAEDALRRLKKLIEEDRRELEKILKELEDLMREDTKENEKILREAEERSR

SEQ ID NO: 3512 - protein, 60 aa, Artificial Sequence
  Synthetic sequence.
SVEDEIRRLTEEIERTLRRWREEVKRSEDRAEESIKRSDEKNKESKERLDKVLDEARRRR

SEQ ID NO: 3513 - protein, 56 aa, Artificial Sequence
  Synthetic sequence.
LRELLKEVEDVLEELKELIKRDTEENKRILDEHKRLTEEDEKRNREVLERLKRKTD

SEQ ID NO: 3514 - protein, 60 aa, Artificial Sequence
  Synthetic sequence.
ESEETLKEVKKEIEKLIKRAEEINRESAERLKRILEEWKKEVDRSEKRLREVLDEVRRRR

SEQ ID NO: 3515 - protein, 56 aa, Artificial Sequence
  Synthetic sequence.
RRELLEELKRVLDRLKKLIDDDRRKNEKVLRDLEKLMREDADENREVLKRLEDKAR

SEQ ID NO: 3516 - protein, 60 aa, Artificial Sequence
  Synthetic sequence.
SDEERVIKEVEDLIRRIREDNKRLLDEAEKIIRRVAEDNKKLVEDHRRMLRKIDEEAKRG

SEQ ID NO: 3517 - protein, 55 aa, Artificial Sequence
  Synthetic sequence.
EDVKRLEEKVRKLLEESKRKLKRLAEEVRKLIKDSRDKIRELERENKEIIKKVKD

SEQ ID NO: 3518 - protein, 60 aa, Artificial Sequence
  Synthetic sequence.
DREKEVVDTLRRLIEDARRDNKDLVETHRRLLEDLERDNRELVRTHEERLEEIERRARRG

SEQ ID NO: 3519 - protein, 55 aa, Artificial Sequence
  Synthetic sequence.
EDVRRLEKEVEELLRESDRRVEDLERKNREILKRSEDLIRRLKEENRRIIEKVRK

SEQ ID NO: 3520 - protein, 59 aa, Artificial Sequence
  Synthetic sequence.
DDERRVVEELERMIRELEKKIREIVKRHEEALKRLKEDNDELSKRHKKMVEEIKRRADE

SEQ ID NO: 3521 - protein, 55 aa, Artificial Sequence
  Synthetic sequence.
EEVRRLKREVEELLKRAEELLKRLEDRNRKILRESEEDIKRLERENREIITRVRT

SEQ ID NO: 3522 - protein, 61 aa, Artificial Sequence
  Synthetic sequence.
KELDEIIRRVEELIKDDERRNREVLKRSDESTKESHDKARRILEESEKTTEDIKRKVEKDG

SEQ ID NO: 3523 - protein, 56 aa, Artificial Sequence
  Synthetic sequence.
EDKIRRLERESRELLRDSEDKVRKSKRKDEENLKRIEEEARRSEKRDEELLREAAK

SEQ ID NO: 3524 - protein, 61 aa, Artificial Sequence
  Synthetic sequence.
RELDEIIKTLEKLIEDSHREAREIVKEVKKRLDDDKRRNEEVLKESRETTERIRKEIEERG

SEQ ID NO: 3525 - protein, 56 aa, Artificial Sequence
  Synthetic sequence.
EEKIRRLEERARRNVEEMRKLAEELEKESRRILKESAEAVKRSKDEDRKLLEEAKK

SEQ ID NO: 3526 - protein, 59 aa, Artificial Sequence
  Synthetic sequence.
SETDKVIEESEKTNRDIKRHSEEVVKDSKRTNTEIERTVEKMIRELEEILERIKRLADN

SEQ ID NO: 3527 - protein, 56 aa, Artificial Sequence
  Synthetic sequence.
KDKAKKLKDETDRILETSERLLKALRDETDAIKRKVEELVRRVKEELDRILKKTED

SEQ ID NO: 3528 - protein, 59 aa, Artificial Sequence
  Synthetic sequence.
SETDRVVEESERTNKEIERHSEEMVRDSERTNKEIEEHSREVIERLREILERIERLVRK

SEQ ID NO: 3529 - protein, 56 aa, Artificial Sequence
  Synthetic sequence.
EEKMRRLKEETDRILDKSRRELKRLKDETDKLLEDSERLLREVEKTLRRILEEARK

SEQ ID NO: 3530 - protein, 59 aa, Artificial Sequence
  Synthetic sequence.
SETEEVVKTLKRLLEEIKKHSDDAVRKSEETNKRIREEVERVIKRLKELIEEISELVKS

SEQ ID NO: 3531 - protein, 56 aa, Artificial Sequence
  Synthetic sequence.
EEKLKRLKDALDRILEESKRLADELKKRTKDILDEAKDALRKIKEELDKLVEDAER

SEQ ID NO: 3532 - protein, 59 aa, Artificial Sequence
  Synthetic sequence.
SETDKVVREVEELIRRLEEHSRRVVEKSERTNEEIERHSRDVIRRSKEINDRIEELARN

SEQ ID NO: 3533 - protein, 56 aa, Artificial Sequence
  Synthetic sequence.
KDKMKRLKEELDKLLDDSRRLMKRLKDETDKILDKSRDLLAKTKRESDRILEEAER

SEQ ID NO: 3534 - protein, 59 aa, Artificial Sequence
  Synthetic sequence.
SETDKVVDDSRKTNEDIKRHSEEVIRRLEELIREVEEHSRRVEDEVRRILDEIRKLAED

SEQ ID NO: 3535 - protein, 56 aa, Artificial Sequence
  Synthetic sequence.
KDKATELKKDTDRILKESEDALRRIKKELDDLLRTSKRLAEELKKELREILERAKR

SEQ ID NO: 3536 - protein, 59 aa, Artificial Sequence
  Synthetic sequence.
SETDEVVERLEKILKDIREHSERAIKKLEDILREIERHSRKVIRDSERINTEIKKLAEA

SEQ ID NO: 3537 - protein, 56 aa, Artificial Sequence
  Synthetic sequence.
KDKLTTLKKKLDDLLDTSRRLVEKVEEDLRRILEASKRMLEETKKRSKEILDRIRK

SEQ ID NO: 3538 - protein, 59 aa, Artificial Sequence
  Synthetic sequence.
SESEEVVREVDKILKEIRKHSKDVIEKLKKLIDDIRRRVRKVIRDSEEINKRIEDLARE

SEQ ID NO: 3539 - protein, 56 aa, Artificial Sequence
  Synthetic sequence.
EEDMRRLKERLDKILDDSREMLKRLKDELDEVLEEVERLLRETKKRSDEILKRIKD

SEQ ID NO: 3540 - protein, 60 aa, Artificial Sequence
  Synthetic sequence.
SEIEDVIRRAEELIKEDKKRVEDVVREIEKLIRDDARKVRRAIEELKRLLREIEERVREE

SEQ ID NO: 3541 - protein, 56 aa, Artificial Sequence
  Synthetic sequence.
KEEAERLRRELEDLHRDVKRLIDELEKDLRRLLEESKRRADRVKEELRRLREEVRK

SEQ ID NO: 3542 - protein, 60 aa, Artificial Sequence
  Synthetic sequence.
SEADKAAEDAKRLIDKDREDVERAVKRAEDLIEKDREDVDRAIKESEELNKRAEDEARRR

SEQ ID NO: 3543 - protein, 56 aa, Artificial Sequence
  Synthetic sequence.
EEKARRLKEEADKVAKESKELADRLKERADRLHKRARELAERTKEDTDRLVEEAKR

SEQ ID NO: 3544 - protein, 60 aa, Artificial Sequence
  Synthetic sequence.
SEIDEVVKEIEKILEDDKRRVDEAIEELEKLIREIREEVRRVIKESEDLNKEIRDRVRKN

SEQ ID NO: 3545 - protein, 56 aa, Artificial Sequence
  Synthetic sequence.
KDKAERLRRELKKIMEDSRRLADEIKKRLDRLLEEVKEEIERTKRETDRLLEEVRR

SEQ ID NO: 3546 - protein, 60 aa, Artificial Sequence
  Synthetic sequence.
SELDRVVEEIDRLIREDEKEVRDMIRESEKLNRENEETNRKLLEDWDKLSKDIRDRVDKN

SEQ ID NO: 3547 - protein, 56 aa, Artificial Sequence
  Synthetic sequence.
DKKARELKEKLDELKKRSEKLLEDTKRETDKLHERSRRELEKLRRKDEELVKRVKD

SEQ ID NO: 3548 - protein, 60 aa, Artificial Sequence
  Synthetic sequence.
SEIEEVVERIERLIKRIKEEVERALKESEDLIRDIERRVRELLEEWDRLSERIREVVERN

SEQ ID NO: 3549 - protein, 56 aa, Artificial Sequence
  Synthetic sequence.
KDELRRLKEELRKLLEDVKKLLEESKKKTDDLLKRAEDELRKLKEKDDDLLRKVKD

SEQ ID NO: 3550 - protein, 61 aa, Artificial Sequence
  Synthetic sequence.
EELDRVVEELDRLIRDNKRRNDEALKESDRLIRENERRNRKAARDWEELSKEIEDRVRKNK

SEQ ID NO: 3551 - protein, 56 aa, Artificial Sequence
  Synthetic sequence.
KDKLTTLRKKLDDLHKESRRELERSKKKTDDLHRKSREEVRKLREDDERKLREIKK

SEQ ID NO: 3552 - protein, 60 aa, Artificial Sequence
  Synthetic sequence.
SEADEAAKKIEKLIEDNERKNRKALKEWDELTRENEKRNRDAIKESEDLIKEAADEVRRR

SEQ ID NO: 3553 - protein, 56 aa, Artificial Sequence
  Synthetic sequence.
EEKARRLREEAEELHRRSEEAARRAEKKDREAHKRSREAIKRTKDDTEELLKEAER

SEQ ID NO: 3554 - protein, 61 aa, Artificial Sequence
  Synthetic sequence.
DEIDKVVRKIEKLIDDNRRENEEMLRESEKLLKENEKKNEKAIRESEELIRRIEKRVRENK

SEQ ID NO: 3555 - protein, 56 aa, Artificial Sequence
  Synthetic sequence.
KDKARRLEEELKELHKRSKEELEKSKEKTDRLHDKSRRLIEETERRTEELLERVRR

SEQ ID NO: 3556 - protein, 60 aa, Artificial Sequence
  Synthetic sequence.
SVEDEVERLERDAEEISRRSETELRRLKKEVEDLNRESKKLLDELREEMEKILKKVREDS

SEQ ID NO: 3557 - protein, 59 aa, Artificial Sequence
  Synthetic sequence.
KDEVKRLVEEIERLLKRAEELSRELVRRIEKLIRELAEESRRLVDEIREVLKRLKDRAD

SEQ ID NO: 3558 - protein, 60 aa, Artificial Sequence
  Synthetic sequence.
SEIETVLEKLKRLLEEDRELVKRVEDKIRRIIEEDEKTVRDIKKRLDDILREIRDVLEKR

SEQ ID NO: 3559 - protein, 56 aa, Artificial Sequence
  Synthetic sequence.
EEELKKVEDELDRVRKETERIIKELREELEELHKRARDLLKEVRDELRKLLEEAKK

SEQ ID NO: 3560 - protein, 60 aa, Artificial Sequence
  Synthetic sequence.
SEIEDVVRRIDELLREDKRRVDEVLERNRKLIEDDERLSREIARELDEIIKRLREVVKSN

SEQ ID NO: 3561 - protein, 56 aa, Artificial Sequence
  Synthetic sequence.
REEVRKLKERLDKILEDTRRLLEESKRRLDRLHERHRETSEDMKRRIDKLLEEVRK

SEQ ID NO: 3562 - protein, 60 aa, Artificial Sequence
  Synthetic sequence.
KEAEDVVREVEELIDRDRKLVERVLRENERLLKEDRDTVKKVLEELEEILKDIERVVRER

SEQ ID NO: 3563 - protein, 56 aa, Artificial Sequence
  Synthetic sequence.
EELLRRLKEEIERLLERSRRLVKESEERLDRIREETKRELDRVEEKLRRLLEEVKR

SEQ ID NO: 3564 - protein, 60 aa, Artificial Sequence
  Synthetic sequence.
SEIEKVVEEIKKLLKELKETSERILRRNEKIIKEIEETSREVLKELERILEEIEDVVRKR

SEQ ID NO: 3565 - protein, 56 aa, Artificial Sequence
  Synthetic sequence.
KDRLKRLRDELERILRDHERLSRESKDKLDKLLERHKELSDEVRKKLKELRDRADT

SEQ ID NO: 3566 - protein, 61 aa, Artificial Sequence
  Synthetic sequence.
REIEEVEKEIERIIERIERTSRRVKEENDRLLEEIKRRSEEVKKRNDDIIREIRRVVEEDK

SEQ ID NO: 3567 - protein, 56 aa, Artificial Sequence
  Synthetic sequence.
ERRLKELKRKLDKLREDHERLSRRSDEELRRLEEEHKRLSEDSKRELDKLLDEVRK

SEQ ID NO: 3568 - protein, 60 aa, Artificial Sequence
  Synthetic sequence.
DEIERVLEEAKKLIRDLEEHSRRVEEENKRLLKEIRETSERVKRELDRILEEIRKTVERR

SEQ ID NO: 3569 - protein, 56 aa, Artificial Sequence
  Synthetic sequence.
DEKLRRLEEELKRLLDESKRLLEESEDELRKLEEEHRKLSEEVKRRLDELKKEVET

SEQ ID NO: 3570 - protein, 60 aa, Artificial Sequence
  Synthetic sequence.
REIEEIVERVKEIIDRIRRHSKEVEKENEKIIERIRRRSEEVLRTNEKALRDIERRVRER

SEQ ID NO: 3571 - protein, 56 aa, Artificial Sequence
  Synthetic sequence.
KDELKRLKEELERLLRESKKLVDESKRRLEELLREHRELSKRSRDKLDELLRRVEK

SEQ ID NO: 3572 - protein, 60 aa, Artificial Sequence
  Synthetic sequence.
SEIEEVVRRIREIIEEIRRLSEAALERNKRIIDEIRRTSKRVKEEIERIIRDIRRVVEER

SEQ ID NO: 3573 - protein, 56 aa, Artificial Sequence
  Synthetic sequence.
REDVRKLKEDLKELLKEHKRLSEESKKRLERLLEEHERISEELKRRLEKLLKEAED

SEQ ID NO: 3574 - protein, 60 aa, Artificial Sequence
  Synthetic sequence.
SEIEEVVKKVKKIIDEIRERSREALERNEKILEELKRHSEEVTRRAEKIIEEIKRVLEKR

SEQ ID NO: 3575 - protein, 56 aa, Artificial Sequence
  Synthetic sequence.
KDELTKLEKELEDLREEHRKLSKDSKDRLKKLLDESRELIERLKEKLKRLLEEAER

SEQ ID NO: 3576 - protein, 59 aa, Artificial Sequence
  Synthetic sequence.
SEVEEMLKRLDDILKKHRELVKEMKEELDRVIETHRRLVEEVRRRLEKSNDEIDKLVKA

SEQ ID NO: 3577 - protein, 59 aa, Artificial Sequence
  Synthetic sequence.
ERVEKALKEVRERLERSHKKAKEDLDRVREEARKSHEDVKRLSEEDRKKSEDLADEVRR

SEQ ID NO: 3578 - protein, 59 aa, Artificial Sequence
  Synthetic sequence.
REVEEALERLRKLIEDDRELVKRAKEKLDKLLKDDRKLVEDVLRELKRSNDEVKKLVDS

SEQ ID NO: 3579 - protein, 59 aa, Artificial Sequence
  Synthetic sequence.
KRAEEELRRVKEEVDRVLEESKRRLDEVRRRLERIEEESRTKSEEDRKRSEDLVREAER

SEQ ID NO: 3580 - protein, 59 aa, Artificial Sequence
  Synthetic sequence.
SEVERLVEDAERVIDEHRKLVTEMERRLERVNREDEKLVRKVLEELKKSNEEIKKLRED

SEQ ID NO: 3581 - protein, 59 aa, Artificial Sequence
  Synthetic sequence.
ERAKKLLDEIRKKLDDSNREVEKRSRDDERHTERVVRESKRLSEEDKKRSDELADETRK

SEQ ID NO: 3582 - protein, 59 aa, Artificial Sequence
  Synthetic sequence.
SRVEEVKKELDDLIRRHKELVEKVRKELKDLLDKHERLVEEAKKEIEKLIETLKRLAEN

SEQ ID NO: 3583 - protein, 59 aa, Artificial Sequence
  Synthetic sequence.
RRAEDELRKVRKEVERSNKEVEEILDDVRRKVEESDKRVKEILKKLREDVKKLLDEVRK

SEQ ID NO: 3584 - protein, 59 aa, Artificial Sequence
  Synthetic sequence.
SEVEKLVADADKLIKDHRKLVEEAKKRLDEVNERHRRLVEEVERRLDKSNKELEDLVRS

SEQ ID NO: 3585 - protein, 59 aa, Artificial Sequence
  Synthetic sequence.
RRADEELRRISERVKRSNEDVRKKSEDDKRHTDESDRDVKRLSKEDRERSETLMDRVRE

SEQ ID NO: 3586 - protein, 59 aa, Artificial Sequence
  Synthetic sequence.
SRVEDVERELEEEIDKHRKEVEDAKRRLDELIRRHKEEVKKLKKKLDDLIEELERLARN

SEQ ID NO: 3587 - protein, 59 aa, Artificial Sequence
  Synthetic sequence.
ERAKRSLDRVREKIEKSDRTAKDLLKKVEEEVRKSNERVKELLKRVKDAVDDLLRRRRK

SEQ ID NO: 3588 - protein, 59 aa, Artificial Sequence
  Synthetic sequence.
DEVEEVVKRAEDVIRTHKELVKKAKEDLDKIIEDIERELKKMLEDLERSNRRVEELVRG

SEQ ID NO: 3589 - protein, 59 aa, Artificial Sequence
  Synthetic sequence.
ERVKKILDDIRRELEESNKKVEEDLRKAEEDLEELLRRARELSKEDEKKSRKLVEDARR

SEQ ID NO: 3590 - protein, 59 aa, Artificial Sequence
  Synthetic sequence.
DEVDEVVKRLEDIIRKHETLVKKAKEDLDRVNEEDTKLIRDVLRRLKESNEEMERLVRS

SEQ ID NO: 3591 - protein, 59 aa, Artificial Sequence
  Synthetic sequence.
ERVKEELRRVEEDVKKSDEDARRLSKEDRDHTRENFKRSEELSRRDEETSRRLMEEVKR

SEQ ID NO: 3592 - protein, 61 aa, Artificial Sequence
  Synthetic sequence.
KDVEDLVRKAEELLKRHREDVTRLLERLKKVNKDHERLVKELKRRLEELLREVRELVERDG

SEQ ID NO: 3593 - protein, 59 aa, Artificial Sequence
  Synthetic sequence.
DEVERRLRRLEEELKKSHEEVERRLDEVRRHSKRSHDELRKVLRKLEEDLRRLAEEVKT

SEQ ID NO: 3594 - protein, 61 aa, Artificial Sequence
  Synthetic sequence.
SDLEELVKRAEKLLEEHKELVKRLEDRLRELDKRHKEIVERLRKELERLLREIRRIVEEKG

SEQ ID NO: 3595 - protein, 59 aa, Artificial Sequence
  Synthetic sequence.
DEAKRKLDELEERLRRSNKELEEKSEENERRTRESNEELERRLEDVRRKLERLREEVER

SEQ ID NO: 3596 - protein, 61 aa, Artificial Sequence
  Synthetic sequence.
KDVEDLLRRLEEIIKDHRREVEELLRELTKLDEEHKEEVRRLTEELERLLDEARRLVEEKG

SEQ ID NO: 3597 - protein, 59 aa, Artificial Sequence
  Synthetic sequence.
DEAERELERVEREVRKSSDKLRRDSKRNKERTRKSNEELERRLEEVERELRRLVAEVEK

SEQ ID NO: 3598 - protein, 60 aa, Artificial Sequence
  Synthetic sequence.
KKVEDLEERLERLLRDAERRVRELLDEARRLLETHRELSKRLLERLEKVNRDIREKAKEK

SEQ ID NO: 3599 - protein, 56 aa, Artificial Sequence
  Synthetic sequence.
ERLLRRVEKEVEDLLRTVKDLLRRIEEEVRKSLEESKKLLKEVEDHSRKLLEEIRK

SEQ ID NO: 3600 - protein, 60 aa, Artificial Sequence
  Synthetic sequence.
DEDEEVLRRLKELLKTHRKLSEDLLREAEAINEDHRRLSEELLRRLEKLNEEIRRKAKEK

SEQ ID NO: 3601 - protein, 56 aa, Artificial Sequence
  Synthetic sequence.
EELLRRVEEEVKKSNEESKKKIKELEEHSRRSNEESERRLREVEEHSRRLLEEIRK

SEQ ID NO: 3602 - protein, 59 aa, Artificial Sequence
  Synthetic sequence.
SEVEDIVRKVDEIIRRLERHNEELRKRVEEVLDRLRRHNEKLDRDVKEIIKEIERVIRG

SEQ ID NO: 3603 - protein, 56 aa, Artificial Sequence
  Synthetic sequence.
KDLLREIEEKVRRLVRKSEELLRRIAEDVKKVIEDSKDSHKKIEDELRELEERLRK

SEQ ID NO: 3604 - protein, 59 aa, Artificial Sequence
  Synthetic sequence.
SEVEDIVRKVDEFLERLKEHNRKLDKEAKELLDRLKRHNEKLDEEAKRLIEEIKRVADE

SEQ ID NO: 3605 - protein, 56 aa, Artificial Sequence
  Synthetic sequence.
KDLLREIAEKAERVKEESKRSHDEIADEIRKVEEESERSHREIAEELERLSRRLKK

SEQ ID NO: 3606 - protein, 60 aa, Artificial Sequence
  Synthetic sequence.
KDVEDIVREVERLIKELREHNKELVDRAREVLKELKDHNEKLVEDVKRLIEDITRKIRAN

SEQ ID NO: 3607 - protein, 56 aa, Artificial Sequence
  Synthetic sequence.
KDLLRDIERKVEKLERDSRRLLREIEEEIRKVIERSKELLERIEKELRDLMRELRK

SEQ ID NO: 3608 - protein, 59 aa, Artificial Sequence
  Synthetic sequence.
KEVEDIVEDVKRVLDELRRHNEKLVREVDRLIRELDKHNKELDDRATEIIKRIEEVVRR

SEQ ID NO: 3609 - protein, 56 aa, Artificial Sequence
  Synthetic sequence.
KELLERIDEEVKRVEETSRRLLREIAEKVKTLKEKSKRSHEEIRRRLEELADEIRK

SEQ ID NO: 3610 - protein, 60 aa, Artificial Sequence
  Synthetic sequence.
SEVEEIVRRVEKLIEDLKRHNEKLVDEVKKVIDTLRKHNEDLVRRVEEVIKRIEEVIREN

SEQ ID NO: 3611 - protein, 56 aa, Artificial Sequence
  Synthetic sequence.
KDLLRDIAEKVKTLKEDSRRLLEEIADRVRRLEEDSRRLLEEIRKEVERLKEELKK

SEQ ID NO: 3612 - protein, 59 aa, Artificial Sequence
  Synthetic sequence.
SEAEEAAREAKEAIDRLEEHNKKLDEDAKRAIEEARKHNKELDERAKRALEEIEKAARD

SEQ ID NO: 3613 - protein, 56 aa, Artificial Sequence
  Synthetic sequence.
TDAARRIAEEVKKLEKKSEDSHRKIAEDVKKAEEDSERSHRDIARRAEEVKKKADD

SEQ ID NO: 3614 - protein, 60 aa, Artificial Sequence
  Synthetic sequence.
SEVEKIVREVEKLLEELREDNRDLVRRADKDLERMERHNRKLVKDVEDVLRRIEEVRRAN

SEQ ID NO: 3615 - protein, 56 aa, Artificial Sequence
  Synthetic sequence.
KDLLREIERKIREVEEKSRELLREIKKKLEDVARESRRLLEEIARKIEKLSDELRK

SEQ ID NO: 3616 - protein, 59 aa, Artificial Sequence
  Synthetic sequence.
SRAERIVEEVEKVITDLERDNRELVRDVRRLLERLERHNKELDDRITEIIKEILRLAER

SEQ ID NO: 3617 - protein, 56 aa, Artificial Sequence
  Synthetic sequence.
EELLREIKRKVEELEKRSKELLEEIARRVKEVEEKSRDSHRKIRERLKELVRKVRE

SEQ ID NO: 3618 - protein, 60 aa, Artificial Sequence
  Synthetic sequence.
REMEEVLKEAKELLKESNKKAREIDRKIKELLDDSHRKVKETVDRVKRRIEELDRKVKEV

SEQ ID NO: 3619 - protein, 56 aa, Artificial Sequence
  Synthetic sequence.
EEVLREVEKELEDNKRELRESHKEIARELERNKEDIDRLVEEIKRRIEELKKRIDK

SEQ ID NO: 3620 - protein, 60 aa, Artificial Sequence
  Synthetic sequence.
DEMEKVLKEAEDELRRVEKEVREVDKEAEELLERSHRKVRDIVRRVTEELKRLKDKVEKI

SEQ ID NO: 3621 - protein, 56 aa, Artificial Sequence
  Synthetic sequence.
REMLEKLRREVERVKKEVDDSHREIAKKVERNKKEIDKLVREVEREVEELKKRIDK

SEQ ID NO: 3622 - protein, 60 aa, Artificial Sequence
  Synthetic sequence.
SEVEEVLEDAKRLLKEVEKRVREIDRRAEDLLRRSHEKVRRIDKDVKRLLREVEKKVEEV

SEQ ID NO: 3623 - protein, 56 aa, Artificial Sequence
  Synthetic sequence.
EEVLKKVEDDVRRLDEEVRRSHEDIRKKVEDNKKRIDESHEEIRRLAERVKKEIRK

SEQ ID NO: 3624 - protein, 60 aa, Artificial Sequence
  Synthetic sequence.
SEDEKVVKEAKRLLDENRRENKEIDERAEKALEDSHRKVRKIDKEAKELLEKLRRDVEEV

SEQ ID NO: 3625 - protein, 56 aa, Artificial Sequence
  Synthetic sequence.
RELLDKVRREVERLKEESKKSHDRIREELRRNKEEIEKSHDEIRRRVEKLDDEIRR

SEQ ID NO: 3626 - protein, 60 aa, Artificial Sequence
  Synthetic sequence.
SEVEEVEREVRKLLKESNDKVREIDKEAKKRLKDVEDKAREIDERITKLLKDIEDEVRKV

SEQ ID NO: 3627 - protein, 56 aa, Artificial Sequence
  Synthetic sequence.
EEVLRKVEKEVEDNKKELDESHKEVKREVEEVRERIDESHKRIRERADRVKKKIEK

SEQ ID NO: 3628 - protein, 60 aa, Artificial Sequence
  Synthetic sequence.
KELEDVLEDVKRLLKESNDEVKEIDDRARRLLEESHRKSEEVDRRAEKRLREIEDKVRKS

SEQ ID NO: 3629 - protein, 56 aa, Artificial Sequence
  Synthetic sequence.
EEMLREVEERARKNKEDIEKSHDEIRKEVEDNIRRDRESHKRIEEEARRVMAEIEK

SEQ ID NO: 3630 - protein, 60 aa, Artificial Sequence
  Synthetic sequence.
SEVERVLKEADKLLKDNDEKNERVDREVEKLIRDSHEKSKKVDERAKRALDKLDDEVRKV

SEQ ID NO: 3631 - protein, 56 aa, Artificial Sequence
  Synthetic sequence.
EEMLREVEKKVETLKKKSDDSHKEIEEKIRRNIEEDDKSHERIREEAEKLKKKIDD

SEQ ID NO: 3632 - protein, 60 aa, Artificial Sequence
  Synthetic sequence.
ELEELMKKIEDDSKKNDEDTERLVKEIRDRSKRNREESKKLHDEDRREAKRVLDEARRDV

SEQ ID NO: 3633 - protein, 59 aa, Artificial Sequence
  Synthetic sequence.
EEDVRRAIEEVRRLLEKSHRDSRRVIEEVRRLLEKSHRDNRKVNEDSRRLLKKVREDAE

SEQ ID NO: 3634 - protein, 60 aa, Artificial Sequence
  Synthetic sequence.
SLEDLVREIREESERNKKETRKLLRRIEEESKRNLDESERLHREDKKRLEDIAERLERRV

SEQ ID NO: 3635 - protein, 59 aa, Artificial Sequence
  Synthetic sequence.
EDLVRKVITEVKRLLEESHKESREVIREIKELLEESHEKSKKVNEESKKLAEDVLRKAD

SEQ ID NO: 3636 - protein, 60 aa, Artificial Sequence
  Synthetic sequence.
SLEELLKKIREESKRNLDETRKLHREDKEESRKNLEESRKLHEEDRREAERVKRRADREV

SEQ ID NO: 3637 - protein, 59 aa, Artificial Sequence
  Synthetic sequence.
EKLVREVVERLRELLRESHERSREVNKRSRDLLRRSHEKSRRLNEESRRLLEEVERRVK

SEQ ID NO: 3638 - protein, 60 aa, Artificial Sequence
  Synthetic sequence.
SADELLKKLRDESEKNKDDTRKLLEELRRRAEKNKKDIEDLLREIEKKLREVLEDIKRKV

SEQ ID NO: 3639 - protein, 59 aa, Artificial Sequence
  Synthetic sequence.
EEEVKRAVDEVRRLLEESHKKSREVIKRIKKLLEDSHKKVREIVTELDKLIKEVEKKVE

SEQ ID NO: 3640 - protein, 60 aa, Artificial Sequence
  Synthetic sequence.
DLKELVDELRKKSDDNLKETERLVREIEKRLTDNKRESERLVREIEKELRDLRERIERTV

SEQ ID NO: 3641 - protein, 59 aa, Artificial Sequence
  Synthetic sequence.
KDEVRKAIKEAEELLKRSHEESRRVIERVRKLIEESHRKNREAIKRIRRLIEEIRKEVD

SEQ ID NO: 3642 - protein, 61 aa, Artificial Sequence
  Synthetic sequence.
SEIEKVREELKELLERDEREVKRVIDDLRRLIKDLRERVKEVNKRDDETVKEIKKVIEERG

SEQ ID NO: 3643 - protein, 56 aa, Artificial Sequence
  Synthetic sequence.
EEVAREVEERSRRVKRKLEELIREIKTELDRVREEIERLSKRDREKNERLREEARR

SEQ ID NO: 3644 - protein, 61 aa, Artificial Sequence
  Synthetic sequence.
SEIEDVLRELKKLLTDDKREVERANRDDERTLRDIRRKVEEAIKKLEDLLRDVKRRVDEEG

SEQ ID NO: 3645 - protein, 56 aa, Artificial Sequence
  Synthetic sequence.
KDVAEEVERESRKVEKELEDLSERDKERNDRILRTIEELIKRVEEEIRKVKEDVER

SEQ ID NO: 3646 - protein, 61 aa, Artificial Sequence
  Synthetic sequence.
SEIEDVLRKLRKLLREDEKRVEDANRRDRDTVRKIEKRSEEAFKESKETNKRIEDKVRKTG

SEQ ID NO: 3647 - protein, 56 aa, Artificial Sequence
  Synthetic sequence.
KEVVEEVRDDSRRVEEKLRRLSKEDKEENDKIRRRDRKLVEDLRRDSDRILRKVET

SEQ ID NO: 3648 - protein, 61 aa, Artificial Sequence
  Synthetic sequence.
DEIERVVEEVRELLERDKRRSDEVIERLKRLLEKDEEDVDDVIRRSKETNERIRDKIEKEG

SEQ ID NO: 3649 - protein, 56 aa, Artificial Sequence
  Synthetic sequence.
KEVVDDLKRLSKKVYDDNKELIDRVRERSREVLRRLKELADELRKLSEKIKRDADK

SEQ ID NO: 3650 - protein, 61 aa, Artificial Sequence
  Synthetic sequence.
DDIEEVVKEVEDLLRRDAEDVERAIKELRKLLEDDRDRVRKVNEESRRIIEEIRKAIERRG

SEQ ID NO: 3651 - protein, 56 aa, Artificial Sequence
  Synthetic sequence.
KEVVDKLREDSERVKKKAEDLVEEIRRASEEVKKEVDDLSREDEERLEKLKEDARR

SEQ ID NO: 3652 - protein, 60 aa, Artificial Sequence
  Synthetic sequence.
SEAEELEDRIRKLLREVEETSRRILKRARELNKRIEEESRRIIKRIKELIDEIKELVRTR

SEQ ID NO: 3653 - protein, 56 aa, Artificial Sequence
  Synthetic sequence.
ERLLRKLEREVRRLSEEVTRLDEETRRHSDDLRRRVERLDETTRRELEKLADEVRK

SEQ ID NO: 3654 - protein, 60 aa, Artificial Sequence
  Synthetic sequence.
SEAEELIKRAEDLIREIKKRSDDLVREMERLNEEIKRVSDEIIKRIEEVLEEIKKLVKKV

SEQ ID NO: 3655 - protein, 56 aa, Artificial Sequence
  Synthetic sequence.
RRLLEKLKRELKDLERRVREENERSKRHSEELVRRARKLNEKTDKDLKRLEEETRR

SEQ ID NO: 3656 - protein, 60 aa, Artificial Sequence
  Synthetic sequence.
REIEEVRKEVERVRKRYKDEVRKIVEDARRVLEEHKRRVEKLLEELERILREAKRLTDEG

SEQ ID NO: 3657 - protein, 56 aa, Artificial Sequence
  Synthetic sequence.
EDMLREIEKAVRELNEESKELLERIEREVRKSEERSKEVIKEIAERARKVVEDTKT

SEQ ID NO: 3658 - protein, 56 aa, Artificial Sequence
  Synthetic sequence.
SEAEKVLTDNRDTLRRLKEELKKVLDENRKTLEELDKRLEEVHKRHNEELDRIRKD

SEQ ID NO: 3659 - protein, 55 aa, Artificial Sequence
  Synthetic sequence.
ERVKEELKRIDEDLKRVVDRIKEKAEDIDRKLKKRVKEIMDKARESLKTLEERVK

SEQ ID NO: 3660 - protein, 56 aa, Artificial Sequence
  Synthetic sequence.
DEMREVLKRLRELVEELRRELEEVLRRNRETLKRLEEELRRVHKEHNDVLKEIRDK

SEQ ID NO: 3661 - protein, 55 aa, Artificial Sequence
  Synthetic sequence.
ERMKDELKKILDEARRVVERIDREAKRIDDELREVVERISRDAKRSLDELDERTR

SEQ ID NO: 3662 - protein, 56 aa, Artificial Sequence
  Synthetic sequence.
DEMREVLRELEDELRKIKERLKRVLDRSRELLEEWREELERVHRRNEETLRRIEKN

SEQ ID NO: 3663 - protein, 55 aa, Artificial Sequence
  Synthetic sequence.
EEIKRRAEDILRELRRLVEELERRNEEINRRLAKRIKELMEKIRREDERLKKEVE

SEQ ID NO: 3664 - protein, 60 aa, Artificial Sequence
  Synthetic sequence.
DKAKRVRTELERRLEKLKRDARKVIEEHEKSLRDLEEEVRRVREEHERSLKELKEELDRK

SEQ ID NO: 3665 - protein, 55 aa, Artificial Sequence
  Synthetic sequence.
EDVTRELERVLDELRREVDRVRRELEKIDRELRELVKRIEDELRKINKELKEKSD

SEQ ID NO: 3666 - protein, 61 aa, Artificial Sequence
  Synthetic sequence.
DEVEELVKTVRKLVEDHNRKLEEVVRRLREIVKELEDRTRRALEEARRTVKRIEEEVRKRG

SEQ ID NO: 3667 - protein, 56 aa, Artificial Sequence
  Synthetic sequence.
ERLLRELKDLLEKSKRRVDELVKEIEKRNRDHKEKVRKIVDEIRRLLRELEERVKK

SEQ ID NO: 3668 - protein, 58 aa, Artificial Sequence
  Synthetic sequence.
KLEEILRRIRELLKRHHEKNKKILDDIREKSKKLKKKVDDILTRITEIIKDLEREVDG

SEQ ID NO: 3669 - protein, 59 aa, Artificial Sequence
  Synthetic sequence.
ERVLEDLRRKADDIIRRADEESRKIKEEADDIFRRSDELLKRLEDEAKRIADEVRKKTK

SEQ ID NO: 3670 - protein, 59 aa, Artificial Sequence
  Synthetic sequence.
DSDRIEETIKKLLKELSDKSKEVLDEIRKRLKDHHDRNRKVLEEIRRILKRLEEEVRRK

SEQ ID NO: 3671 - protein, 59 aa, Artificial Sequence
  Synthetic sequence.
KRALKEMLDRVRKIIKEYEDSLRRLKEEVDEIIERADRLSEELRRKAEKIIRDITDAVR

SEQ ID NO: 3672 - protein, 58 aa, Artificial Sequence
  Synthetic sequence.
DSEELLREIRKRLEDLSRKSEEIKRRIDEISRDLERKVEEIKKRIEELVRRVRTEADK

SEQ ID NO: 3673 - protein, 59 aa, Artificial Sequence
  Synthetic sequence.
RKVLERIREEADEIDKDYDRLLKEIRKKIEDIARDTERRLRELKDRVDKIIKKVEEDER

SEQ ID NO: 3674 - protein, 57 aa, Artificial Sequence
  Synthetic sequence.
REIETVTKKSRDLNREIDKKLKELTERVDKLIEEWKRKTDRVREEAKRAVKEIEDKN

SEQ ID NO: 3675 - protein, 59 aa, Artificial Sequence
  Synthetic sequence.
EELRRVIEESKRSNDELKKKADELSKRVKEALDRLEEEDKRVLEEIKDILRELRERRRK

SEQ ID NO: 3676 - protein, 56 aa, Artificial Sequence
  Synthetic sequence.
SEIEEVEKKSRELNRRVKERLDEVEEESRRLNEKWERDTRRVRERVEEEIKKIEER

SEQ ID NO: 3677 - protein, 59 aa, Artificial Sequence
  Synthetic sequence.
EKLDEVLKRSEDSNRELKRRAEELLRDSERTNEELRRRDEEVKREVEEKLKELEKEIRR

SEQ ID NO: 3678 - protein, 58 aa, Artificial Sequence
  Synthetic sequence.
SSKEILKEIDERVEELKRRNEKVDREIKEKVKRLEEENEKVDREIKEILKELEKEAEK

SEQ ID NO: 3679 - protein, 59 aa, Artificial Sequence
  Synthetic sequence.
EEVLERLRREVRKRIEDYKRKLDKIARDVDETIERYKRKLEEIKRRVEDEARKIKEEIR

SEQ ID NO: 3680 - protein, 61 aa, Artificial Sequence
  Synthetic sequence.
SRKEELKRRLDEALKKYEADLDELRRRHEEDVRRSKEENERLLKELEDAVRRAKEEVKKAG

SEQ ID NO: 3681 - protein, 56 aa, Artificial Sequence
  Synthetic sequence.
DRRVEKEIREAIERLKRNLERIKRNIEKVREDSKRVNKELRDKIREIIERIDRRLK

SEQ ID NO: 3682 - protein, 61 aa, Artificial Sequence
  Synthetic sequence.
SRKEKLLDDARKILKRAEEELKRLYDKHRRIIEEVKRDLERLKKEHEDVVRRVEDVLRKRV

SEQ ID NO: 3683 - protein, 56 aa, Artificial Sequence
  Synthetic sequence.
DKELEEDIRRIEDRLRRLLEELEKLIEDSMRELKRVLDELEKHIREVDEELEEDLK

SEQ ID NO: 3684 - protein, 64 aa, Artificial Sequence
  Synthetic sequence.
SEAERVKRELDEALKKAKKALEDNKRKLEEALRKHREDAKRWKEELEKALKEAEKAAKDLRRDA

SEQ ID NO: 3685 - protein, 55 aa, Artificial Sequence
  Synthetic sequence.
KEAERKLRELEKRAKEALERSKEHSDELEERARKANKEIEDKLKRLAEEAEKEAR

SEQ ID NO: 3686 - protein, 56 aa, Artificial Sequence
  Synthetic sequence.
SEAEKIKKDLDKIREDLKRLDREAEERVRRLSEELDRKDRELRKRIDEILKRMRDE

SEQ ID NO: 3687 - protein, 59 aa, Artificial Sequence
  Synthetic sequence.
DEDLKRLEDELRKVEEDNRRTLEELRRRVEEVSRRNKESLEDIRRKLEEAIRRLREKTR

SEQ ID NO: 3688 - protein, 56 aa, Artificial Sequence
  Synthetic sequence.
DGAEEVDDRLKKADEELRRKDKESDEKTKRIAEELRKLLEESKKKTEDLVRRLDEE

SEQ ID NO: 3689 - protein, 59 aa, Artificial Sequence
  Synthetic sequence.
EKRLRELEKKVEDVSRTNKKTLEDNRKKIAEVVKRLDEEIKRNKDTVRRVVERVKKDTD

SEQ ID NO: 3690 - protein, 60 aa, Artificial Sequence
  Synthetic sequence.
ERKERLKERLDEVKKEHERLVERWHRENREVLRENRETVERLERELERVLRELRDALREQ

SEQ ID NO: 3691 - protein, 56 aa, Artificial Sequence
  Synthetic sequence.
DEELEKRIEEVERKLRDTNRKIEELLKRLKKRHEEVDRELERLLEKLEREAEETRR

SEQ ID NO: 3692 - protein, 61 aa, Artificial Sequence
  Synthetic sequence.
SEEEELEKELEKVLRENEESVRRLHKRNRDVLKKNRETLEKLEEDLKRVLERLKRALDRKN

SEQ ID NO: 3693 - protein, 56 aa, Artificial Sequence
  Synthetic sequence.
EKEARDEVRRLKKKMDDVDKDVERLVRELEKEHEEVDKDLRRKLDEVRKELEDARR

SEQ ID NO: 3694 - protein, 57 aa, Artificial Sequence
  Synthetic sequence.
SEEERLEKELDEVLEDHKRRVEEWKKKMDEVNKKHKESIDRLREELDRVLDEVRKAG

SEQ ID NO: 3695 - protein, 60 aa, Artificial Sequence
  Synthetic sequence.
REEALKRLEELVRKLKEKLERINRRIARIVDKNTKEIKDTNDTLRKEVRDLMKELKDRTR

SEQ ID NO: 3696 - protein, 57 aa, Artificial Sequence
  Synthetic sequence.
REDEEVKKELRKILEDHKRRVEDWKRRLKKNLEEHRRRVEEWKRRLDELLEKVRRAG

SEQ ID NO: 3697 - protein, 56 aa, Artificial Sequence
  Synthetic sequence.
EEEIKRVIERLARDARRINERLRELLERLSEISERINREIEKIIDEARERLEREER

SEQ ID NO: 3698 - protein, 57 aa, Artificial Sequence
  Synthetic sequence.
SEKEEVKKRLKDNMRRAEELIRRDDREVEENRKRHDELVKEWDKRLREILKKAEDSG

SEQ ID NO: 3699 - protein, 56 aa, Artificial Sequence
  Synthetic sequence.
EKEIKEVLEELSRTSKRLIEDSKRSSERLSERSKRTNEEIERIVRAAKRTIEERER

SEQ ID NO: 3700 - protein, 60 aa, Artificial Sequence
  Synthetic sequence.
SVAEELEERLKEIKRESEKSIRDLRRLLEEIERRLRDINRKLDEIVKRVAEKIKDAETKG

SEQ ID NO: 3701 - protein, 59 aa, Artificial Sequence
  Synthetic sequence.
KKVVDDVERKLREIIRRHEEELKKIKEDLDKIREDHERLLREWKKELDELITRVAESAR

SEQ ID NO: 3702 - protein, 60 aa, Artificial Sequence
  Synthetic sequence.
SVSKKLDDELRKMEREIEKSNETIKKLIEDIRRRSKESRDRLKELLEEIKKRLKEAEERG

SEQ ID NO: 3703 - protein, 59 aa, Artificial Sequence
  Synthetic sequence.
EKVVEDIERRVEKVLTDHERELERVERELDDIIRRHEEELEKIERELEKIKEDVDRSAK

SEQ ID NO: 3704 - protein, 60 aa, Artificial Sequence
  Synthetic sequence.
DELDRLRELLEELKRRSETVIKEAEELLRKLERELRELIREWKEITERLARRMEDLSRKG

SEQ ID NO: 3705 - protein, 59 aa, Artificial Sequence
  Synthetic sequence.
REDLKRIEEELREILKRHRDANKRIKDEVEELLKRVEEMLRRLHEEDRKLLEDLKRETD

SEQ ID NO: 3706 - protein, 60 aa, Artificial Sequence
  Synthetic sequence.
RETEEVKKDVDRIRKASEDVARKMEKITRDVAKELRDLIEEWRRRSEELKKELEDLSRRG

SEQ ID NO: 3707 - protein, 59 aa, Artificial Sequence
  Synthetic sequence.
EDELKRIEEELRKILKEHEDKNREIKKENDRLNKEVEEEAEKATREDKRLLEKADRDRQ

SEQ ID NO: 3708 - protein, 57 aa, Artificial Sequence
  Synthetic sequence.
SEKEEIEKRLDKLLKEHEEENDKIRRTLKEINDRSKEEVERIEERLKDLLRRLRERI

SEQ ID NO: 3709 - protein, 56 aa, Artificial Sequence
  Synthetic sequence.
TKRARDRLEELRRESEELIKTARDLVRRSEKEHRDLIERLRRILEELREKLERKTT

SEQ ID NO: 3710 - protein, 60 aa, Artificial Sequence
  Synthetic sequence.
SVKEEVRTLLRRLERVSRELIRRLKEMLKTLHEENKKLIDDSRKLIRKIKRDLERVAERR

SEQ ID NO: 3711 - protein, 59 aa, Artificial Sequence
  Synthetic sequence.
KDTVKKVKEDLKDILRRHEEANERIRDELRRNLRKHEDDSKKSKEELDRILKKARDDAR

SEQ ID NO: 3712 - protein, 59 aa, Artificial Sequence
  Synthetic sequence.
DIEDELRKELEKHHTKSREVKRRLTELLKRHEDRVEEVERRLRKDLKELRDRIEELSKI

SEQ ID NO: 3713 - protein, 59 aa, Artificial Sequence
  Synthetic sequence.
EKVAREVEERLKRDHDDLRRVIEEIRKRLEDSHRELKKTIEDVKRRVEELIEEAERRMK

SEQ ID NO: 3714 - protein, 59 aa, Artificial Sequence
  Synthetic sequence.
SIREKLREVLERHHRTSRKVEEDLRRKLEDHHRKTREVAERLKEKVDRLREEIKRASRI

SEQ ID NO: 3715 - protein, 59 aa, Artificial Sequence
  Synthetic sequence.
ERVVRKIEKDLRDDHRRLKEIAKRIDDEARRDIKRLEEIIKKIEEEVDRLIEEVRRRDK

SEQ ID NO: 3716 - protein, 60 aa, Artificial Sequence
  Synthetic sequence.
DKDREIERLAKEAKDRHDKTLEDDRRRLEEVRRKIEETIRRIKKKLDEAKKRLKELVRDK

SEQ ID NO: 3717 - protein, 55 aa, Artificial Sequence
  Synthetic sequence.
EEILKELEEIVRRVEEKNKRLHDENEKDTRRVEAVLEDIKRRIDEIVRRLEERIK

SEQ ID NO: 3718 - protein, 60 aa, Artificial Sequence
  Synthetic sequence.
DEKDRIDKRMKEVLKKIEELIRRDERRLEKVRKDHEELVRRIEDELRRVLEELKKLVEEK

SEQ ID NO: 3719 - protein, 55 aa, Artificial Sequence
  Synthetic sequence.
EDIERKIRELEEKVERELKKIHDENEKLAEKARRDLERIEREIDKLVKDVEDAIR

SEQ ID NO: 3720 - protein, 60 aa, Artificial Sequence
  Synthetic sequence.
SEKDKITKTLEDAKRDHRKLVEEDEKALEEVERRHEEIVRRIEEKLKEAKEELDRLVRDK

SEQ ID NO: 3721 - protein, 55 aa, Artificial Sequence
  Synthetic sequence.
EKILREIEERIKEVKENLRRVHEENRELAKKVLKDLERILEEIKKIIKELRERVK

SEQ ID NO: 3722 - protein, 60 aa, Artificial Sequence
  Synthetic sequence.
SKKDEIEETIRRARERIKTIVDRIREELKRIRDKHKKLVDEDKKTLEEVLRTLRELVRDK

SEQ ID NO: 3723 - protein, 55 aa, Artificial Sequence
  Synthetic sequence.
DEILEKVKELVREVEEVLRRIEKEIEDLVRKVEEDLRRIHERNRELAKKADDDIK

SEQ ID NO: 3724 - protein, 60 aa, Artificial Sequence
  Synthetic sequence.
SKEEEIEKTLKKIEEDHRELVRRIERALDDARRRHKELVDRDDKELRDAERELDRLVREK

SEQ ID NO: 3725 - protein, 55 aa, Artificial Sequence
  Synthetic sequence.
EEILKEIRDLADEARRNLERILRDIERVVEKVERDLKRIHDKNKRDVERVRREVK

SEQ ID NO: 3726 - protein, 60 aa, Artificial Sequence
  Synthetic sequence.
KEKDDIDRDLKRAEEEHKRLVDEIRETLKEIEREHRERVKRIKEKLDEAKRRLEKLKRDR

SEQ ID NO: 3727 - protein, 55 aa, Artificial Sequence
  Synthetic sequence.
EKILEDIKREVDRVRKNLKEIKEKIDKEREDVKRDLDRIRKEIEELVEKVDRDVK

SEQ ID NO: 3728 - protein, 60 aa, Artificial Sequence
  Synthetic sequence.
DKARKIEEDIRRAEEEHKELVKRNEERIKEVAERHEETVRDIERKAEDIRRELKKLVDEK

SEQ ID NO: 3729 - protein, 55 aa, Artificial Sequence
  Synthetic sequence.
KEILDEVKKLVDEVRANLEKSHEDIERLVEKVREDLKRIEERLRKIAEDLRRRVK

SEQ ID NO: 3730 - protein, 60 aa, Artificial Sequence
  Synthetic sequence.
EEEREIEDTIRRAEEEHRKRVEDNKRRLEEAEKEHRKRVEDNKRRAEEIRRKLKELVDRK

SEQ ID NO: 3731 - protein, 55 aa, Artificial Sequence
  Synthetic sequence.
EEILKKVKELVDRVRRNLERSHEKIKRIEDKVRRDLERSHKELEDLMRRMEEEIR

SEQ ID NO: 3732 - protein, 57 aa, Artificial Sequence
  Synthetic sequence.
EKKERIEERAKEVEREHREIVKRDEEELERVREEHEESVRRDRKALEDVERDVRRDG

SEQ ID NO: 3733 - protein, 56 aa, Artificial Sequence
  Synthetic sequence.
MEDMLRKVKEVADENRERLKELHEENERTARRLRKLNRELHEENKRLVEEIKKEAK

SEQ ID NO: 3734 - protein, 57 aa, Artificial Sequence
  Synthetic sequence.
SKAEEIRKELDRVRREIEKRAEEDKRTLEEVRREHEKLVRENEETIKRVEEDVERAG

SEQ ID NO: 3735 - protein, 56 aa, Artificial Sequence
  Synthetic sequence.
MEDALREIKEVADEVRKKLRELHEKNKKLMDDNRRKLDKSHKDVREVEREIRERIK

SEQ ID NO: 3736 - protein, 57 aa, Artificial Sequence
  Synthetic sequence.
DKERRIEEELEKARRDHKEDVDRDRERLKEVREEHERLVRENKKRLEEIRKELEDRG

SEQ ID NO: 3737 - protein, 56 aa, Artificial Sequence
  Synthetic sequence.
MEDLLREVKRVVEKNKEDLKRLHDENEKLAEENRRRLKKSHDEVEKVAEDLKRKAK

SEQ ID NO: 3738 - protein, 57 aa, Artificial Sequence
  Synthetic sequence.
EKKERIEDDLRRVKEEIDDLLRKNEKRLREAEDEHRKRVEDDRRRLDEVRKEVDDEG

SEQ ID NO: 3739 - protein, 56 aa, Artificial Sequence
  Synthetic sequence.
MEDALRKLKRVADEIRKRLDESHKEIKKVVDDNRKKLEELHRKNRELERKIREDAR

SEQ ID NO: 3740 - protein, 56 aa, Artificial Sequence
  Synthetic sequence.
KDEERIKKKLKKLVDENRDLNRRIEETNRRVAEDLDRRLKEIEKRNRDMAEELRKS

SEQ ID NO: 3741 - protein, 55 aa, Artificial Sequence
  Synthetic sequence.
DEIRKRAEDAERETRETNRRIRDHTRRVAERVEKVLDEIRRHTEEVKKEVDEKER

SEQ ID NO: 3742 - protein, 56 aa, Artificial Sequence
  Synthetic sequence.
SDEERIKDKLEKLVKENEDKNRRILEENKRVADENRRLNEEIEKRLEEMVEELERR

SEQ ID NO: 3743 - protein, 55 aa, Artificial Sequence
  Synthetic sequence.
EEIRKRVKEAEDKTEETNRRIEKHHREVKKESEESNKRITDRLEEVKERVTRKRK

SEQ ID NO: 3744 - protein, 56 aa, Artificial Sequence
  Synthetic sequence.
KREEDIKRRLEKLAKENRERNEEIKRRLDELVDRNREENEKILRELEKMVRELERS

SEQ ID NO: 3745 - protein, 55 aa, Artificial Sequence
  Synthetic sequence.
EEARKRLEELKKETEDTNRRIDEAVERAKEETRRTNERIKEELKRVKKKVTDKRR

SEQ ID NO: 3746 - protein, 60 aa, Artificial Sequence
  Synthetic sequence.
SEVETAKEDLKKKVEENEKRIKDVEDKLRKTVEDNRKRLEDVLEELRRSVETLRDLLRKG

SEQ ID NO: 3747 - protein, 55 aa, Artificial Sequence
  Synthetic sequence.
EELEKRLREAEEKSDRLLRRLKEESRKAEEDSKRLLKELKEESRRAEEEVRRARD

SEQ ID NO: 3748 - protein, 60 aa, Artificial Sequence
  Synthetic sequence.
DEKEEAKERLKELRRRLEETDKRVDEELEKLMREMEDTDRRVKEKVDRSRREADEVLRRG

SEQ ID NO: 3749 - protein, 55 aa, Artificial Sequence
  Synthetic sequence.
EELKRRLRKVSEENKESNERLRRKVKRVVDENRRTNKELKETSKKVKEDIERKRK

SEQ ID NO: 3750 - protein, 60 aa, Artificial Sequence
  Synthetic sequence.
SELEEVTDRLRKLAEKARRLDKEYEEKSRKLKEEVERIDEDLDRLLKELTDEVREIAERG

SEQ ID NO: 3751 - protein, 59 aa, Artificial Sequence
  Synthetic sequence.
EEALRRIEKEIREVEKENRDTLERLRRHDEEVNRTNKETLDRLDEKLKRVEREIDERRK

SEQ ID NO: 3752 - protein, 61 aa, Artificial Sequence
  Synthetic sequence.
DEEEDLKEKVKKVETEHEETLKEIRRKLEDVKREHEKTVEEIRDHNRKVEERIRDVERRKD

SEQ ID NO: 3753 - protein, 55 aa, Artificial Sequence
  Synthetic sequence.
ERIRERLEELMRDARRLNRELDEKVRKLVEKARRDNTRVKKKSRELMKEIDDELR

SEQ ID NO: 3754 - protein, 61 aa, Artificial Sequence
  Synthetic sequence.
DEEEELKERIERVKDENRRSVERLRRELKRVEDDHRETVKDLERRLREVKKEIEELVRRKD

SEQ ID NO: 3755 - protein, 55 aa, Artificial Sequence
  Synthetic sequence.
EELKKKLEELMKEVRDLDRELKREVEELEREIRRLNKEIRERIEDLVRKAREAIR

SEQ ID NO: 3756 - protein, 61 aa, Artificial Sequence
  Synthetic sequence.
REEEELKKKLDDVRRENEESVKKIKEDIDRVRREHEKTVEEIRRHNKKVEEEIRAEVRRKD

SEQ ID NO: 3757 - protein, 55 aa, Artificial Sequence
  Synthetic sequence.
DRIREEIEKLAEEIRRLDERLEEELREIVRKMRELNRRVAEKSKELTEDARRRLK

SEQ ID NO: 3758 - protein, 60 aa, Artificial Sequence
  Synthetic sequence.
SEREEIRERLRRNLEELRKSIKKIEDDLRRLEKRHRDAVKEIEDRLRRLEEKLDEMAKRD

SEQ ID NO: 3759 - protein, 56 aa, Artificial Sequence
  Synthetic sequence.
REDVKRAVDEIHKHTKEKEDRLRKLLKDLEKNIEDAIRRLEKLLRDLEEEIKEAAK

SEQ ID NO: 3760 - protein, 59 aa, Artificial Sequence
  Synthetic sequence.
EESERILEKIRRAAEEDKERIRKAIEELRKLAEEDERKLRKANKEARDSARELRRLLKE

SEQ ID NO: 3761 - protein, 58 aa, Artificial Sequence
  Synthetic sequence.
EVVEEARRLIKKWREEVERLNEEIKKLVEDWDRRVKELNERHRDDDRKIEKEVEDEEK

SEQ ID NO: 3762 - protein, 60 aa, Artificial Sequence
  Synthetic sequence.
SELEKALEEIKRLAEDDMRRIKKVIKELEKLARDDEKRLREVIERLETEVRKLEELLKRG

SEQ ID NO: 3763 - protein, 58 aa, Artificial Sequence
  Synthetic sequence.
EVVDELRKRLKEVKERAEDLNRKLEELIRRWKERVERLNRELEKRMRDVEEKVRREEK

SEQ ID NO: 3764 - protein, 60 aa, Artificial Sequence
  Synthetic sequence.
SDLEKILEELKRLAEEDKRKLEEVIKKLEEAARKDAEDLKKVNEEAKKSARELEELLKRG

SEQ ID NO: 3765 - protein, 58 aa, Artificial Sequence
  Synthetic sequence.
EVVREIEELLKKIEEEVRRLNEELKRLADEWRREVRRLNEEHKDTDRRIKERVKRAEE

SEQ ID NO: 3766 - protein, 60 aa, Artificial Sequence
  Synthetic sequence.
KDMERMLKEIEDLARKLREELKRVLDELRKTAKRDEEELKKVNKEAKESARELEEKLRRG

SEQ ID NO: 3767 - protein, 58 aa, Artificial Sequence
  Synthetic sequence.
EVVKELRKLLKKIKDDVRRLDKELDELLRRWEESVERLNREHKKTDEKVEEDVKRTTT

SEQ ID NO: 3768 - protein, 61 aa, Artificial Sequence
  Synthetic sequence.
SEEEKVEKELRDLVREDDRRLREVEERVRKVVKEAEDDHRRVKEDIRRMVEEIRKKLDKDG

SEQ ID NO: 3769 - protein, 55 aa, Artificial Sequence
  Synthetic sequence.
ERLEDEVRKVEDRSRRMNERIDERLKRVEEESKKAIEELRRELERVKREVEERKR

SEQ ID NO: 3770 - protein, 61 aa, Artificial Sequence
  Synthetic sequence.
SEVEEVKKELEKLAREDEKRLEDVKEEVKESARRDKRRLEEVEEDLDRLVKELEDKLRDDG

SEQ ID NO: 3771 - protein, 55 aa, Artificial Sequence
  Synthetic sequence.
DELKRKLKRVEERSREVNRELRERDKKIEEDSRRINKRLKKKVDEVKEKVREDTR

SEQ ID NO: 3772 - protein, 61 aa, Artificial Sequence
  Synthetic sequence.
DEEEDVRRKLEELARRLKRRLEEIEKRLRDSVKEDRRKLEEVKEKLRELIKKLEDEIRKKG

SEQ ID NO: 3773 - protein, 55 aa, Artificial Sequence
  Synthetic sequence.
EKLKEDVERVKRDVRRVIRELEKTDERIERESRKVNEELKELVERVERSVKKADE

SEQ ID NO: 3774 - protein, 60 aa, Artificial Sequence
  Synthetic sequence.
DEDREARKKVEALLKEVEDRVRESKKRTKDLLREIEKRLRDTTREIDELRRRIEDLSRRG

SEQ ID NO: 3775 - protein, 59 aa, Artificial Sequence
  Synthetic sequence.
EEVLRELKELLDKIRETIERASKENEELLREIEKRIEDANRENTERLRRIEKRIDDDAR

SEQ ID NO: 3776 - protein, 56 aa, Artificial Sequence
  Synthetic sequence.
SEKDELRKRVEDIKETAKKVVEELREASRKIHEDNKRVNDRLRKESKRIKDKADKL

SEQ ID NO: 3777 - protein, 55 aa, Artificial Sequence
  Synthetic sequence.
ERAREEVRRIEKTIRDTARRVRERVRDSERRFRKLVREWEKLVEDSERKIDELSK

SEQ ID NO: 3778 - protein, 56 aa, Artificial Sequence
  Synthetic sequence.
SAKEEIKERVKRIEERLRRLLKELEEKVKRIHDENRKVNKELTDRSKEIKDRLKDL

SEQ ID NO: 3779 - protein, 55 aa, Artificial Sequence
  Synthetic sequence.
EEVREELKRIEERLDRTLREVRKTLEDIERRIRKAVEDWRRLVKESEERVKRLTD

SEQ ID NO: 3780 - protein, 60 aa, Artificial Sequence
  Synthetic sequence.
SEEERVRKDLKELHEHLKREVDKARKDLEDMHRHSEELAREVRERHERSKRELDELERRG

SEQ ID NO: 3781 - protein, 55 aa, Artificial Sequence
  Synthetic sequence.
EEIEERVRRNEDTLRRVLKELRERAKRNKDDIRRVLKELEDRSREIEKKLREAER

SEQ ID NO: 3782 - protein, 60 aa, Artificial Sequence
  Synthetic sequence.
TEEERARETLDRLNKHSKELVDRVREKLKRLVEHSRELLRRVDRKHKESEKRVREVSRRG

SEQ ID NO: 3783 - protein, 55 aa, Artificial Sequence
  Synthetic sequence.
DEIERRVERNKREIDKVLKELEERVRTNKDEIDKALEKLKRLSEEIKRKMREDET

SEQ ID NO: 3784 - protein, 60 aa, Artificial Sequence
  Synthetic sequence.
KEKEELDETIRRLEEHSKKKVDKVRKELKEMDEHSRDEARRVRREHEKSEEKVRRASEEG

SEQ ID NO: 3785 - protein, 55 aa, Artificial Sequence
  Synthetic sequence.
EEARERLRKNEEEIKKVLEELERRVRENKERIDDVERELEDLSRKIEEKLDRDDT

SEQ ID NO: 3786 - protein, 60 aa, Artificial Sequence
  Synthetic sequence.
KEEEEARRTLERIERRIRKALKEIDETLKRLNDHSAKRVKEVREKHEESRRKVDDVSRRG

SEQ ID NO: 3787 - protein, 55 aa, Artificial Sequence
  Synthetic sequence.
EEIRERVKRIKEEMDRALKRLKDKVKENKERIDEVLKDLRRTSKEIKERLDRSTK

SEQ ID NO: 3788 - protein, 56 aa, Artificial Sequence
  Synthetic sequence.
SKKEELERLLEEAKKKHEESERRLRESSKKLEEEIRRMKEHSKKSSEDAEDKLRRN

SEQ ID NO: 3789 - protein, 54 aa, Artificial Sequence
  Synthetic sequence.
ELLERIKDLVRRSEEENKKLLDEHRKIVKTLKERLEKLNEEHERIVREVERRTR

SEQ ID NO: 3790 - protein, 56 aa, Artificial Sequence
  Synthetic sequence.
SSEDELRRLLKEARDTHRESEKRLRDSSKRAEDMHEKSKEDVERSSRELEKELRRR

SEQ ID NO: 3791 - protein, 55 aa, Artificial Sequence
  Synthetic sequence.
ERLLDEVRKEMKRSEEENRRLLREHEEVVKKSIKENKELLDKHKEIEDRLREEIR

SEQ ID NO: 3792 - protein, 56 aa, Artificial Sequence
  Synthetic sequence.
SEKETLKRLLDEIKKRHKESEDRVRKLVEDAREELDRVADELRKSSEDLRRDLKRA

SEQ ID NO: 3793 - protein, 55 aa, Artificial Sequence
  Synthetic sequence.
SKLLREVEKLMEESRKRNEDLLKELRDIIEDLREKLRELLREHREAAKRLRDEIR

SEQ ID NO: 3794 - protein, 57 aa, Artificial Sequence
  Synthetic sequence.
DERETLEKLLKEVRDMHEESKKRLTDSSRKLREDLRRVKEELDKTLRDIEERAKEEN

SEQ ID NO: 3795 - protein, 55 aa, Artificial Sequence
  Synthetic sequence.
SRLLEEAKKLIEESKRENEELLKEHDKIVKELIKKLRDLLKEVEDRARDVTEEAK

SEQ ID NO: 3796 - protein, 56 aa, Artificial Sequence
  Synthetic sequence.
SSRETLDELLRRAEEIHRRSEEELRRSSEEVRRKHEKSERDLEKLLRDAEELLRRE

SEQ ID NO: 3797 - protein, 55 aa, Artificial Sequence
  Synthetic sequence.
DKLLDTVRKLVETSRDENRKLLEDHKKMVKESEDRNRELLRDLERVIEELSRRIR

SEQ ID NO: 3798 - protein, 56 aa, Artificial Sequence
  Synthetic sequence.
SEVEEILDRLRREVERSKKKVEDILRELKKLAEDTKEKVERVLDRNRKTIEELKKA

SEQ ID NO: 3799 - protein, 59 aa, Artificial Sequence
  Synthetic sequence.
EDLVTKLRDLLRRHHETLRRLAKELRDLLKKHHEELRRLIERLEKSLEDLERELDKTRR

SEQ ID NO: 3800 - protein, 57 aa, Artificial Sequence
  Synthetic sequence.
SEVEKILEDLKKLIKESKDEADRILTDHRRLVKETEEEARRALERNRKTVDDLRKAN

SEQ ID NO: 3801 - protein, 59 aa, Artificial Sequence
  Synthetic sequence.
EEALRELRRLLKEHHEILRKVEEELRRSDEEHHRRLEEVERRLRKSLRELEETVRETTR

SEQ ID NO: 3802 - protein, 57 aa, Artificial Sequence
  Synthetic sequence.
SEAERILEKLDRLVKETDRRVKEVLEDNRRTVRRLEEEVKRILKENRETARELEEAN

SEQ ID NO: 3803 - protein, 59 aa, Artificial Sequence
  Synthetic sequence.
EEVLRRLKKLLDEHNERLRRLERDLDRSLKEAKETLDELERRLEKSLRELKESVDRTRK

SEQ ID NO: 3804 - protein, 60 aa, Artificial Sequence
  Synthetic sequence.
SSEERLKEEFKRAAEKVRKVEEELRELHERVEKSSRDSKRRIRELLKRAEEEVKRVEDRG

SEQ ID NO: 3805 - protein, 55 aa, Artificial Sequence
  Synthetic sequence.
DEVLRDLKRLIEELEDKARRVLDKSRRIIERLRRKDEEVLRKLEKEIRELKKKAN

SEQ ID NO: 3806 - protein, 60 aa, Artificial Sequence
  Synthetic sequence.
DEERELRRLLEDVKRRVREVEEELRRLHEEIKRTSKRSKEELRKLHKELEDAVREMAKRG

SEQ ID NO: 3807 - protein, 55 aa, Artificial Sequence
  Synthetic sequence.
DKVLRDLEELVKELKRRLDEVLETSRREAEKLKRDDEKVLRESKKIMEDLRRRAE

SEQ ID NO: 3808 - protein, 60 aa, Artificial Sequence
  Synthetic sequence.
SEEDELRKLLEELRRRSKEVNDRLRKLHDELRRRVEDLKRKLRELHKEAAKIVEEMKARG

SEQ ID NO: 3809 - protein, 55 aa, Artificial Sequence
  Synthetic sequence.
DKVLEDLRRLVEENTRRLEEMLKRSEKIARDLLEDVKRFLDESKKKIDTLRRRAE

SEQ ID NO: 3810 - protein, 60 aa, Artificial Sequence
  Synthetic sequence.
SLEDELRRLLTEAEKRSKDVNERLRDLHREVRELSEDVNRKLEELHRELEERVKELKREG

SEQ ID NO: 3811 - protein, 55 aa, Artificial Sequence
  Synthetic sequence.
DEVLKKLKELVRRNEEELEKALKESKDIVEKNKRDLDEVEKKSREIVRELIERTK

SEQ ID NO: 3812 - protein, 60 aa, Artificial Sequence
  Synthetic sequence.
SLEETLEKLLREAEDISRKANKRLEEAHERIKRTLEDLERKLEKLNKEVRDRVERVKERG

SEQ ID NO: 3813 - protein, 55 aa, Artificial Sequence
  Synthetic sequence.
DKVLEKLKRLIEENKKRLERVLEKSDKILDDLRRKVEEVLKRLEKTVKDLEDEAR

SEQ ID NO: 3814 - protein, 61 aa, Artificial Sequence
  Synthetic sequence.
SEDEELLRRLEETIRRATERVKRLLDTLRKLAEDVRKELERLLDTHRELAKRIEDELREGR

SEQ ID NO: 3815 - protein, 55 aa, Artificial Sequence
  Synthetic sequence.
EEVERVLREVTKRLRDLKREHRKLLEKVKRELEKVEEDHRDSSRKLEEIIKEAEK

SEQ ID NO: 3816 - protein, 61 aa, Artificial Sequence
  Synthetic sequence.
SEAEKLAKDIREAAKRLREHAERDKEELKKAADKLRDEARRDAEKLKRAAEKLKDLARRTG

SEQ ID NO: 3817 - protein, 59 aa, Artificial Sequence
  Synthetic sequence.
EEAAKRIKELLDKARKDLEDAKREAEELNRRAREELEKAKKDAEDLNRRAKEELDKARK

SEQ ID NO: 3818 - protein, 60 aa, Artificial Sequence
  Synthetic sequence.
DDKDKLLEELRKVIEELEKKLEDNNRELEKVLEKLKREAERDLERLREMIRRLEELLRRD

SEQ ID NO: 3819 - protein, 59 aa, Artificial Sequence
  Synthetic sequence.
EEVLDRLRRIIEELRERLKRAEKSNRDILERIDRELEKLKRRAEELNEELRRRLKERRD

SEQ ID NO: 3820 - protein, 61 aa, Artificial Sequence
  Synthetic sequence.
SRTEEVLKELRTLMRELRRRLEEVIKELEKSAEELERIAREVAKRSRKVIEELKRKADKDG

SEQ ID NO: 3821 - protein, 55 aa, Artificial Sequence
  Synthetic sequence.
EELEDLLRRIRETLEDMKRRLDELDTELEKRLREVARTLDELHKELEETLRRLKK

SEQ ID NO: 3822 - protein, 57 aa, Artificial Sequence
  Synthetic sequence.
DAEDELRELSKRNKDEVREVKERLKKLSEENRRDLERVKRKLEKDSEENREALEREN

SEQ ID NO: 3823 - protein, 55 aa, Artificial Sequence
  Synthetic sequence.
EELKKRIEELIRRSRKLAEDLKKKLEDIHRETERLVRELAELVRDLHRRTKEKAR

SEQ ID NO: 3824 - protein, 57 aa, Artificial Sequence
  Synthetic sequence.
SAEDRLRELSKRNREEVEEVEKRLRELMERIRRRLREVKEDLRRLSEENRKTLERKN

SEQ ID NO: 3825 - protein, 55 aa, Artificial Sequence
  Synthetic sequence.
EEIEERIKRLIKESRDLARELEEKLRKLLEELEKLAKRLREKVKELHDDTERAAK

SEQ ID NO: 3826 - protein, 58 aa, Artificial Sequence
  Synthetic sequence.
SEEDELRELSRRNEEEVKKAKRDLEKLSRENEEDLKRVKRKLEKKSEDNRRILERDNR

SEQ ID NO: 3827 - protein, 55 aa, Artificial Sequence
  Synthetic sequence.
EEVKKKIEDLIRRSRELVERLKRKVEELHKTTKRLVEELEKTIDRIIEETRERAR

SEQ ID NO: 3828 - protein, 60 aa, Artificial Sequence
  Synthetic sequence.
SAEDELRRLLRENRERNKKADKDIKKLLDDNRRDLERLRRELERILREIEKRLKDVEKDV

SEQ ID NO: 3829 - protein, 59 aa, Artificial Sequence
  Synthetic sequence.
EDVVRELMKKVDDDHKESEKLVRESEEKLERDNERTRRIADKLRKELDDTREEIERDAK

SEQ ID NO: 3830 - protein, 56 aa, Artificial Sequence
  Synthetic sequence.
DSEERAEDVARENKEILERVDEKARKLLDDNRKVVEELKKTNEESSRELKRVLDEL

SEQ ID NO: 3831 - protein, 59 aa, Artificial Sequence
  Synthetic sequence.
EETVEELLKKMRAISRDSERKVKELLDKIRELSDRSRRRAEELNKEHKKIVDDIAERRR

SEQ ID NO: 3832 - protein, 57 aa, Artificial Sequence
  Synthetic sequence.
SVEERLRELVKENRDVVRRAEEEFRRLVEENKRILEEIDRRARESSRKLKDVLDKLN

SEQ ID NO: 3833 - protein, 59 aa, Artificial Sequence
  Synthetic sequence.
EETMERLLRKAKEISRRSKERLKRLLDKVKKLSEDSERELKKLLDEHEKIVEDIEREAR

SEQ ID NO: 3834 - protein, 56 aa, Artificial Sequence
  Synthetic sequence.
DDERRLREVSDRNRRILDRIKKEVERLLDEVRKILKEAEDRLRRSSERLEELLRKD

SEQ ID NO: 3835 - protein, 59 aa, Artificial Sequence
  Synthetic sequence.
EREVKKTLDEMRRRSRESEEELKKLLKEIKEIVEELKRKLDTLLKEHKEIVEEIKRRTT

SEQ ID NO: 3836 - protein, 56 aa, Artificial Sequence
  Synthetic sequence.
SDEERVRRLEEEVDKTLEKVERELRKVSEENKRTLDRLRAEMEKSSKELERVLEEL

SEQ ID NO: 3837 - protein, 59 aa, Artificial Sequence
  Synthetic sequence.
ERDVERTLRKIEETVKKLAEDLKRLLDEIKKISEESKRRAEELLRKHKKIVDDIDKRTR

SEQ ID NO: 3838 - protein, 60 aa, Artificial Sequence
  Synthetic sequence.
SMKEELDRLLKELRERNKEIEDRAEELLRRSTDSLRKVKEKLDKLLEESTRILRKVEKEN

SEQ ID NO: 3839 - protein, 55 aa, Artificial Sequence
  Synthetic sequence.
EKVLKDIKRVIDEDEERLKRVLDDYERRVRELEDKVKKILDRYKTEVDKLRERAR

SEQ ID NO: 3840 - protein, 60 aa, Artificial Sequence
  Synthetic sequence.
SVEEEIRDLLRKLREIVDRVRRRLKEILEESTRRLEEVTRRIDESNEDLKRAVDDVKRRN

SEQ ID NO: 3841 - protein, 55 aa, Artificial Sequence
  Synthetic sequence.
KEVLRKLEEEIEKLRKEAKKILDEYRKLVEDLADKIKKILDRNRKLIEELVREVK

SEQ ID NO: 3842 - protein, 60 aa, Artificial Sequence
  Synthetic sequence.
SESEKTLKDLDEISKRYEKKVREMLERHKRLSEETKKRDDEALERLTRLVKELKDVARRG

SEQ ID NO: 3843 - protein, 59 aa, Artificial Sequence
  Synthetic sequence.
EDVKRRLDELLERHKRISEEVEKRNEDLLREHEEISRRSKKRIDDLLREAERILDEMRR

SEQ ID NO: 3844 - protein, 60 aa, Artificial Sequence
  Synthetic sequence.
SESEKVLRDLEKISEDTARRLEDELRKHKEIVDRIKEEDDEMLDRLRKLVETLKRLAERG

SEQ ID NO: 3845 - protein, 59 aa, Artificial Sequence
  Synthetic sequence.
EEVKRRLEELLKRHKEESDRARERNERLLKEVRDLSEESRERIERLLRELEERVREDER

SEQ ID NO: 3846 - protein, 60 aa, Artificial Sequence
  Synthetic sequence.
SRSEKSLKELREISERTRKRLEDKLDRHEKESKKVEDKAREVLKELEDLVRTLEEVARRG

SEQ ID NO: 3847 - protein, 59 aa, Artificial Sequence
  Synthetic sequence.
EEVRRRLRELLERHKRISDEARKRNEDLLREHEKRSRDIEKRLDDLLKEAEDRLRERKR

SEQ ID NO: 3848 - protein, 59 aa, Artificial Sequence
  Synthetic sequence.
SDEEELRRLIEEHEKILKEIEDRVRESSKRNKEILKRLEDEVRKLLETVKDRLEKARER

SEQ ID NO: 3849 - protein, 59 aa, Artificial Sequence
  Synthetic sequence.
SETAKRVLDELKERSERSMEDLKRLLKEHKERVDEMRRRAEELLKRLREVIRKVEEEIR

SEQ ID NO: 3850 - protein, 56 aa, Artificial Sequence
  Synthetic sequence.
SRDEEVKRLKKEHEDILEEIRKRVDESSKRNEKILREIKERVKRSSDDLKRLLEEL

SEQ ID NO: 3851 - protein, 59 aa, Artificial Sequence
  Synthetic sequence.
EEDVERVLREFEEVSRRSEETLRRLLEKHKELVERAARELETLLKEHRERVRKIEEEAK

SEQ ID NO: 3852 - protein, 60 aa, Artificial Sequence
  Synthetic sequence.
SSKERLEKLLRELEEDLRRAHEEHKRLIKRLREILDEIRKRVEKLNRDLDRVLERAREEG

SEQ ID NO: 3853 - protein, 55 aa, Artificial Sequence
  Synthetic sequence.
EELLKEVKEMIKRLRKKIKKSLDDVRRVIRELEEHARRDLRKLEKDLKDIEDKLR

SEQ ID NO: 3854 - protein, 60 aa, Artificial Sequence
  Synthetic sequence.
DSEERLKELERRLRELLKRVSERSKKLNKEHEEINRKAEEEVERLNRELERDLEDAARKG

SEQ ID NO: 3855 - protein, 55 aa, Artificial Sequence
  Synthetic sequence.
DELLREAEKMLKELEELVREDEKRLKDISKEVEEHYRKDLEDVKRAIKEIRDRLK

SEQ ID NO: 3856 - protein, 60 aa, Artificial Sequence
  Synthetic sequence.
DSERRLEKLLRELKELLKRVEESLRRLNEEHKRINDEARERSKRLNEELEETLRKAREDG

SEQ ID NO: 3857 - protein, 55 aa, Artificial Sequence
  Synthetic sequence.
EELLKEIKDRLKELAEHVERDERRLKRISEEAEKRYREDVREVKEMIEEIERELR

SEQ ID NO: 3858 - protein, 60 aa, Artificial Sequence
  Synthetic sequence.
ESEERLRDLIRKIRELLEEIERRLRDLNRRLREILKRIEEESEKLNRELKKILDEARERG

SEQ ID NO: 3859 - protein, 55 aa, Artificial Sequence
  Synthetic sequence.
EELLKEVRERLRELEEHARRDLETLKRMIRKLEEEAKKDLRELEKMIKDIRDKLK

SEQ ID NO: 3860 - protein, 60 aa, Artificial Sequence
  Synthetic sequence.
SLEEALRKLEEELERLNEEAKRRIDRLIEELRRLNEEARKKIERLIEETRELLKRLAEEG

SEQ ID NO: 3861 - protein, 55 aa, Artificial Sequence
  Synthetic sequence.
REILERAKELLKKLEREYRELLKKIEKVVRDLEEKYRELLKRHRKETERLDREVR

SEQ ID NO: 3862 - protein, 60 aa, Artificial Sequence
  Synthetic sequence.
ELAERVKRLIEEHRKTDKEVEDRIRKLIEDHDRENRKVEDEIRKLIKELREIVDRARKEG

SEQ ID NO: 3863 - protein, 55 aa, Artificial Sequence
  Synthetic sequence.
EEILDKIREVHRRVRKKARDLAERIKDAHRKLRKKVEELLRRIKEMIRRLEEELR

SEQ ID NO: 3864 - protein, 60 aa, Artificial Sequence
  Synthetic sequence.
SDRERLTRLIEELRKLLEKWEREVKKINDEIRRTVEKVEEDSKKSIEDLRRLLKEMEDRG

SEQ ID NO: 3865 - protein, 56 aa, Artificial Sequence
  Synthetic sequence.
TKDLERRIEDVIRRLKKLADDDLRDLRRFLKELKERADKLRKEDEEALKELRDRAE

SEQ ID NO: 3866 - protein, 60 aa, Artificial Sequence
  Synthetic sequence.
SREDDIRRLIEEARKLVEDAERRSKKSIDDIRRLVKEWEEEVKRINDDLKRLIDEARKRG

SEQ ID NO: 3867 - protein, 56 aa, Artificial Sequence
  Synthetic sequence.
DKDLKERIKKLLDELRRLVEELEKRDKEMLDRIKKLADDDRRELERILKKLEDDLR

SEQ ID NO: 3868 - protein, 60 aa, Artificial Sequence
  Synthetic sequence.
SAEDTIRTLLERHDDLDREVEERSKESIRELRRLIKEWRERVRKLNEELKRLLDDLRRKG

SEQ ID NO: 3869 - protein, 56 aa, Artificial Sequence
  Synthetic sequence.
KEELIEEIKEMNKKAKKSVDELEKKDRDVLDEIRKMAKEDLDRLRKALEDLERDAR

SEQ ID NO: 3870 - protein, 60 aa, Artificial Sequence
  Synthetic sequence.
SSEDRVRDIERRHKEEDDRVEEESRRSTREIRELLRTAKERSDDSIRKLRKLIDDLRKEG

SEQ ID NO: 3871 - protein, 56 aa, Artificial Sequence
  Synthetic sequence.
TEELEKELEDVNRDVDRSAKRLKERDEEALKTLEDEIRKLEEKDKKVLEDLEREAR

SEQ ID NO: 3872 - protein, 57 aa, Artificial Sequence
  Synthetic sequence.
SDKEEVDKLKERNERVLEEVRRRLEKLEKDNKDTLKKIRDDSERLREKIKRVRDREQ

SEQ ID NO: 3873 - protein, 59 aa, Artificial Sequence
  Synthetic sequence.
REFVEKALREYEELLKRSRETLEELLRRYKKLLDESRKTAKEDLDRSEEIIKKLADESK

SEQ ID NO: 3874 - protein, 57 aa, Artificial Sequence
  Synthetic sequence.
SDEEEVKKLHDENKKVNDEMREESKKLHDENDRVNKEVKERAKKVSKELEDMLRREQ

SEQ ID NO: 3875 - protein, 59 aa, Artificial Sequence
  Synthetic sequence.
EETVRRLLEKVREEIRRSKKRADDDLKTTKELIEKSEREVDRLLEEIKKIIEELERRAR

SEQ ID NO: 3876 - protein, 56 aa, Artificial Sequence
  Synthetic sequence.
SELEKVLREVEENLREVKRENEEKLRRNEENIKRLEEEDRRRLEEIEKMIEEIERA

SEQ ID NO: 3877 - protein, 58 aa, Artificial Sequence
  Synthetic sequence.
EVEEELRRLREEYEEVSRRSKEELEKSLRRLEEVHKESRKRLRDLLKKLDDVAREERK

SEQ ID NO: 3878 - protein, 56 aa, Artificial Sequence
  Synthetic sequence.
DELRELLKDIKRTTEDVEREVEEILRKVEEMIRRLEEEDRKVLEDIRRKIEDIRRA

SEQ ID NO: 3879 - protein, 58 aa, Artificial Sequence
  Synthetic sequence.
EVRKEMERLRREHEDVDKKVRDELRKLEEELRRVHRESEKALRDLLRKLREVAEREKT

SEQ ID NO: 3880 - protein, 56 aa, Artificial Sequence
  Synthetic sequence.
DELEDFLRKVERVIKELRDDDKRALDRIREVTKDVERKAREILKRVEEVIRRIEES

SEQ ID NO: 3881 - protein, 58 aa, Artificial Sequence
  Synthetic sequence.
EAEEALERLKTRLEKVHRDSKRALEKLRRDHEEVDKRITEELRKLMERLKRVVDELRR

SEQ ID NO: 3882 - protein, 59 aa, Artificial Sequence
  Synthetic sequence.
SADEALRELEERNRKVNEDVKREDERLHREDREVNKRIREEDKKLHKTLRDVLEELRKK

SEQ ID NO: 3883 - protein, 59 aa, Artificial Sequence
  Synthetic sequence.
ERRVEKLLRRYKKVLDEVKRELKESLDKAERVTRKSEDDARRSLEEIKKEIEEVRERIR

SEQ ID NO: 3884 - protein, 59 aa, Artificial Sequence
  Synthetic sequence.
RVDEELRKLVEDNKRKNEEVKKELKKLKEENERVNKEVRERDRKLHEKLRRVLEEVRRT

SEQ ID NO: 3885 - protein, 59 aa, Artificial Sequence
  Synthetic sequence.
EEEMRRLLEEYEELVRRVLKRLKEILEEYERLVRRVEEEVKKSLEDIERKIKEAKDRVD

SEQ ID NO: 3886 - protein, 59 aa, Artificial Sequence
  Synthetic sequence.
DVEEEVKKLKDKNRRINEEVKKRMRELEERNKELNKRIREEDERLHRELRKVLEEARKT

SEQ ID NO: 3887 - protein, 59 aa, Artificial Sequence
  Synthetic sequence.
REEVEKLLREYEERLERVRKRVEEILAKYKELLDRVEERARKSLKEIKETIEDARRRIK

SEQ ID NO: 3888 - protein, 59 aa, Artificial Sequence
  Synthetic sequence.
SMDEELDKLTRENEAVNERVEREARRLKEENRKVDEEVRRAVEELKERVRRVLEEVRRK

SEQ ID NO: 3889 - protein, 59 aa, Artificial Sequence
  Synthetic sequence.
EEDVRRLLEEYARLVREAEREVREILRKYEELVRKARKDAKKLLDDIERKIEKIKRDVD

SEQ ID NO: 3890 - protein, 59 aa, Artificial Sequence
  Synthetic sequence.
SMDEELKKLVKENEDLNRRVREEAERLRKENEKVDEDAEREDKRLHDKAERVLRELRRR

SEQ ID NO: 3891 - protein, 59 aa, Artificial Sequence
  Synthetic sequence.
ERTVTELLKEYRELVRRVEERVKKILKEYKEEVEEVKRRLEESLKDIERKIDEIRRRAT

SEQ ID NO: 3892 - protein, 59 aa, Artificial Sequence
  Synthetic sequence.
SMDEALEELTRRNEEVNKRIEEEDRKLHKRNKEVDDEVRKRDKDLHDELRRVLEDARRT

SEQ ID NO: 3893 - protein, 59 aa, Artificial Sequence
  Synthetic sequence.
EDEVEKLLREYKRRVEEVKKRAEDSLKRYEEEVKELEDEVRESLERIRRDIEDVKRRID

SEQ ID NO: 3894 - protein, 59 aa, Artificial Sequence
  Synthetic sequence.
SMDEAVEKLKKENKDIDEEVRRRLDELRKRNEEVNKKIKEDDDRLHKEAKEVLEDVRKT

SEQ ID NO: 3895 - protein, 59 aa, Artificial Sequence
  Synthetic sequence.
EDIVRKLLREYEKLLREVRERARRILEEYKRLVKEVRERAERSLEELKREIKKVRDRAK

SEQ ID NO: 3896 - protein, 60 aa, Artificial Sequence
  Synthetic sequence.
SEKEELLRKAKEVIDRIRKELEELLRRAREVNKDSRRTVEEVLRKAREVSERVRKASERG

SEQ ID NO: 3897 - protein, 55 aa, Artificial Sequence
  Synthetic sequence.
EELDDLRRRAEELLKRAEDEIRKLHEENKRSNEEAERAIRELAKRNKELDDKTRE

SEQ ID NO: 3898 - protein, 60 aa, Artificial Sequence
  Synthetic sequence.
KEKEDLIEKMKKVLEDIRKRLEELLKRARKVNEDSRKLVKEVLDKIKKVNEDVRKVATES

SEQ ID NO: 3899 - protein, 55 aa, Artificial Sequence
  Synthetic sequence.
EELTRLAREIEKLLEEARRRVEKLHEENKRSNEEAKERMERLRDHNRKLDDDTRK

SEQ ID NO: 3900 - protein, 60 aa, Artificial Sequence
  Synthetic sequence.
REREELIKKVRTVHKRSEEELRRHSEEVKKVNRDSRERVKEHLKRVKEVIKELEDVARES

SEQ ID NO: 3901 - protein, 55 aa, Artificial Sequence
  Synthetic sequence.
RELKELADRNKKLLEDIEREHKKLHEDNRRSNEDARRRHEELKREVEKLLDELRK

SEQ ID NO: 3902 - protein, 60 aa, Artificial Sequence
  Synthetic sequence.
SLEEEIKRLVKHHEELLREVRKRLKELEDHHRELDERHRRMLEELVREARKLIKDVKDDI

SEQ ID NO: 3903 - protein, 59 aa, Artificial Sequence
  Synthetic sequence.
EETVERILRTLKTTDERTTDTVREILRKIKRTNEESKETADRTVKRAKDLIREIRERVR

SEQ ID NO: 3904 - protein, 60 aa, Artificial Sequence
  Synthetic sequence.
SAREAIKEIKKHHKKLLEDVKETIDRIEEHHRKLDKDHRDELKKLLEEVRELLRDIRSRI

SEQ ID NO: 3905 - protein, 59 aa, Artificial Sequence
  Synthetic sequence.
ERTVEKILEELKDMNRATKRRVEEILRRLKKTNDESEKRARDTLTRIKELIEEVERRAR

SEQ ID NO: 3906 - protein, 58 aa, Artificial Sequence
  Synthetic sequence.
DESEELKKEAKEILDRLEKVLRELTDRNREMLKRIEKLIRENEKRLEDILREIAKRAS

SEQ ID NO: 3907 - protein, 59 aa, Artificial Sequence
  Synthetic sequence.
EEVEKELKRIKDELKRLVEKAERSLRESEERLRRLLEEAEKRNRKVEREIEKLLDDTRK

SEQ ID NO: 3908 - protein, 56 aa, Artificial Sequence
  Synthetic sequence.
SKEEKITRDAEEVLRRSEEIIRRLLRRLEEVLKDLERSARENKKRLDKILEDLAKL

SEQ ID NO: 3909 - protein, 56 aa, Artificial Sequence
  Synthetic sequence.
EKRVKRMEEELRRLHEEVRRRVEKVKRDMDRLNKKIKEDSRRVNEEIRKLLEDKTR

SEQ ID NO: 3910 - protein, 56 aa, Artificial Sequence
  Synthetic sequence.
SEEEKVRKELEEVLRRSDEDIERNRRRLEKVLDDLRRSAEENKRRLKEILDRLKDT

SEQ ID NO: 3911 - protein, 56 aa, Artificial Sequence
  Synthetic sequence.
EKEVRKVKDRLDKLHEKVKRISEEVNERIRRLNKRIKEISKRLNEELEELLRRRRT

SEQ ID NO: 3912 - protein, 56 aa, Artificial Sequence
  Synthetic sequence.
DELEKFKEDVKEVIKKLAETIKRLLDDVRRVLEKLRKLAEENKERLDRILDELRRL

SEQ ID NO: 3913 - protein, 56 aa, Artificial Sequence
  Synthetic sequence.
EKEVARLREEIKKLNERLKREVERLKRELEKLLRDIEKTSEDANRRLKELLDRTRK

SEQ ID NO: 3914 - protein, 56 aa, Artificial Sequence
  Synthetic sequence.
RREEELLERAEEVLEKLERIIEETERELKEVLDRLRKSIEDNLRRLKKVLKELKDN

SEQ ID NO: 3915 - protein, 56 aa, Artificial Sequence
  Synthetic sequence.
EKDLTEVKKRLRDLLKKMEDVLREVKKRLDDLNREMDDRSRKANEELRDLVRRKEK

SEQ ID NO: 3916 - protein, 61 aa, Artificial Sequence
  Synthetic sequence.
DVERKLREVEERHKDVLKKAKELLDKVEEDHKKSSKEVEDVLEEMRRRAEKLVRDAVRKKG

SEQ ID NO: 3917 - protein, 59 aa, Artificial Sequence
  Synthetic sequence.
DELARRIEEELEKLLRTLEELVTEIIKELEKLLKTHEDLLREVEKTLRRIIEELEKRDK

SEQ ID NO: 3918 - protein, 61 aa, Artificial Sequence
  Synthetic sequence.
SVEETLRTVEEEHRKSSKEAEELLEEVERRHEESSKRLEDTLREAEKEVRRLAEDVVRRRG

SEQ ID NO: 3919 - protein, 59 aa, Artificial Sequence
  Synthetic sequence.
KELVDEARRELKELLETHKETVKRVLDKLRDLLRTHEEKMKDVEETLRRLLERLKEETR

SEQ ID NO: 3920 - protein, 61 aa, Artificial Sequence
  Synthetic sequence.
KVEDSLREVKKRHKDKVDEVRKRLREAEEENKRLLDEVRRELERVEERIRRIVEEIVRKKG

SEQ ID NO: 3921 - protein, 59 aa, Artificial Sequence
  Synthetic sequence.
DEEARDIERRLRDLERTLEELVKEADERLKRSNEEDEERIRRVRKKLEELLRELEKRDE

SEQ ID NO: 3922 - protein, 58 aa, Artificial Sequence
  Synthetic sequence.
DEDRDLKRELDRLLREHEELVDRSTKRLEKLLRKHEREARESKKELEKLNDELREIAR

SEQ ID NO: 3923 - protein, 59 aa, Artificial Sequence
  Synthetic sequence.
EDVKRKLEEVRRRIEESVKRHRETVEEMRRRVDESVRRHERTVDELRRTHEELIERVRR

SEQ ID NO: 3924 - protein, 59 aa, Artificial Sequence
  Synthetic sequence.
KDEEKIIEDLKRLLRKHEKLVEESRERLKRLLETIRKIAKDIVERLKRLNEELREIAKR

SEQ ID NO: 3925 - protein, 59 aa, Artificial Sequence
  Synthetic sequence.
EEAREKIKRVVEELKESVERHERDVDRVRREAERLLEEVTRRIETVRRTHERLIEEIKK

SEQ ID NO: 3926 - protein, 59 aa, Artificial Sequence
  Synthetic sequence.
SEKDEIKRELEELLREHEKLAEESRRRAEELLRDIERRARESLTELRELNKKLREEARR

SEQ ID NO: 3927 - protein, 59 aa, Artificial Sequence
  Synthetic sequence.
EDVEREIRKVREDLKRSVDEHRKDLERIRRELEELLEKHHEDLRDVERTHRELLKEIKR

SEQ ID NO: 3928 - protein, 56 aa, Artificial Sequence
  Synthetic sequence.
DVEDELRRLHEENKDLLREAEEELERLHRENKKLLEDARRLLERLEEELERIERRL

SEQ ID NO: 3929 - protein, 59 aa, Artificial Sequence
  Synthetic sequence.
REEVEREVRKIEKLIRDSRERVRELIEKIERTLRDSERRVRELVKEVEKRLREIERKVE

SEQ ID NO: 3930 - protein, 56 aa, Artificial Sequence
  Synthetic sequence.
DVEKELKELHDKNEEILERARRLLERLHKENEEINKRVEEALRRLAEELRRLKEEL

SEQ ID NO: 3931 - protein, 59 aa, Artificial Sequence
  Synthetic sequence.
RREVKELIRKIDELLRRSKEEVDRLVKEVERLLRESKRRVEEVIEKLRKIIEELEREVR

SEQ ID NO: 3932 - protein, 56 aa, Artificial Sequence
  Synthetic sequence.
REVEEVIKDARRLLEELRKHSEDEVRKVEEEIKRLRDDNKRAVDDIERLLRELEEA

SEQ ID NO: 3933 - protein, 59 aa, Artificial Sequence
  Synthetic sequence.
RRAETKLEELRRRLDEILRTTEELLRRLKRELEKLSEESKARLDELKRKLDEILKETRR

SEQ ID NO: 3934 - protein, 57 aa, Artificial Sequence
  Synthetic sequence.
DEAREIVRELEKRIKDIEDRARKLIRELEKSLEDLKRRVEEMLREWEEESKELERRN

SEQ ID NO: 3935 - protein, 56 aa, Artificial Sequence
  Synthetic sequence.
REKVKEIKKRLDELLKRIEDELRRIREEDKRIHDEVEKELRKLERRDEELLKRLED

SEQ ID NO: 3936 - protein, 57 aa, Artificial Sequence
  Synthetic sequence.
SEAEDIVRKIEELLKRHHDRVEEMLRRWEELTRRHSEKAEKIVREVEKLIDELREAK

SEQ ID NO: 3937 - protein, 56 aa, Artificial Sequence
  Synthetic sequence.
EEEVKRLEKEIRDNLREMEERLKELEKRDKDNLDRIRELHRRLREELEKLLEDARR

SEQ ID NO: 3938 - protein, 59 aa, Artificial Sequence
  Synthetic sequence.
SMDELLKRLEEEDRKLNEESKETLERLRKHDEDLNRKNREKLKELKDRVDRVLEDAKKR

SEQ ID NO: 3939 - protein, 59 aa, Artificial Sequence
  Synthetic sequence.
EDDVRREVEDVKRRIEDSREKLRKLTEKWKKLNRESDEKVKKHVEDVEREIEKVRKEAE

SEQ ID NO: 3940 - protein, 59 aa, Artificial Sequence
  Synthetic sequence.
SSEEELKKLSDKARRLNDENRKILERLKEHDERLNKRNKEELKRLREDVERLLEDARRR

SEQ ID NO: 3941 - protein, 59 aa, Artificial Sequence
  Synthetic sequence.
EEDVKRKLDTIDKVIRDVRRRIEEHVRRWEELNRRSKKEIEDHVKTVEDVIKEAKDRID

SEQ ID NO: 3942 - protein, 61 aa, Artificial Sequence
  Synthetic sequence.
DEDEEVDREVREMIKRLEEHVKRDEDTLEEMLKRLRDHVERDRRRLEELLKDLERLVRERG

SEQ ID NO: 3943 - protein, 55 aa, Artificial Sequence
  Synthetic sequence.
EELKRLDREAEELLRRVDRLNEEVEKKLRKLLEEVRRENKRLEEEAKRLLDKAEE

SEQ ID NO: 3944 - protein, 61 aa, Artificial Sequence
  Synthetic sequence.
DEDEEVRKKVEEEIKRLKKEVEEDRRDVERLDEESKDKVRRDEKKVKDLLKELEDLVRRDG

SEQ ID NO: 3945 - protein, 55 aa, Artificial Sequence
  Synthetic sequence.
EELKRLEEEAKDLLRDVERLNRELHKRNREILEEATRRNEELKRELKELLDRARK

SEQ ID NO: 3946 - protein, 61 aa, Artificial Sequence
  Synthetic sequence.
SEEERVKEELDKAIKTLEKLVKDDLKKVADALRRLREHVEKDLRDLEEVLRELKELVDKTG

SEQ ID NO: 3947 - protein, 55 aa, Artificial Sequence
  Synthetic sequence.
EELKRAERELDRLLTEADRRNDELRREAERLLEKVNEDNRTVKERARRLLDDARR

SEQ ID NO: 3948 - protein, 61 aa, Artificial Sequence
  Synthetic sequence.
REDEEIVKEMERLLERLEELSRRIMEEVKRIDKESEDHIKRDEDKLREELERLRDLVRREG

SEQ ID NO: 3949 - protein, 55 aa, Artificial Sequence
  Synthetic sequence.
EELKELEERAKRLLERHERTNEELHRRNEEILRKANELNEEVRRRLDKLLDEVRT

SEQ ID NO: 3950 - protein, 61 aa, Artificial Sequence
  Synthetic sequence.
DREREVRRRVKEALDEIKRHVDRDRKKAEDMDRRSRELSDELRRRVDDLIKRLKELVDRDG

SEQ ID NO: 3951 - protein, 55 aa, Artificial Sequence
  Synthetic sequence.
EELDELRKELDKLLTEVDETNKKLHEDNKRILDDHDRINEELRRRMEALLREATR

SEQ ID NO: 3952 - protein, 61 aa, Artificial Sequence
  Synthetic sequence.
SEEEDMVRRVREMIKRLRDHVRRDKDKLDKEDKRSADHVDRDRKRLEDLLKELRDLVRDTG

SEQ ID NO: 3953 - protein, 55 aa, Artificial Sequence
  Synthetic sequence.
EDLKRLEKELRDLLDEVNKENEKVHRRNREILKRADELNEEAERRLRELLREAEK

SEQ ID NO: 3954 - protein, 61 aa, Artificial Sequence
  Synthetic sequence.
KEDEEVKDKVEKLIRKLEKESRDISEEVKRLDEESKKLARDLTEEVDRVIKRLRELVERDG

SEQ ID NO: 3955 - protein, 55 aa, Artificial Sequence
  Synthetic sequence.
EELKKLEKKLEELLERHRRDNKRLHEENRRILEELRRRIKELKERLRRLKEEARK

SEQ ID NO: 3956 - protein, 60 aa, Artificial Sequence
  Synthetic sequence.
ETDERLDELRRRLEKSLKDHKKLLDEVRKKAEELLDRNARLLEELKRELDELLKKVEEDN

SEQ ID NO: 3957 - protein, 59 aa, Artificial Sequence
  Synthetic sequence.
REVVEELLRRAEEEIRRHRKKVKESLDRLEDEIRKVEEDSRRSEKKVRKLIEDVKRRVK

SEQ ID NO: 3958 - protein, 59 aa, Artificial Sequence
  Synthetic sequence.
STEETLEKLDRDLKDSSRRNEELLKRVDDRLRESSKENRKILKELSDRLRDLLEKVKKD

SEQ ID NO: 3959 - protein, 59 aa, Artificial Sequence
  Synthetic sequence.
DKVVRELVKRAEDEIRDHKRLSKESLDRLDEEIKRHRELSKESMEEADRLIKTVKERVR

SEQ ID NO: 3960 - protein, 59 aa, Artificial Sequence
  Synthetic sequence.
ELDDLLREVEKRVRDLNRRNEEELRRVEDRMRESLRKSEEDLRRVEERLKKTLTRVKTE

SEQ ID NO: 3961 - protein, 59 aa, Artificial Sequence
  Synthetic sequence.
RRSAKKILDDLERTLEDVERRSRESVRRLREEIETHRKLVEELKKRLDDLEEEVKERVR

SEQ ID NO: 3962 - protein, 56 aa, Artificial Sequence
  Synthetic sequence.
SSDEILKRVKEELDRLLEENKRLLEEARKRLEDLIRKNREDLKRVEEKMRRLLEET

SEQ ID NO: 3963 - protein, 59 aa, Artificial Sequence
  Synthetic sequence.
EEVVRRLAEELRRLIEEVKRKIEESERRLKETLDRYRKLVEDSLRKLEETIRRVREESR

SEQ ID NO: 3964 - protein, 56 aa, Artificial Sequence
  Synthetic sequence.
SSEELLRKVKEDAKKIIKENEELLRKVDKDMRDIIKENRDLLEELTERVKRLLDRT

SEQ ID NO: 3965 - protein, 59 aa, Artificial Sequence
  Synthetic sequence.
EEVVKRILEELKKLLDEAERLSRESLKELEKMLREYRESVERSLRKVDDTLRRVEEKSR

SEQ ID NO: 3966 - protein, 59 aa, Artificial Sequence
  Synthetic sequence.
DDKRLLEEIRRRADELIKENEELLRRLEKLNEDLERRNKELNERLAERVKRLEEDVRRR

SEQ ID NO: 3967 - protein, 59 aa, Artificial Sequence
  Synthetic sequence.
RRIVEEEVDRVRKTIEELKRKSEDLVREHEEIVRDLERKSRELVKKVEKLLRDVRERAR

SEQ ID NO: 3968 - protein, 60 aa, Artificial Sequence
  Synthetic sequence.
SVDEMLKEIRDRAKKVDEDNRRLVERLEERNRELDERNKRLLDDIRRKVEEVMRIADERV

SEQ ID NO: 3969 - protein, 55 aa, Artificial Sequence
  Synthetic sequence.
KELVDRVRKLLEEVRRKSEKLVREHEDLVRRNEEHSRRLVEEADRILERAKRELD

SEQ ID NO: 3970 - protein, 60 aa, Artificial Sequence
  Synthetic sequence.
SVEEMLRRLRERDEEINDRLRRLAEDLKRENKRLDDENKKLVDEIREDVERLKEKLDRKL

SEQ ID NO: 3971 - protein, 55 aa, Artificial Sequence
  Synthetic sequence.
SELLKRWEELLRRLEKRIRDLVEDHKRLVEENERHSRKLVEEVKKALTDAEKKVE

SEQ ID NO: 3972 - protein, 60 aa, Artificial Sequence
  Synthetic sequence.
SVEELLEDIRRRVEKVKEDNKRMLEDLERKNRELKKEADDLAREIKKRVRDLEKELDEKL

SEQ ID NO: 3973 - protein, 55 aa, Artificial Sequence
  Synthetic sequence.
SKLVEEVRKLLEEARRESEELLRRHKKLVDDNRRHIRKLFEDVKKILDDARKEVE

SEQ ID NO: 3974 - protein, 61 aa, Artificial Sequence
  Synthetic sequence.
SEEEEIVKDVERVIRELEERHKDLVRRAREDIKRLREHIRRSIRALDEDIKRIEEKIRRDG

SEQ ID NO: 3975 - protein, 56 aa, Artificial Sequence
  Synthetic sequence.
EDLVRDLERKNKRVIDESRRLLEELRRRYEELLREYRELLEDLRRKYKRIEDEAKR

SEQ ID NO: 3976 - protein, 61 aa, Artificial Sequence
  Synthetic sequence.
SEKEEIVKTVKTVIDRLEEEHRKILEDLRDDIRRADEYIKRSIDEVEEDLRRIEETVRRDG

SEQ ID NO: 3977 - protein, 56 aa, Artificial Sequence
  Synthetic sequence.
ERLVRELEKENEKLKRRSERMLEELEKEYRRLLKKYEDLLRELERKYEEIKDKLRK

SEQ ID NO: 3978 - protein, 61 aa, Artificial Sequence
  Synthetic sequence.
SEDEDIVRKAKEDIERLKREVEETIKRVEDDARKVEKEVRDIVERTRKEIKKLEDEVRERG

SEQ ID NO: 3979 - protein, 56 aa, Artificial Sequence
  Synthetic sequence.
EKLVEELRRELEKLKKEIDDLLRDLEKKYDDIRKKIRKLSEELKKLLEELKRKLDE

SEQ ID NO: 3980 - protein, 61 aa, Artificial Sequence
  Synthetic sequence.
SELEKIVEEVRRDIKRVRERVEEIIRKTDEMIRRLEEHIKRSIERVRKDAEDIERTVRRDG

SEQ ID NO: 3981 - protein, 56 aa, Artificial Sequence
  Synthetic sequence.
KDLLDELRRRYEELEERIRRLSRELEEKLKKLRKRYEDLLEELEREYRRIAEEARR

SEQ ID NO: 3982 - protein, 61 aa, Artificial Sequence
  Synthetic sequence.
SEEEKIVEEVKRDIKKVDDEVKDIIRRTDKAIKDLRREHKELIDRTRKAIEELEDEVRKRG

SEQ ID NO: 3983 - protein, 56 aa, Artificial Sequence
  Synthetic sequence.
EDLVDELRKLYDTIREKIKRLSDRLREKNEKLKKESDDLSRRLRKELEKLEREVRR

SEQ ID NO: 3984 - protein, 59 aa, Artificial Sequence
  Synthetic sequence.
SKEELLKEIRDELRKLKKKHDDLLEEIKREYDRLREKVRKDLEDIERKLRKLEEDVERK

SEQ ID NO: 3985 - protein, 59 aa, Artificial Sequence
  Synthetic sequence.
EEEVKRVVERVKELIKRLEDNIREAIRKLREDIKRLEEEVEKARKDVEDFLRELRKKVK

SEQ ID NO: 3986 - protein, 59 aa, Artificial Sequence
  Synthetic sequence.
SSDELAEELKREYDRNKEEHKKLLEELKKEYKRLLDEHRDLLRRIKERLDRLLRRIEEK

SEQ ID NO: 3987 - protein, 59 aa, Artificial Sequence
  Synthetic sequence.
EELVERVIRDVRKHIEDNTENIRRDIERVRKDIETLEENVKDAAKKVEDILKTLEDEVK

SEQ ID NO: 3988 - protein, 59 aa, Artificial Sequence
  Synthetic sequence.
DKERLAEELRRLYERNKREHEKLLKKIEDDLRKLEEDHERLLREIEEAAERLRREIERK

SEQ ID NO: 3989 - protein, 59 aa, Artificial Sequence
  Synthetic sequence.
EELVKRVVDRVRRHIEENTKNIEEAIKRVEDVIRELRKNIEEAIKRVREVLKRLKDEIK

SEQ ID NO: 3990 - protein, 59 aa, Artificial Sequence
  Synthetic sequence.
SEDELLDRLREKYERNKERHKRLLDELRKRYEDLKREHEKLLRDIEEELKKLEDKIRRK

SEQ ID NO: 3991 - protein, 59 aa, Artificial Sequence
  Synthetic sequence.
EDLVRKAIEDVDRHIKENTKNIEDTIRKVKKNIEDLKRNVEEAIKKVKEVLREIEERTR

SEQ ID NO: 3992 - protein, 59 aa, Artificial Sequence
  Synthetic sequence.
SKEELLKRLKERNERLNEDSERLAREIKRRLEELRKEHRRLLKEIEERLKELEEDIRRK

SEQ ID NO: 3993 - protein, 59 aa, Artificial Sequence
  Synthetic sequence.
EEDVKRVIRRWEELLKELEKDNRRVVKEAKELIDRLERNIRERIKEVRDALREIRKKVK

SEQ ID NO: 3994 - protein, 59 aa, Artificial Sequence
  Synthetic sequence.
STDEKLKELEKRNRDLNEESRKLAEEIRKRYEDLKKEHEDLLREIEKRLRDLMREVERK

SEQ ID NO: 3995 - protein, 59 aa, Artificial Sequence
  Synthetic sequence.
EKSVDDVIRRWEELLEELRRRNEEAVRRMERNIDELRRNVRETIDRVRKLLEEIKRKVD

SEQ ID NO: 3996 - protein, 60 aa, Artificial Sequence
  Synthetic sequence.
SEAERVVEELERLLKKNRDDNERVIRRLEELLDRLREKNERAIEELRKLLDELKKVVDRG

SEQ ID NO: 3997 - protein, 56 aa, Artificial Sequence
  Synthetic sequence.
RELLREIEERLKTLSEESKRLIDRIREELKRLTKESEDLLKDIERLLREVKERART

SEQ ID NO: 3998 - protein, 60 aa, Artificial Sequence
  Synthetic sequence.
DEMEDLRRDVERIHEESRKLSEDSVRTAEKIHRESEKLIDDLRRKVEKILKEVEDVVRRG

SEQ ID NO: 3999 - protein, 56 aa, Artificial Sequence
  Synthetic sequence.
EEELKKLEDRSRKLLEENKRLNEDLDRRSEELKARLKDILRRIDERLRDLEREADR

SEQ ID NO: 4000 - protein, 60 aa, Artificial Sequence
  Synthetic sequence.
DEVEELKRRAEEILRKYDEDSKRIVEEAERIVRTSAEKIERLRKKAEDILREASKVVDDG

SEQ ID NO: 4001 - protein, 56 aa, Artificial Sequence
  Synthetic sequence.
ERDLEKIETDVERLERKSKKLLEDLREKSERLKKRLEDILKRIKEEVERLKRKVEK

SEQ ID NO: 4002 - protein, 59 aa, Artificial Sequence
  Synthetic sequence.
DEMEELKKEVEEILKEYEKRSRDLFKELKEILRRSKELSEDSKREADKILRDAEKVVAD

SEQ ID NO: 4003 - protein, 56 aa, Artificial Sequence
  Synthetic sequence.
EDDLRRIEEKVKKLEKESRELLKRIKDESEELKRDNKRLNDEVREELEKLKERVRK

SEQ ID NO: 4004 - protein, 60 aa, Artificial Sequence
  Synthetic sequence.
DEMDELRREVKEILKTTEELIKRLEDKVRDILRRYKEVSDDIVRKAEDILRKAEDILRRG

SEQ ID NO: 4005 - protein, 56 aa, Artificial Sequence
  Synthetic sequence.
ERELEEIKKESEDLERRLKKVLERIEREVRRLEEETKELLKRIAEEVERLIREAEK

SEQ ID NO: 4006 - protein, 60 aa, Artificial Sequence
  Synthetic sequence.
KEAEDLVREVERILEDYDRVVKELKDDADRILEESRRLIEELKKKAEDILRRVRKVVEDG

SEQ ID NO: 4007 - protein, 56 aa, Artificial Sequence
  Synthetic sequence.
EELLERIKDRLRKLHEKSKKLLTDIKRESRRLEKRLEDILKRIKEEADKLKEEADR

SEQ ID NO: 4008 - protein, 59 aa, Artificial Sequence
  Synthetic sequence.
REEELERRVREESEELNRRLAEVHKRLRKKSKELNDRHKELDDRIRREADRLRKDIRRQ

SEQ ID NO: 4009 - protein, 55 aa, Artificial Sequence
  Synthetic sequence.
DEVLKELKEMHDRLREHVKRDSERAERMHEELKRLSDELERRVREALKRLKEKVR

SEQ ID NO: 4010 - protein, 59 aa, Artificial Sequence
  Synthetic sequence.
KKEEVRKRIEEELRRLKKDHRRLDEEIKRKLKKLDEEIKEVHERLKKAARDLEDEARRN

SEQ ID NO: 4011 - protein, 55 aa, Artificial Sequence
  Synthetic sequence.
KEVEKDVEDLLKELEDDSRRLEEEVERLIERVKRHVERDERRVREMLREIKEKIK

SEQ ID NO: 4012 - protein, 59 aa, Artificial Sequence
  Synthetic sequence.
SKEDLDRELRRLSEELNREHKELDERIRRELEKLRTRIDKVHEDIRREMKRLEDEVRKR

SEQ ID NO: 4013 - protein, 55 aa, Artificial Sequence
  Synthetic sequence.
EEVFEDAERLHRELKKKSRDLEERVKKLLEEIEDHVRRDETRVRKVLRDIEEDIR

SEQ ID NO: 4014 - protein, 59 aa, Artificial Sequence
  Synthetic sequence.
SKEDMLREAEERSRRLNEDHKRLDDELRKESEKLNRRHRDLDEKIDRELRRLKKDIRRR

SEQ ID NO: 4015 - protein, 55 aa, Artificial Sequence
  Synthetic sequence.
RELLERLRKVHEDLKKKSEDLKRTAEKLHRELEKESRDLVRDVERALDELRRKVE

SEQ ID NO: 4016 - protein, 60 aa, Artificial Sequence
  Synthetic sequence.
SSEELLRDIERRLEEMNRDTERVVEEIRRRLEELRKRHKETIDKIREELKKVEDLVRRRG

SEQ ID NO: 4017 - protein, 55 aa, Artificial Sequence
  Synthetic sequence.
EDVLRRAKRLIEKYKEDTKRIKEKLEKVIEDLRKNIEDFEEDVRRVLEELKKRIK

SEQ ID NO: 4018 - protein, 60 aa, Artificial Sequence
  Synthetic sequence.
SSRELLERIKEELKELEDRHRDLLRRIEEKLERLNRRTREVLERIKRKLDELKKRVEEAG

SEQ ID NO: 4019 - protein, 55 aa, Artificial Sequence
  Synthetic sequence.
EDLLREVKELIERLRENIKRAKDKVEELIKKYKRDTDEAKKEVDEEIKRLKEEVD

SEQ ID NO: 4020 - protein, 60 aa, Artificial Sequence
  Synthetic sequence.
DSERLVREIRERLKKLEKEHRELLEEIKDRLRRLNEESKKLLDDIKRRLEELRDRIRRAG

SEQ ID NO: 4021 - protein, 55 aa, Artificial Sequence
  Synthetic sequence.
EDVLRDLEKLIEDLKRNIERARAKVEKLIKEYEDKLEKIVRDAEELIKDLDRKVK

SEQ ID NO: 4022 - protein, 59 aa, Artificial Sequence
  Synthetic sequence.
SSEEILRKIEEELERLEREVRKIHRDNERKSEELNRRSKKILDDIRRELDRLKKEAEEK

SEQ ID NO: 4023 - protein, 55 aa, Artificial Sequence
  Synthetic sequence.
KEVVKEMRRALEEIKKEIEKVRKELEKRNREYRKRSEEVREEAERKLEEIKRRTD

SEQ ID NO: 4024 - protein, 59 aa, Artificial Sequence
  Synthetic sequence.
RSEEILREIRDRLRKLNEESEKVHEENERRSRELNERSREILKRIDEELKRLKKEVDDK

SEQ ID NO: 4025 - protein, 53 aa, Artificial Sequence
  Synthetic sequence.
VVRDLKKKLERYKRETDRVRKELRDLNKKYEDRSREIKRELERLLRDIKRRID

SEQ ID NO: 4026 - protein, 59 aa, Artificial Sequence
  Synthetic sequence.
SLEEVIKTVRKLLEEVERRLREVVERAERMLEEVRRRTREVSEEAREMLKDVEKALRDK

SEQ ID NO: 4027 - protein, 59 aa, Artificial Sequence
  Synthetic sequence.
DRIVEKLLRDAERIVKRLRELIEKLREEVEKIVDENRKTVEELRRRNEEIVRRLRREIE

SEQ ID NO: 4028 - protein, 60 aa, Artificial Sequence
  Synthetic sequence.
DVKEVLDDAERKLREVLKLIEDSLKKLKELSDEVIERIARSLEKLEKLIRDVDEELKRKV

SEQ ID NO: 4029 - protein, 59 aa, Artificial Sequence
  Synthetic sequence.
KEVVKEIKERVDKVVDEARKLVEESERSIRELVERSKKVVEESERSIEELRRELKETVK

SEQ ID NO: 4030 - protein, 60 aa, Artificial Sequence
  Synthetic sequence.
DLEEVRERARRLLRKLEEDLERVHKEMEELLRELEERIKASLERLDELLKRLADKLRRDV

SEQ ID NO: 4031 - protein, 59 aa, Artificial Sequence
  Synthetic sequence.
KEVVKEIEDRVRKVAEKVREVIERNRKLVRDVLDKIRRMLKESERSVEEVLKRLDDELK

SEQ ID NO: 4032 - protein, 60 aa, Artificial Sequence
  Synthetic sequence.
SLDEVVKRLEDLLREVEEKSKESSKRMEDLNREVNERLRRSSERLKRLNDEVKKRLEDAG

SEQ ID NO: 4033 - protein, 56 aa, Artificial Sequence
  Synthetic sequence.
VEEIKKLADKVVTELEKLVEDDRRLAEESFERARKIVEEDERLARESVDRARRLVD

SEQ ID NO: 4034 - protein, 59 aa, Artificial Sequence
  Synthetic sequence.
KLDEVIEEIRKLLRRMEEELRRSVEEIDKLLREVRELLRESSEKVKELLRRVTEELKKR

SEQ ID NO: 4035 - protein, 58 aa, Artificial Sequence
  Synthetic sequence.
KLVEDLKRRAEEVIRELREIVKRNTEIAREVVERAKRIVEKNEKLLKDVVEEAKKIVK

SEQ ID NO: 4036 - protein, 56 aa, Artificial Sequence
  Synthetic sequence.
SELEKAKEDVDRLLEDVNRVSEEVEDRVRKLLADSDRVLEEVERRVREVLKRLKDA

SEQ ID NO: 4037 - protein, 56 aa, Artificial Sequence
  Synthetic sequence.
VKTVADELRKVVKELLEINRRSLEELTKLVDESRRVNEKVMEELKKLVDDLRRRIE

SEQ ID NO: 4038 - protein, 58 aa, Artificial Sequence
  Synthetic sequence.
SEIEKVKEVVREVIERSRKLLKEVRDTVEKVIDESRKLSDTVRRRVEDAIRDVLERRG

SEQ ID NO: 4039 - protein, 59 aa, Artificial Sequence
  Synthetic sequence.
REEVKKVIEDLTREAKRSLERNREVVKELKKLADDLKDLNKKSVDRLDDLVRRLKERTE

SEQ ID NO: 4040 - protein, 60 aa, Artificial Sequence
  Synthetic sequence.
KRAEDVLEKLREDAKRVLKRNRDSVKEAEDLVRKSLRTSEEVVKTLRTELKKLLDELDRV

SEQ ID NO: 4041 - protein, 59 aa, Artificial Sequence
  Synthetic sequence.
EKVLRDIEREVRKIIKELEDMDDELRRILEEVIERSRRVNERLKELLKEADDRLREKLR

SEQ ID NO: 4042 - protein, 59 aa, Artificial Sequence
  Synthetic sequence.
DAAEELLRLVEDVARELKRLVDELLKENRETVERLKKVVKRSEEINREVVRTLRELVAN

SEQ ID NO: 4043 - protein, 58 aa, Artificial Sequence
  Synthetic sequence.
EKIKEVRRSIEEARRRVEEALREVNEASKEAERTVREALKRSREAVEKAVRDVTEAAR

SEQ ID NO: 4044 - protein, 56 aa, Artificial Sequence
  Synthetic sequence.
KELEDVLRESEKTAEELLRRVKKSIDRTRDVVRRLLEEIRKSIEETKRVADEAKRE

SEQ ID NO: 4045 - protein, 58 aa, Artificial Sequence
  Synthetic sequence.
DLVRRLERISEEVRRRVEKLVREDRKILEDVARALRELVKEDEEILRRVVKDLRDKTR

SEQ ID NO: 4046 - protein, 59 aa, Artificial Sequence
  Synthetic sequence.
DEDKKVVRKVERIIKRVKELHDKSVRDSEEVVREVLKRHKESVEKIKEIVRRIVEIAAR

SEQ ID NO: 4047 - protein, 55 aa, Artificial Sequence
  Synthetic sequence.
EELKEVIRRVEKLSEDVKRENEKSNDEVRKLSEDAIRENEEVLRRARKLVDDLRR

SEQ ID NO: 4048 - protein, 59 aa, Artificial Sequence
  Synthetic sequence.
DEEKEVVKKLRDIIREVERLHTESVRKVEEIVRRVLRLHKETVRELKEIVKRIVDIARN

SEQ ID NO: 4049 - protein, 55 aa, Artificial Sequence
  Synthetic sequence.
RELEKVAKEVEDRSKELLDRNEEVLDRVRKLSEDVLRENREVIERVREEVKKESK

SEQ ID NO: 4050 - protein, 59 aa, Artificial Sequence
  Synthetic sequence.
SEADKVVAELEKIVKDVVDAHKDSVRKLREIVRRAVERLRKDVDDTRRVVKEIVDIARS

SEQ ID NO: 4051 - protein, 59 aa, Artificial Sequence
  Synthetic sequence.
ERVRRKLEEVVKKVRDLSRRATEEVEEVIKEVRELVRRLKEENKRVVDEVRKRVEDTRK

SEQ ID NO: 4052 - protein, 60 aa, Artificial Sequence
  Synthetic sequence.
KSMEDVVRKLDELVKTDKEIADRVVKELKDIVKRVEELVEDIVTKSRASVERVRDVVTRG

SEQ ID NO: 4053 - protein, 59 aa, Artificial Sequence
  Synthetic sequence.
REAKELLDRLKRRLEKSTEEVKKKLETVLRELEEVIKRVKEELERVNRELRKVIEDAKK

SEQ ID NO: 4054 - protein, 59 aa, Artificial Sequence
  Synthetic sequence.
ELEKLIRDVVRENEESAKEAHRRIKEVVRTSEDLVREVRERVRRIVESSKRVVEEVRKK

SEQ ID NO: 4055 - protein, 56 aa, Artificial Sequence
  Synthetic sequence.
MEKLLRDLKKLIEDNERVVRELKKNLDDDSERVKRVADELLKNLKKDTKKVKDTAK

SEQ ID NO: 4056 - protein, 59 aa, Artificial Sequence
  Synthetic sequence.
DEAEDVVKRADDIVKRNRELLERVVRDLERIVRKNKDIVRKVVDEAKKLVKTVEDLSRQ

SEQ ID NO: 4057 - protein, 59 aa, Artificial Sequence
  Synthetic sequence.
KEVEDLLRRVEEKLRKSVKEVEELLDTVRRRLEDSSRDVKRLLKEVLDRLEDVLDKEEK

SEQ ID NO: 4058 - protein, 59 aa, Artificial Sequence
  Synthetic sequence.
SAVEEADKEVRRILKKNTDLVRRVVEEAKKILDRNEKRVREVFKELTRLLDELRKLIEE

SEQ ID NO: 4059 - protein, 59 aa, Artificial Sequence
  Synthetic sequence.
EEVERLLRELERRLEDSVRKARELLKDIERRLRESIKRSEELLRDVERRLKELEERLEE

SEQ ID NO: 4060 - protein, 60 aa, Artificial Sequence
  Synthetic sequence.
DVEEELKRVVEKLRDVERKVRELNKRVTDKNEDVVRTVRELNERVTRENRRVVEDIDRKK

SEQ ID NO: 4061 - protein, 56 aa, Artificial Sequence
  Synthetic sequence.
LDDVLRRLEELVKDLERLIEESVRYLERNVERSRELVERSLRYLKENVDRSRKLAE

SEQ ID NO: 4062 - protein, 59 aa, Artificial Sequence
  Synthetic sequence.
DEVREVVERARKLVKDNLDAARKAVKRLRELVKENLDTVRDVVRKLRKLVEDLKRLIRS

SEQ ID NO: 4063 - protein, 56 aa, Artificial Sequence
  Synthetic sequence.
KELADEVRELAKRSHEELKRLLDEVRKLLKDSERALRKLLEDVRREADKVAEEVRT

SEQ ID NO: 4064 - protein, 59 aa, Artificial Sequence
  Synthetic sequence.
SEVDEVVRRARELVKKNRDDVKKVVEDLRRIVKEDLDTARRVVKRLRELVEELKELIRS

SEQ ID NO: 4065 - protein, 56 aa, Artificial Sequence
  Synthetic sequence.
KELADEVDELMKDSDRELKRLLEEVRKLAKRSTDELERLIEEVRKELEDVLDEARQ

SEQ ID NO: 4066 - protein, 59 aa, Artificial Sequence
  Synthetic sequence.
SREEELLERLRRVVERNKKLVDDLADRADKVVKENEKLVRDLLEESRKTSEILDRLVKN

SEQ ID NO: 4067 - protein, 54 aa, Artificial Sequence
  Synthetic sequence.
LVEEVRRLSEKSNRDLKELVKDIERKLDKVHKDLEKVIEEVERSNERVKEEVKT

SEQ ID NO: 4068 - protein, 60 aa, Artificial Sequence
  Synthetic sequence.
SDAERIVEEAKRLVEENTELVERVLEKLERLVRENRTLVERVIEELDDLVRRIEDVVRRG

SEQ ID NO: 4069 - protein, 59 aa, Artificial Sequence
  Synthetic sequence.
KKLEKLLREVERLMEESHKRLKEVADTARRLMDDSERELDRLLREAEKKIRDVREEIRR

SEQ ID NO: 4070 - protein, 59 aa, Artificial Sequence
  Synthetic sequence.
SLVDEILKDLDRLVEENEKLVKKIVEDAEELVKRNTDLVEEVLRELKEIVETIRDLVRR

SEQ ID NO: 4071 - protein, 59 aa, Artificial Sequence
  Synthetic sequence.
EELKDVLRRVEEKIRKSNEKLEKLLEEVSRLAKRSDERLKKVLEDIKEEIRKVKEDLER

SEQ ID NO: 4072 - protein, 59 aa, Artificial Sequence
  Synthetic sequence.
SLEEVVKKAEDLLKRVNDELKKVSKKVRDDLRRVNEKLKTVVEDVLRKLEAVVDKIRKS

SEQ ID NO: 4073 - protein, 56 aa, Artificial Sequence
  Synthetic sequence.
VKDVDKRIRDVVRRHEEVVETNARRVDEVVKRHDKLVKDLERRVEKVVRELEEKVR

SEQ ID NO: 4074 - protein, 59 aa, Artificial Sequence
  Synthetic sequence.
SLDEIVKRAEEELKRLNEELKRVSDRVKERLDRVLDELRRISERIKELLERVKRKLERE

SEQ ID NO: 4075 - protein, 56 aa, Artificial Sequence
  Synthetic sequence.
AEDLRREVEEIIRRHKEVIRKNEEDVKRVLDTLREMLKKNKKLVDDMVRKLDETIK

SEQ ID NO: 4076 - protein, 55 aa, Artificial Sequence
  Synthetic sequence.
SEAEKVLEKVERVAREVLERIKRIVEHTKRVVEDVIRRADESVRRSEEIMEDVRR

SEQ ID NO: 4077 - protein, 56 aa, Artificial Sequence
  Synthetic sequence.
KEDVERLVRTVKEELDRLVDESRKLSRDVRETLEELVKRSEDVTRRVEETLREIVK

SEQ ID NO: 4078 - protein, 56 aa, Artificial Sequence
  Synthetic sequence.
DELERILEEVKKVVEEVVRRAEESVKKTEDVMRKVVERVARSLEESRRVAEEVERR

SEQ ID NO: 4079 - protein, 56 aa, Artificial Sequence
  Synthetic sequence.
EKDVKRLVDEVRKELEELVRRSEELTKEVKKTLEELVKESKEVVKDVEKKLREIEK

SEQ ID NO: 4080 - protein, 57 aa, Artificial Sequence
  Synthetic sequence.
REVDEAVKNNEEDAKESRRVVEEAVKRDEDIARDIERRAREVVERDKEIVDEVRRRV

SEQ ID NO: 4081 - protein, 60 aa, Artificial Sequence
  Synthetic sequence.
SKEVKDLLDENSKRSNEISREVKKDLERTVRENKKIVDEVRKKLEDTVDKNRRIVEEVTT

SEQ ID NO: 4082 - protein, 57 aa, Artificial Sequence
  Synthetic sequence.
SEVDKMLKRSNDIVREIARVVEEAVKTDERIMREILEHARKVVEEDKEIVDRVRKEV

SEQ ID NO: 4083 - protein, 60 aa, Artificial Sequence
  Synthetic sequence.
SEEVVRRLRTLVEENRKIVEDVKRELERTVRDNRRIVEEVAKRNHDTVRENKEIVDRVKT

SEQ ID NO: 4084 - protein, 57 aa, Artificial Sequence
  Synthetic sequence.
KEAEDVIELVRRILEEVDRRVRDVLRKDEESLRRVKKTVEEVLKRHKDIEDEVRRRV

SEQ ID NO: 4085 - protein, 60 aa, Artificial Sequence
  Synthetic sequence.
SEEVKRVLEEIVKKVEEIVKDVERKLRKTVEENEEVVRRVKRYLEKSVEDLEKVVRDVTT

SEQ ID NO: 4086 - protein, 56 aa, Artificial Sequence
  Synthetic sequence.
SAEDILREVEELVRRTRKHLEDSLREVTKLVEETKREADRILKEVRDRVKEVIERG

SEQ ID NO: 4087 - protein, 59 aa, Artificial Sequence
  Synthetic sequence.
EEVLKTVREELRDIIRRSVEHNRDSLRRLREIIERSLRHVEEVLERVRKEIERIKRETK

SEQ ID NO: 4088 - protein, 56 aa, Artificial Sequence
  Synthetic sequence.
SAEDILREIKRLVEETERLLKRILEEVRKLVEETRRRLETILRRVEEKVRRLVEKG

SEQ ID NO: 4089 - protein, 59 aa, Artificial Sequence
  Synthetic sequence.
EETLKRALDEARKIIEESKKHVKDVLRKVTDEIRESKKDVERVEDEVDKRIREVDERTK

SEQ ID NO: 4090 - protein, 60 aa, Artificial Sequence
  Synthetic sequence.
SIDEVAEEVERLLEEVKETSREVLERVKRELEKIIDTSRRILEEVRRLLERVLEEVERRK

SEQ ID NO: 4091 - protein, 59 aa, Artificial Sequence
  Synthetic sequence.
DRDVKRVLDKVRKKIEENKDTVRRVEEEIKKLIEDNKRTSEKVRKEVTDIIEEIKEEIK

SEQ ID NO: 4092 - protein, 56 aa, Artificial Sequence
  Synthetic sequence.
DVEDVVREAEDLLRKLEEKSRKVVEDAKRLLDEVKRKMEESVKEAKRLLDEVLRKS

SEQ ID NO: 4093 - protein, 59 aa, Artificial Sequence
  Synthetic sequence.
KKIVEEVRRRVEEVVRRDEKSVEDLKREVDRVITELDRLVKRNTEEVERVIRRLDEETR

SEQ ID NO: 4094 - protein, 60 aa, Artificial Sequence
  Synthetic sequence.
SEEEDAERLLRDLKRRADEVVKESEKILEDIVRDAERVLRESKRISEEIVRRADEIRRKV

SEQ ID NO: 4095 - protein, 55 aa, Artificial Sequence
  Synthetic sequence.
RLVEELRRLVEEVRERLDRSVKKTKELLKEVIKELEKLLKKDEDDVERVIRRLED

SEQ ID NO: 4096 - protein, 60 aa, Artificial Sequence
  Synthetic sequence.
SEVEDILRRVEKRARDSLKHLEDVLRKVDKRVRESLDNLRRVLEEVERIVRELERLLDEG

SEQ ID NO: 4097 - protein, 59 aa, Artificial Sequence
  Synthetic sequence.
ERLLEEIVRRLEDSLRKVEEIARRIEKRLRDSLRETKRIADEIRKRLEDALRRVEERAR

SEQ ID NO: 4098 - protein, 60 aa, Artificial Sequence
  Synthetic sequence.
SDVEKILDDVRKDAERSLENLKEVLEKVEEEVRRSLEDLRKVLEDVERIARKLEELLKEG

SEQ ID NO: 4099 - protein, 59 aa, Artificial Sequence
  Synthetic sequence.
EELLRRIERTLRESLEAVKRIAEEIERTLEESLREVERIVKEMEDLVRAALKRVEDKAR

SEQ ID NO: 4100 - protein, 60 aa, Artificial Sequence
  Synthetic sequence.
SEVEEILRRIKEEVRESLEDLRRVLEEIEKKAKESLRELKEVLERVKEIADKLKRLLDEG

SEQ ID NO: 4101 - protein, 59 aa, Artificial Sequence
  Synthetic sequence.
EKLLRDIKRDLERSLEAVDKIVKEIMERIKESLKATERIVKEMKDLITRVREEVKRRAE

SEQ ID NO: 4102 - protein, 56 aa, Artificial Sequence
  Synthetic sequence.
DEVEELKERAKRSNEELKRKVEELKKRAKKAIDDVRRVVDENKKLVKEAIDRLRKT

SEQ ID NO: 4103 - protein, 59 aa, Artificial Sequence
  Synthetic sequence.
KETLKKLLEELKKLVDESRRRLDELRKEVEKKVEEMLERARRLLKKTEDLVREVKRRVD

SEQ ID NO: 4104 - protein, 55 aa, Artificial Sequence
  Synthetic sequence.
DELKELEDRLRRAEEEARRLLEEIKKRLKESNEELKRLVEENEKLVKEALRRLEN

SEQ ID NO: 4105 - protein, 59 aa, Artificial Sequence
  Synthetic sequence.
KDVLRKLLEEVERLVKRVLDELRALLKEVEDLVRKSVEDLRKLLEETRKLVREMEERVR

SEQ ID NO: 4106 - protein, 55 aa, Artificial Sequence
  Synthetic sequence.
SLVEKLEKRLRDVIKTIEDIIRENEERLRRSNRELEKLVDENRKLVEEVLKRLAD

SEQ ID NO: 4107 - protein, 59 aa, Artificial Sequence
  Synthetic sequence.
ERVLEKLLREVEELAKRVLTELRRLLRETERLVRESEKRLRDLLRDTERLAREVEKRVE

SEQ ID NO: 4108 - protein, 55 aa, Artificial Sequence
  Synthetic sequence.
SLVEDLKRELEKAKEEIEKIVRDLERELDRVIKENERLIRENEDTVRKALERLRR

SEQ ID NO: 4109 - protein, 59 aa, Artificial Sequence
  Synthetic sequence.
EDVLRELKDRVRRIVEEVARRLEELLKKVKDLVKKSLKTNEDLLRKTEELVRRAEERVK

SEQ ID NO: 4110 - protein, 60 aa, Artificial Sequence
  Synthetic sequence.
SEVEEVLKRLKELVDTVLEELKDVIRRIEELLERVRRDNERTIREDEELVRKVLDELRKI

SEQ ID NO: 4111 - protein, 56 aa, Artificial Sequence
  Synthetic sequence.
AEEIERVIREAERRLKKLLDELRRLVEEVRRELEELDERLKRSSEEAKKRLDELVK

SEQ ID NO: 4112 - protein, 60 aa, Artificial Sequence
  Synthetic sequence.
SEVERVLEDLRRLVRDVEEKLRRIIERDRRLVEEVERENRKTIRKIEELLRKVLEELKDI

SEQ ID NO: 4113 - protein, 56 aa, Artificial Sequence
  Synthetic sequence.
AERIEDVVREAEKRLRELLKELEKTSRDLKKRLEELDRELKALVEKVERDLEELRK

SEQ ID NO: 4114 - protein, 60 aa, Artificial Sequence
  Synthetic sequence.
SEAEELLRRLKELVDEVLKRLRDMIKRSEDLARDVLRKHEDLIRKLEELMKKVEDLADKI

SEQ ID NO: 4115 - protein, 59 aa, Artificial Sequence
  Synthetic sequence.
EEVVREIERIVREVTERLRRLVEENAEVVKRVEKELKELNDELRRVVEEIVRKAKEKTK

SEQ ID NO: 4116 - protein, 60 aa, Artificial Sequence
  Synthetic sequence.
SEAEELLKRLEDRAEEILRRLEEILRTSRKLAEDVLRELEKLLRESERRIREVLEELRRI

SEQ ID NO: 4117 - protein, 59 aa, Artificial Sequence
  Synthetic sequence.
KEVVDEIKRIVDEVRERLKRIVDENRKIVEDARRKLEKIVKENEEILRRLKKELRELRK

SEQ ID NO: 4118 - protein, 60 aa, Artificial Sequence
  Synthetic sequence.
DMRKELEKRVEEIRRAVTELVKRNEDIVREVKKRVEELVKRNEDITKKAEDDIRDLVRKR

SEQ ID NO: 4119 - protein, 59 aa, Artificial Sequence
  Synthetic sequence.
EEKLRRLLERLEDIARRVLKYLEEDLRETEKLAKEVLDRARKILEETKELVKDVLEKAR

SEQ ID NO: 4120 - protein, 60 aa, Artificial Sequence
  Synthetic sequence.
DMDEELRRVVKEIEDELRRLVEENRDVVRKVEKLNRDLLKRNEDITDEARKRVEDLVRKR

SEQ ID NO: 4121 - protein, 59 aa, Artificial Sequence
  Synthetic sequence.
REKLEKLIRRLREIAKEMLEYAKRDIERTKELAKRSLERHKESLDRTEKLVKEVLDKAR

SEQ ID NO: 4122 - protein, 60 aa, Artificial Sequence
  Synthetic sequence.
DMVRDLERIVEKIKEDIKELVKRNREVTEKVVRDVEELVKTNREVVREATRRVEKLVEEE

SEQ ID NO: 4123 - protein, 59 aa, Artificial Sequence
  Synthetic sequence.
EDTLRKLLKTLRELARRVLEEARKIIERSKELAERVLRYLKRDIEESKKIVKEIEDRAR

SEQ ID NO: 4124 - protein, 60 aa, Artificial Sequence
  Synthetic sequence.
DMERELDDVVRKAEEDNRRLLKENEDIVREVVDRNARLLEENRRVVEEAVRRVEDMLRRR

SEQ ID NO: 4125 - protein, 59 aa, Artificial Sequence
  Synthetic sequence.
ERKLRKLIDDLRKLVRESLEYNKDDLEKTKELARRSLKYNKEDIDRSREIVRDVRRKAQ

SEQ ID NO: 4126 - protein, 60 aa, Artificial Sequence
  Synthetic sequence.
SVIEALEEIAEKIERDVRKLVEENREVVKEAEKRVEEILRTNSKRSEEVRREVEDLVRKD

SEQ ID NO: 4127 - protein, 59 aa, Artificial Sequence
  Synthetic sequence.
ERVLEELLRRLEEIAKRALEYLTRDIEETKRLVEEVLKRLKEILDKTDDLAREVLERAR

SEQ ID NO: 4128 - protein, 60 aa, Artificial Sequence
  Synthetic sequence.
SEVEKIEEDLKRLVKRLREINEESKKRLEELIRTAEEINKKTTDELERLAEEVDRLVKRV

SEQ ID NO: 4129 - protein, 59 aa, Artificial Sequence
  Synthetic sequence.
REAVDRLRRVVDEIRKEARKLNEEIRKRVEDVVRKLDKMDEDLRKRVEEIERKVREATR

SEQ ID NO: 4130 - protein, 60 aa, Artificial Sequence
  Synthetic sequence.
SEVEEILERLRRLVKEVDKRNTDSLDTLKRLIDELERKNRDSLRRVDELAKELEKLARRV

SEQ ID NO: 4131 - protein, 59 aa, Artificial Sequence
  Synthetic sequence.
KDAVTELEKDVREIKKRLDEMDKRLKDVVDEVRRRAEEVNRRIERLVREIEKRAREEVR

SEQ ID NO: 4132 - protein, 60 aa, Artificial Sequence
  Synthetic sequence.
SEAEEVLERLKRLRETVKEENDDSLRKDRELVDRLEKDNRDSLRKLKELIERVREILKRV

SEQ ID NO: 4133 - protein, 59 aa, Artificial Sequence
  Synthetic sequence.
KDVVETVKRVVEEIEKELEEANRRLEKSSREVEDRIRKANKRLEEVVDEVREEVDKATR

SEQ ID NO: 4134 - protein, 60 aa, Artificial Sequence
  Synthetic sequence.
DEVREVLTRLEELVRRVTKELEDSLRNTERVRRTIRKLAEEVNRDSKRLKDEVKKVLEKI

SEQ ID NO: 4135 - protein, 59 aa, Artificial Sequence
  Synthetic sequence.
EEAVETLKRKVEEIERRLKRMVEEDRKTIEEIEEEVRRLVKTNREIIKEIVETLREAVR

SEQ ID NO: 4136 - protein, 60 aa, Artificial Sequence
  Synthetic sequence.
KEVEEVRTRLKKLRDDVKRLLDEVNEESKRLAEEVRRRLEESNRNTERVVEEIERVIERI

SEQ ID NO: 4137 - protein, 59 aa, Artificial Sequence
  Synthetic sequence.
DKVVDEVRRRVEEAEREVKDMVRTNNEIVRRIVEEARRLVDEDRDRIKKIEERLRRELQ

SEQ ID NO: 4138 - protein, 60 aa, Artificial Sequence
  Synthetic sequence.
SEAEEVLREVDELAKRLERVATESLKNTKKVVDDVRREVKRVNERSEEIMRRIEDVLRKI

SEQ ID NO: 4139 - protein, 59 aa, Artificial Sequence
  Synthetic sequence.
EELIREIERIVREIDKRARELVERDNREVERIVEELKELVKTNNDIVRRVVEKLKETVR

SEQ ID NO: 4140 - protein, 58 aa, Artificial Sequence
  Synthetic sequence.
SEAEKILEDLKRIVRRIKEELRRVLDHTRELVERIRRLAKKILDDTEKIVRDIRDKAE

SEQ ID NO: 4141 - protein, 59 aa, Artificial Sequence
  Synthetic sequence.
EDVVRELKREVERIKREVKKMVDDNRRTVEKIKRDAEKMVRDNEELSRRIEKDVDDKTK

SEQ ID NO: 4142 - protein, 58 aa, Artificial Sequence
  Synthetic sequence.
SEAEKIEERLKRVVEKLRRDATRVRKHTDDLVKEITDLAEESKRRVEEIRERVKRLRE

SEQ ID NO: 4143 - protein, 59 aa, Artificial Sequence
  Synthetic sequence.
EKVVKRLEDEVKRIKDEAKEMVDENKRKVDEIRKELRRLVEENRRESEKIKKKLDEDLK

SEQ ID NO: 4144 - protein, 58 aa, Artificial Sequence
  Synthetic sequence.
DEIREILRRIREVVADATRRAKESLDNLKRVVEEVDRRVKESLDRLKEIVDRVRELSK

SEQ ID NO: 4145 - protein, 59 aa, Artificial Sequence
  Synthetic sequence.
KDVVKRVEDEVRDIRRVLEEMVRRDKKVVDEIRERLKEAVRRNEEVSRKIKKDLKDETK

SEQ ID NO: 4146 - protein, 57 aa, Artificial Sequence
  Synthetic sequence.
SMEERLREVVTEIRKKVEKLLRDNRKSNKEIKETVDDLVRRNRELTERAKRRVDARG

SEQ ID NO: 4147 - protein, 59 aa, Artificial Sequence
  Synthetic sequence.
EREAEELLRELADVVRRAEELAERSLRESEKVMEDITREAERILRDTKRLIEEIERRAR

SEQ ID NO: 4148 - protein, 57 aa, Artificial Sequence
  Synthetic sequence.
SLREDLEKDVRDIVREIDEAVERNRRSVEEVDKRVEDMLKNNRDSNKKIEEDVRRAG

SEQ ID NO: 4149 - protein, 59 aa, Artificial Sequence
  Synthetic sequence.
EEDAKRLKDELREVVDKIRRDLKKSNDDIRRLVEKIKRELEELNKRSRELVERARETVR

SEQ ID NO: 4150 - protein, 57 aa, Artificial Sequence
  Synthetic sequence.
SLEETIEEKVRRIREEVRRMLENNRRINEEVDRRVTEMVERNRKTVEEVVREVDRDG

SEQ ID NO: 4151 - protein, 59 aa, Artificial Sequence
  Synthetic sequence.
EEDAKRLLEEVEDIVRRLRKELEDSNRKSRKLVEEIRKRAEESNRELRELIKRIKDRAR

SEQ ID NO: 4152 - protein, 56 aa, Artificial Sequence
  Synthetic sequence.
DVLERLAEVVRRVVKEAEDLVRNNRRLNKEVEDEVDELVRNNRRLTKDVVKKVEDA

SEQ ID NO: 4153 - protein, 59 aa, Artificial Sequence
  Synthetic sequence.
KEEVKRLEDELRKVVDKVRKDMKRSNDDSERLREDITRKAKRLNEETRKVMEDVTRRAT

SEQ ID NO: 4154 - protein, 60 aa, Artificial Sequence
  Synthetic sequence.
KEAEELIREIERKAEEVRKENERSIRENERLAREVEKRLKRTNEELKRLVRELEEKLKRD

SEQ ID NO: 4155 - protein, 59 aa, Artificial Sequence
  Synthetic sequence.
EELIRRLEEVVKRIREDLKKLDDDLKRSVEEIERRLKKVIEDNRETLERARRRLDERVK

SEQ ID NO: 4156 - protein, 60 aa, Artificial Sequence
  Synthetic sequence.
DEAEEILEELRRLIEEDKKTVEEVLRRDEETIKRLEEENREALKDNRRLIEELEDIVRRI

SEQ ID NO: 4157 - protein, 59 aa, Artificial Sequence
  Synthetic sequence.
EKVREKVERILDDLRRVVEETVKRAEDLLRKSREVVKRVDEELKESHDRLDERIKRDLK

SEQ ID NO: 4158 - protein, 60 aa, Artificial Sequence
  Synthetic sequence.
DEAREILKTLKDLIKELEDRNREVLERDKKTIEDLERRNARVLEENKKLIDEIRRIAKDI

SEQ ID NO: 4159 - protein, 59 aa, Artificial Sequence
  Synthetic sequence.
RSVEEALKKILRELEKKVEEVDRRLKRILEDSRRVVRRVDEEARKSHEELKRELDRIRK

SEQ ID NO: 4160 - protein, 60 aa, Artificial Sequence
  Synthetic sequence.
KEAEDLLRKLRELIKKLDDTNRRVLERDRKTIEELERRAEKILTDIERLIRELEDRVRRT

SEQ ID NO: 4161 - protein, 59 aa, Artificial Sequence
  Synthetic sequence.
EKVVEKARRILKELRDRIREVDKRLRELLEESRKRVEEVERELERLVRELEKKVREAEK

SEQ ID NO: 4162 - protein, 61 aa, Artificial Sequence
  Synthetic sequence.
SEVEDVVRKIKEILERLKKEVDDVLDRNRKLLEELKKRADEVLKRNKDLLETLKREADRDG

SEQ ID NO: 4163 - protein, 56 aa, Artificial Sequence
  Synthetic sequence.
KDELKRLLDELREIVKEAEERLRKSDEDLERIIREVKKRLKESNEELERTIREVER

SEQ ID NO: 4164 - protein, 58 aa, Artificial Sequence
  Synthetic sequence.
REVEEVVKEAEDLLRKLRELAKEFLTRHKKLIRDVTEKVKEVLKRSADSIRELEKIID

SEQ ID NO: 4165 - protein, 59 aa, Artificial Sequence
  Synthetic sequence.
EDAVRKLEEMVERLARIVEDVERKLKKLNKELEEIVRDAKRRLERLNEELRRRIREAER

SEQ ID NO: 4166 - protein, 58 aa, Artificial Sequence
  Synthetic sequence.
DEDEDIERKLKELIDRLREEVKKAEDEHKELIKRDHRRVEEVERRSEKSIKDLRDLAK

SEQ ID NO: 4167 - protein, 59 aa, Artificial Sequence
  Synthetic sequence.
EDVARRLEELVEELEDIVRKVKESLRRLNEELRKNSETVKKKLEDLNRELRKDIEEKRR

SEQ ID NO: 4168 - protein, 58 aa, Artificial Sequence
  Synthetic sequence.
SEAEKVLEEAKRLIEELERRVREVLKRSKKTIEDLRREVDRVVKEHKKLIRELREIIK

SEQ ID NO: 4169 - protein, 59 aa, Artificial Sequence
  Synthetic sequence.
EEVAKRLKDVLRELKDLVEKIEEEARRLNEELKEIIDRARKTLEDLNRELEEVVRRARK

SEQ ID NO: 4170 - protein, 59 aa, Artificial Sequence
  Synthetic sequence.
SEVDEVRRELERVITDDKRLVDESRRKNEKSIRDDEELIKTSRRINEESIRRLKELVER

SEQ ID NO: 4171 - protein, 56 aa, Artificial Sequence
  Synthetic sequence.
EETLRRLVKRLDETSEELEDENRRLNETLKRSSDELRKTNEELNKRLKEVVDRAKK

SEQ ID NO: 4172 - protein, 61 aa, Artificial Sequence
  Synthetic sequence.
SVEEKIKEMVDKIKDSVRRSTEENDRLVKEIDKVLKEAEKRNRDLLKEAADVLKRVLDKRR

SEQ ID NO: 4173 - protein, 56 aa, Artificial Sequence
  Synthetic sequence.
IDTVLKDMKKILDDNKKLVDDSRKKHKESIDRLRKLVKDSLDEHRESIERLERAAR

SEQ ID NO: 4174 - protein, 60 aa, Artificial Sequence
  Synthetic sequence.
REVEELERELEESNKELRKLIKELDDLLRETNKRLNDLIRELKERLDRVLEELRKIIKDD

SEQ ID NO: 4175 - protein, 59 aa, Artificial Sequence
  Synthetic sequence.
REVEKLVEEAIKRNEDLVRTVERKVDEAIKENRRSVEKVAEEVKKAEEELERIVDTVRR

SEQ ID NO: 4176 - protein, 60 aa, Artificial Sequence
  Synthetic sequence.
REVEELKKEADKTNEDLNRLIKELEERARESNRELKRLIDELRRRLEEVLKRLKDIIDKE

SEQ ID NO: 4177 - protein, 59 aa, Artificial Sequence
  Synthetic sequence.
EEVERLVTEMIKRNRTSVDAVRRKVKEMIDRNKALVETVRDEVRRAREKLRDILRKAEK

SEQ ID NO: 4178 - protein, 59 aa, Artificial Sequence
  Synthetic sequence.
SIEEIVRKVKEDLKRSLDELRKVSEDMARRLRESLKELEEVVREMEERLKRILDDIRRK

SEQ ID NO: 4179 - protein, 56 aa, Artificial Sequence
  Synthetic sequence.
ERDLKRRVDEVLTRSKESVDENKRTADRVLEESRESIKELKERAKRLLERLEEERK

SEQ ID NO: 4180 - protein, 60 aa, Artificial Sequence
  Synthetic sequence.
KEVEELEREARRMLEHTKRLIDEVRDRAKKSLDNTRRVDREVEKLVEDTERRLDELRKRG

SEQ ID NO: 4181 - protein, 59 aa, Artificial Sequence
  Synthetic sequence.
EELKRTAERMIEENRRLVETLKRVLEEAIRRNEELVKTLLRKLEESDKKIRKLIEETRT

SEQ ID NO: 4182 - protein, 60 aa, Artificial Sequence
  Synthetic sequence.
SELEELRDRLKEILEHTKKLIKESVERLEESLRNTRRVIRKVEEEVERTRTKLDDLRRRG

SEQ ID NO: 4183 - protein, 59 aa, Artificial Sequence
  Synthetic sequence.
EEMADVARRVIEENKRLVEENEDRLRKAIERNRELVEEVKKRLEDSDREIERLIREVKK

SEQ ID NO: 4184 - protein, 60 aa, Artificial Sequence
  Synthetic sequence.
DEVETLRREARKLLERIKREIEEVRRRLKESLDNTKRVEDEARKLVKETKDKLKRLAERG

SEQ ID NO: 4185 - protein, 59 aa, Artificial Sequence
  Synthetic sequence.
EEMRKVAEDMEREIRRLITDLRRELEEAIERNEELVRRLARELERSDREIKKRIDEIET

SEQ ID NO: 4186 - protein, 60 aa, Artificial Sequence
  Synthetic sequence.
SELDELRKRAKRSLETTEELIRRSRKLMRESLDNTRRVEEKVRRLVEKTLRDLEDLKRRG

SEQ ID NO: 4187 - protein, 59 aa, Artificial Sequence
  Synthetic sequence.
REMEETAREAIERNRKLVEDNERDLKKAIEDNEKLVRDLKRELERSDEEIKKLIREVKN

SEQ ID NO: 4188 - protein, 60 aa, Artificial Sequence
  Synthetic sequence.
DSREELRREAKRLLDDIKRLEEKVERLAREVLKHTEELDEKLKRLVEETLKKLEDLRRRG

SEQ ID NO: 4189 - protein, 59 aa, Artificial Sequence
  Synthetic sequence.
EELKRTAEEMERRIRELIKRLKDRLEDMIRRNKELVDRLKKKAERSDEEIERLIRETKK

SEQ ID NO: 4190 - protein, 60 aa, Artificial Sequence
  Synthetic sequence.
KEIEDVVRELERKVRENKRRNDEVIKRLERLVEKNTELVRRLIRTLEKLVEDLEDIVRRI

SEQ ID NO: 4191 - protein, 59 aa, Artificial Sequence
  Synthetic sequence.
EEAKKVAEDVERRIRRSVEEARRLLEEVKRKMEESVEESKRLLKKVEDEAKDVVDRARK

SEQ ID NO: 4192 - protein, 60 aa, Artificial Sequence
  Synthetic sequence.
SEIDKVIEELKDLVRKNEKRNRDVVRRDDKSVKDNTKRVEDVIRDLDRLIRELREIVERI

SEQ ID NO: 4193 - protein, 59 aa, Artificial Sequence
  Synthetic sequence.
KRAAELAKEVIDRMEESVKEAERLLRELKRKSEDSVRKSKELLDEVEKKVEEVVREAER

SEQ ID NO: 4194 - protein, 60 aa, Artificial Sequence
  Synthetic sequence.
EEIERAIEKVEREIRELEERVREIIERDRKSVEDNSRRVRTVIKELEKLVEELRKTVKDI

SEQ ID NO: 4195 - protein, 59 aa, Artificial Sequence
  Synthetic sequence.
EEARKLAEELRKEIKRVVDEVRKLLRDLERKSKESVREAEELLKRVRDELKEVVDRTEK

SEQ ID NO: 4196 - protein, 56 aa, Artificial Sequence
  Synthetic sequence.
SLREAVERLRKRHEDVVRELEKLVRRVKEELERVNKDLRKVVEEVRRRLEKVLEDA

SEQ ID NO: 4197 - protein, 55 aa, Artificial Sequence
  Synthetic sequence.
TDLLKRADDNVKRNRDLIRRLKEKADEIVKRNEDLIEDARRKADEMIKDLEEKAR

SEQ ID NO: 4198 - protein, 59 aa, Artificial Sequence
  Synthetic sequence.
SEVDELRERAKRIVDDLRRKIEEVVKRLEDSDEENKKLIEKAVRELEKIIRDLEEVIRR

SEQ ID NO: 4199 - protein, 59 aa, Artificial Sequence
  Synthetic sequence.
RELKELVDRLDKEATDVLRKVREDLRKAIERSERSHRRLEKLIEEIERELKRVVDEVTR

SEQ ID NO: 4200 - protein, 57 aa, Artificial Sequence
  Synthetic sequence.
DIEELLRKVAEEITRSVKESRDRLDEVEKKAREVVERSEKRLREVEEKIERVVRRIV

SEQ ID NO: 4201 - protein, 59 aa, Artificial Sequence
  Synthetic sequence.
EEDADKVLKEAEELVRRNRRLVEEVLRRLEEIVKRDEDLVRKVLKEADEIVRRLEEAAR

SEQ ID NO: 4202 - protein, 59 aa, Artificial Sequence
  Synthetic sequence.
SRVEDVVRRLKELNDENSEDSRRVLEKLKDEVRKNSDEIEKAAEELKEKLTRLKRLIEG

SEQ ID NO: 4203 - protein, 59 aa, Artificial Sequence
  Synthetic sequence.
KEVKELVKRVRETSKKSLKEDEDMVREVKKKLDDSLRRVDELVRRVEEEARRVLEEVKK

SEQ ID NO: 4204 - protein, 59 aa, Artificial Sequence
  Synthetic sequence.
DEVERVVKELRDKVDRNSREIEKAVTELRKIVKRNSDESKEVIERLEELLRRLEELIKS

SEQ ID NO: 4205 - protein, 59 aa, Artificial Sequence
  Synthetic sequence.
SRVKTLVDEVRKRAEDSLDTVKKLVDRVRERLDESLRDDKRLVDRVREEAERVVREVEK

SEQ ID NO: 4206 - protein, 60 aa, Artificial Sequence
  Synthetic sequence.
SDVEKIFDELRKLLEDLRRKVEEVFRRLKELVERNTRLNREVVKELKKTSDDLRDMVRRT

SEQ ID NO: 4207 - protein, 59 aa, Artificial Sequence
  Synthetic sequence.
EKVRKLVKEIRERIEKVLRDAEELLKEIEERVKESKKEAKKLLDEVRESVDDVKRKAEK

SEQ ID NO: 4208 - protein, 60 aa, Artificial Sequence
  Synthetic sequence.
SDVEEIVRKLDKLVEDNTRENEEAFKRLDETSKKLEEEVERVFRELKKLVDDLEKIIRDI

SEQ ID NO: 4209 - protein, 59 aa, Artificial Sequence
  Synthetic sequence.
EKVRKLVREVEKKVDESTERAERLLKRVEDSVRDVLRRAKELLDEIRKRVKDVERKAEK

SEQ ID NO: 4210 - protein, 60 aa, Artificial Sequence
  Synthetic sequence.
DEAREIRRRLKEVVDEVRKRLEDSLEEIDRRAKEVLEKVKRSLDRLRKVAEEVLDKLRRK

SEQ ID NO: 4211 - protein, 55 aa, Artificial Sequence
  Synthetic sequence.
ERVKRRVDEVVRKLREIVRKLTEENKRTVEDLERIVERLDRDNRKMVEDMEREVK

SEQ ID NO: 4212 - protein, 60 aa, Artificial Sequence
  Synthetic sequence.
REVEELKKRLEKIVEELKRIVDDHKRKVERIVEELEKLVEDHKRTVEEIVERAKRIVEKD

SEQ ID NO: 4213 - protein, 58 aa, Artificial Sequence
  Synthetic sequence.
ERLEEVAREIEEALKKVKRDLKESNRELEEVADRVRKELDRSDEDLERRMREVREELK

SEQ ID NO: 4214 - protein, 56 aa, Artificial Sequence
  Synthetic sequence.
SVLETLAERVKEVKDNLRKLVEDLKRLVDRIKETLDKLVEELRELVERLDDRLRKN

SEQ ID NO: 4215 - protein, 62 aa, Artificial Sequence
  Synthetic sequence.
RDLLKRLEEIMRRLEKEHKDVSKLLRDIEREIDRVHREVKRKIEEIVRKVRKSLEEVKRRAK

SEQ ID NO: 4216 - protein, 57 aa, Artificial Sequence
  Synthetic sequence.
SRAETVLKEVTDKIKKLKDSSDELLRRNKENIDELKKSSEELLRRLTKAIEEIEKAN

SEQ ID NO: 4217 - protein, 56 aa, Artificial Sequence; identical to SEQ ID NO: 1346
  Synthetic sequence.

SEQ ID NO: 4218 - protein, 59 aa, Artificial Sequence
  Synthetic sequence.
DLEEVVKEARRLLDTVRKKLDESIKEARELLREIEERFKKSADEVREELKRVEDELRRK

SEQ ID NO: 4219 - protein, 56 aa, Artificial Sequence
  Synthetic sequence.
VRELRKEVEDIIRRLDELVKKNTEDNRRVIKELRELVEEHTRRVKKIIEDLEREVR

SEQ ID NO: 4220 - protein, 60 aa, Artificial Sequence
  Synthetic sequence.
SVEEVVEEAKELLKEVEEELKRSAEEAEKLLRDVARKMEESVERLRRLLKDVERALREKN

SEQ ID NO: 4221 - protein, 56 aa, Artificial Sequence
  Synthetic sequence.
LRRLREKIEEIVRRLRELVRRHNEEVRRIIETLEELVRRNTETVEREVRRLRDEVR

SEQ ID NO: 4222 - protein, 59 aa, Artificial Sequence
  Synthetic sequence.
SVEKVLEDARRLLEEVKDRLKKSIDDAEKLLRELEKRLRESADEARRLLRRVKELLERK

SEQ ID NO: 4223 - protein, 56 aa, Artificial Sequence
  Synthetic sequence.
LRELKREIEEIVKRAEDLVRENTEKNKRVVDTVEELVRRHNEEVRRVVKELEERVR

SEQ ID NO: 4224 - protein, 59 aa, Artificial Sequence
  Synthetic sequence.
GLDEIIKRLREVLEKIREELRKSSEELERLLKRVDDDLERSNKELEELLERVRKKLEDS

SEQ ID NO: 4225 - protein, 59 aa, Artificial Sequence
  Synthetic sequence.
EELLRELEKEIKRVDEDLKRLVEEHEELVRDVLRKLEKLVREHKEKVRERVERADDKVR

SEQ ID NO: 4226 - protein, 59 aa, Artificial Sequence
  Synthetic sequence.
SLEEVLKELKKIVEDVTRRLEEMLRESKETSKEVEKELKKLDDEIREIIERAEEDLRRA

SEQ ID NO: 4227 - protein, 56 aa, Artificial Sequence
  Synthetic sequence.
EEILKEVAERLKKTAEEVKRELEKFIEDDRKRADEVRRENEETLKRIEDIVRELKR

SEQ ID NO: 4228 - protein, 58 aa, Artificial Sequence
  Synthetic sequence.
SALEKIMKDLEKSIEDVRRKLEDILRKLRKSSEEVKRRIEDIERKVDRAAKEILRSKG

SEQ ID NO: 4229 - protein, 59 aa, Artificial Sequence
  Synthetic sequence.
EDVVRRLKRTVEEVHKRNEDVVREAEKLVEKLSRINEEAVRRLADIVRRLEEELRKAEK

SEQ ID NO: 4230 - protein, 57 aa, Artificial Sequence
  Synthetic sequence.
REKEDVLRRIERIVREIERRLRESLKRNREIVKDLERLARRVLKESEDNLRKLKEDR

SEQ ID NO: 4231 - protein, 56 aa, Artificial Sequence
  Synthetic sequence.
REKLRKRLEEMKEELRKADERAKEIDTRTKRLVDEAVRKLEKLVEEHRRMTDEIRR

SEQ ID NO: 4232 - protein, 63 aa, Artificial Sequence
  Synthetic sequence.
REDETLEKILRRIEEIVRRLVREAEDVVRRDRETIERLVRENEKAVKEIKDIVDELTRLKKDK

SEQ ID NO: 4233 - protein, 58 aa, Artificial Sequence
  Synthetic sequence.
ESVREAAERLKDILRRLEELLRKVAKDLKKSNDELERLSEESVRRLREILKRLEDALR

SEQ ID NO: 4234 - protein, 60 aa, Artificial Sequence
  Synthetic sequence.
SEVEKILEDLDRSAKEAADRIKEIVDRLTELVKDLKKKNEESLEELDRLVKELADLLRRG

SEQ ID NO: 4235 - protein, 59 aa, Artificial Sequence
  Synthetic sequence.
EDKLRDIARRVREVNKRLEDLIRTVARAVRKALKDSEDLVREIAKRVEKALEDVRRAAK

SEQ ID NO: 4236 - protein, 58 aa, Artificial Sequence
  Synthetic sequence.
REVEEVIRKLERILEEAERMSRESERKLREILEKLERAIREIREELERIHKELEEKAG

SEQ ID NO: 4237 - protein, 56 aa, Artificial Sequence
  Synthetic sequence.
RDRLDKAVEELRKEIEEMLRRSDELVKRLDEKVKKVLKELREHVKRDKEKVDKDAE

SEQ ID NO: 4238 - protein, 58 aa, Artificial Sequence
  Synthetic sequence.
SSRERVIKKLEESLERLERLARKIKEDLERINRDLERLARKVEEELKRIHEELERRSG

SEQ ID NO: 4239 - protein, 56 aa, Artificial Sequence
  Synthetic sequence.
EDELDKRVKDLHRENEREIRRLEDHVRRDRERLEEALRDLEAHVKRDKDKLDKDAK

SEQ ID NO: 4240 - protein, 56 aa, Artificial Sequence
  Synthetic sequence.
SEIEDVARRLEEINKKSEDMARRIKEELEKVDEESERLVREVAKRLDEVLKRVRDD

SEQ ID NO: 4241 - protein, 56 aa, Artificial Sequence
  Synthetic sequence.
AEELKKRVEDLKRKNEDLIRRLEEKVRRLKKRNRDLIEELKKLVKELKDEAKKTSD

SEQ ID NO: 4242 - protein, 56 aa, Artificial Sequence
  Synthetic sequence.
SEEERIEKRLREIHERHKRMLDEIKKRLDDSLKTLEDLIRDVTRELEKVLKKAEDD

SEQ ID NO: 4243 - protein, 56 aa, Artificial Sequence
  Synthetic sequence.
AEDLDREVKRLEREIERSIKELEELVRKLHKENEELIRELEELVERLKRKIDETSR

SEQ ID NO: 4244 - protein, 60 aa, Artificial Sequence
  Synthetic sequence.
SEVEDAERVVRELEREVREEVKKLRKHVKETRDRDKDTVRRVEEKVKRLREKVKRVEDAR

SEQ ID NO: 4245 - protein, 58 aa, Artificial Sequence
  Synthetic sequence.
RAVREVLKELERVLRDAKRELDRVREEHERSHKELRDMLDRVKKELEKILEKLERALR

SEQ ID NO: 4246 - protein, 56 aa, Artificial Sequence
  Synthetic sequence.
EDKERVEEKIKRSLEEARREAERVRDKLRKSEEEIDRVMKRVLAEIDRVLKEVKEA

SEQ ID NO: 4247 - protein, 56 aa, Artificial Sequence
  Synthetic sequence.
SKELEDIVRRLEERNRRTVEEVERLVDEHNKRLREAAKELKKLVDDLERKLREDTR

SEQ ID NO: 4248 - protein, 56 aa, Artificial Sequence
  Synthetic sequence.
SEIEEVKKKLEKILRDHNRVVEEVAKEHEKILRDHNRVIREVKEELDRVLKKLRDD

SEQ ID NO: 4249 - protein, 56 aa, Artificial Sequence
  Synthetic sequence.
AEKLERLVKRIKEEVEESVKRLKDHAKENREDVKRSVEELRDVVRRLEERIKESAD

SEQ ID NO: 4250 - protein, 56 aa, Artificial Sequence
  Synthetic sequence.
SEIEEVARRLDEILERHNDVLRKVKEKHEEILRRHRKRVREVEEELKKILKELREK

SEQ ID NO: 4251 - protein, 56 aa, Artificial Sequence
  Synthetic sequence.
AKDLKRKVDELRRKAEESMKEVERHVRENAEHVKRSVEELEEDVRRLRKKLEEKER

SEQ ID NO: 4252 - protein, 56 aa, Artificial Sequence
  Synthetic sequence.
DEKEKVKEDLDRILEEHRREVEDVERKHRKILKDHEEVVRRVREEHEKILKRLKDN

SEQ ID NO: 4253 - protein, 56 aa, Artificial Sequence
  Synthetic sequence.
AKKLEDLVRRLKEHVDRSRERLEKHLRENKRHVEESAKRLEKHVRDNEEDVKRKST

SEQ ID NO: 4254 - protein, 60 aa, Artificial Sequence
  Synthetic sequence.
KEEEDLEREVKRLEDKVREDAKKLEEVVKTVEKLVRDDARRNEEVVKEVADRVRRLTERK

SEQ ID NO: 4255 - protein, 55 aa, Artificial Sequence
  Synthetic sequence.
EDVIRKMEEIIKRLEEVSREVEKRLRRIIRELERVSKEVLDRLREIIEKLDRDAT

SEQ ID NO: 4256 - protein, 56 aa, Artificial Sequence
  Synthetic sequence.
SVEDDVRRKLKEIEDEHRKVVKDARDELEKSHRRLRKVIEDVKRKLDRVLEELERS

SEQ ID NO: 4257 - protein, 56 aa, Artificial Sequence
  Synthetic sequence.
EKDLEEVIRRIRKKVEDSKRDLERLLEKSKRDVEEVMKDLKRRIEELEKLVRDETT

SEQ ID NO: 4258 - protein, 59 aa, Artificial Sequence
  Synthetic sequence.
SLKDELEKLLKELKEHVDRSEKKARENLKRLEEHVRKSKEELEDRLRRIEEKVKRLTES

SEQ ID NO: 4259 - protein, 59 aa, Artificial Sequence
  Synthetic sequence.
EEMVERAIRKLEDIHRRHREVVERVEREHRRIKEEHEKVVREAEETLKRIIEDLRRSAD

SEQ ID NO: 4260 - protein, 59 aa, Artificial Sequence
  Synthetic sequence.
KLEEEARELLRRLEEHVRKSKKEAEDNLRRLEKHVEDSKRRLKELLDRLRKTVEDLKRA

SEQ ID NO: 4261 - protein, 59 aa, Artificial Sequence
  Synthetic sequence.
EDVVRRAADALRRVHEAHKRMVEEVKRRHDEIHKRHEKVVRDAERALREVLKRLEEAAR

SEQ ID NO: 4262 - protein, 56 aa, Artificial Sequence
  Synthetic sequence.
SLRETADKRLRDVNRDLKRVIEELRERLKESNKKLEDLIRELRERAERILDDLRRS

SEQ ID NO: 4263 - protein, 60 aa, Artificial Sequence
  Synthetic sequence.
EEDLARRLEEIVKESKEIVDRARRRLEEIVERSEDRVRRVEERIKELVKRLEDIVRREKT

SEQ ID NO: 4264 - protein, 60 aa, Artificial Sequence
  Synthetic sequence.
KEIEEVLRRLEELIRRVREELRKNNEDIEREADKLRKELKRVNDELEKKIKDVKDRARRD

SEQ ID NO: 4265 - protein, 59 aa, Artificial Sequence
  Synthetic sequence.
KEVLDELRRVVEEVTREIREVLETSRELVRRIVETVKEVLRSHDEKIKKVEEELDRDRQ

SEQ ID NO: 4266 - protein, 57 aa, Artificial Sequence
  Synthetic sequence.
DVDEKVRELLRKIEEDLRRSVKELRELAKRIEEDLRRISKKSKDLLKKIKDDVKRAG

SEQ ID NO: 4267 - protein, 56 aa, Artificial Sequence
  Synthetic sequence.
EEDLKRVIEELKKEVEELHRRNEKIIRELEDKVRRVREDNERVIEELARDVERAER

SEQ ID NO: 4268 - protein, 59 aa, Artificial Sequence
  Synthetic sequence.
SLREEAEKIIRDLEDHVRRDEERVKEMVDRSRKLVKELEKRLRDLIREITRRVDKLRKD

SEQ ID NO: 4269 - protein, 59 aa, Artificial Sequence
  Synthetic sequence.
EKVLRKAEELLKRIIAELKKIHEELRRLSKESKERLERILDEARKMLEEVKKRLEDIEK

SEQ ID NO: 4270 - protein, 59 aa, Artificial Sequence
  Synthetic sequence.
SLEEKLEKLLKELRDHVRRDKKEVREALERLKDHVRKDREKLERAIAEIKKAVEKLKRD

SEQ ID NO: 4271 - protein, 59 aa, Artificial Sequence
  Synthetic sequence.
EKVLRKLEKAAREVAEAVKKVHEELKRALEEIRRELEDINRKLKEAADEVRKKLRDIAE

SEQ ID NO: 4272 - protein, 60 aa, Artificial Sequence
  Synthetic sequence.
SLEEELREVIKRLRDHVRRDKERAKEAIKRAEDHVRRDEEAVEEVIKELKRLVDELRKAK

SEQ ID NO: 4273 - protein, 59 aa, Artificial Sequence
  Synthetic sequence.
EDVLRRATKALEDIRRELEKINEELKRAAERIEKRLKEIHDRLKKALDDVRRELEETRR

SEQ ID NO: 4274 - protein, 59 aa, Artificial Sequence
  Synthetic sequence.
SLKEKLEREIERLRKHVEDDERRLREVIRRLEEHVKRDEDRLKKELDRLREEVERLRRA

SEQ ID NO: 4275 - protein, 59 aa, Artificial Sequence
  Synthetic sequence.
EEVLKEAEDLLRDVTRALEEVNRRARKLLKEIKEKLDEIHKRLNKMLEEVKRRLDEIRR

SEQ ID NO: 4276 - protein, 56 aa, Artificial Sequence
  Synthetic sequence.
SRAEEMIKDVRRIVEEVRRENKRVLEEIEEIIKRSKEEWEKILKELRDIIEEVERR

SEQ ID NO: 4277 - protein, 59 aa, Artificial Sequence
  Synthetic sequence.
EELLRRIKEVVDRARDTLRRLDEELKRIVEAVHDTDDKVKKELEKIVREVEEIARRRSK

SEQ ID NO: 4278 - protein, 57 aa, Artificial Sequence
  Synthetic sequence.
SEAERVVRENEENLERIKREVERDLRRNEEVLEDLRRKVKKVLDEIRETLRRLREAK

SEQ ID NO: 4279 - protein, 59 aa, Artificial Sequence
  Synthetic sequence.
EEAVRKLDDLDRRLEEIVRRASEALKRSLEEIERILRKAEEDLRRLLKRLEEIIREVER

SEQ ID NO: 4280 - protein, 60 aa, Artificial Sequence
  Synthetic sequence.
SVEDTLREMLKRLEEIVRRAEETLKRLNEEIERVVREAARRLDKLNKELRDIVRDIKRRK

SEQ ID NO: 4281 - protein, 56 aa, Artificial Sequence
  Synthetic sequence.
KDDLKRRLEEILKELKRIVDEAEERHREIIKRLRDIVREATEKSREVLKRLEDKAK

SEQ ID NO: 4282 - protein, 60 aa, Artificial Sequence
  Synthetic sequence.
KVREKLERALRRSTTSSRDIERRLKELLDTNREIVDRIVKRLKEMLDRLREEIRRIEERR

SEQ ID NO: 4283 - protein, 59 aa, Artificial Sequence
  Synthetic sequence.
DELVKRLEDDLRRWEKESKEIVDRVKEEIDRVNRESKETLKELEKEAKRVLDELERDER

SEQ ID NO: 4284 - protein, 60 aa, Artificial Sequence
  Synthetic sequence.
DVERTLDEMLKRSEDVTDEVREELKRALESNNKLIKEIVDTADKVLKDIEDTVRKIIEKK

SEQ ID NO: 4285 - protein, 59 aa, Artificial Sequence
  Synthetic sequence.
EKLVKEVEDRARKWLKDLRDKIERLREELEKVNRDTERILEKVERDLRRLLEEVRKRDR

SEQ ID NO: 4286 - protein, 56 aa, Artificial Sequence
  Synthetic sequence.
DEVEKVLREIEEIIKELKKEVDKDLEELKRTIERLKKKADEVVKRNEEVIRTLREG

SEQ ID NO: 4287 - protein, 59 aa, Artificial Sequence
  Synthetic sequence.
KEAADKLRELLKRLEEVVRRWKEAIEDINRKLEKVVRDIERLLRDLDRKAREVLERLRK

SEQ ID NO: 4288 - protein, 56 aa, Artificial Sequence
  Synthetic sequence.
SSVEKVLRELDDLIRRNRDLVEEDRKELKRTSDENRERVERIVRKNEKAIRDLRRN

SEQ ID NO: 4289 - protein, 59 aa, Artificial Sequence
  Synthetic sequence.
KKAADDLKRVLDKLRKSHREWNELIKKANKENTEILREAEERLRELDRRLRKVLEDLRR

SEQ ID NO: 4290 - protein, 60 aa, Artificial Sequence
  Synthetic sequence.
SEVERVLKELKELLDRLRELVEEILRRLEKIIKETKREIEESLRTLEEIIRRLEELAERV

SEQ ID NO: 4291 - protein, 58 aa, Artificial Sequence
  Synthetic sequence.
DADRALRKVLEDIKEIVKKAKEDLERVYKKHKKLVDEVKKAHEDVLKKAREVLEEIRR

SEQ ID NO: 4292 - protein, 60 aa, Artificial Sequence
  Synthetic sequence.
DEVEDVLRKIKEIIKRTEDKVRESLKTLKEIIRRTKEEVKKILKEIKELIERVEREARRV

SEQ ID NO: 4293 - protein, 59 aa, Artificial Sequence
  Synthetic sequence.
ERAETKLRELYERHRKVIKEVRERHKEVHKRHRDVLEEIRRRLEKLLKDLEDVIREIER

SEQ ID NO: 4294 - protein, 56 aa, Artificial Sequence
  Synthetic sequence.
DEEKDVVRRLKRNVEENTKNVERMVRELERNIRENTENAKEVITRLKKIIDELRRR

SEQ ID NO: 4295 - protein, 55 aa, Artificial Sequence
  Synthetic sequence.
EDVKRVRKLARESLERVRRLHREVLEKLKKSHDDVKRLHEEIDERAKRVVEEREK

SEQ ID NO: 4296 - protein, 56 aa, Artificial Sequence
  Synthetic sequence.
DAEELLKEIERELKRSIEEARRLLEEVEKRLRKSKRDVEKLLKEVREKLEKVVREI

SEQ ID NO: 4297 - protein, 59 aa, Artificial Sequence
  Synthetic sequence.
RDVVRRLVEEARKLVEENTRENRDMIEKLRRLVKRHSEEVEEIIRRLDKLIDDVRREAE

SEQ ID NO: 4298 - protein, 59 aa, Artificial Sequence
  Synthetic sequence.
SLEELLREVERRLRELNKKLEDMIREVEERLRKVIRETEKLIEDVKRELEKILEKARER

SEQ ID NO: 4299 - protein, 56 aa, Artificial Sequence
  Synthetic sequence.
EKELEKEVRDDLRRTDEDIRRLLDEARKDVERHKEELKKLLEDAKRLLERVERTIR

SEQ ID NO: 4300 - protein, 57 aa, Artificial Sequence
  Synthetic sequence.
RELEEVVKKVREEVKEHTEKVKRLVEEAEELNRRYEEEVKKLVTTAKRLNDEARKRN

SEQ ID NO: 4301 - protein, 56 aa, Artificial Sequence
  Synthetic sequence.
KELLDEVAKLVEESLRRLDRLLEEIKRTSDELIEKNERLNRELNKTSDKVVEDMRR

SEQ ID NO: 4302 - protein, 60 aa, Artificial Sequence
  Synthetic sequence.
SLEDLIREVEDRNRKSVEEVERLLEEVRRKLDESRKRLEELLKRVEEKLERVIEEAKRRL

SEQ ID NO: 4303 - protein, 59 aa, Artificial Sequence
  Synthetic sequence.
EKVVEELAREMKKSVEEHTREVRRMVAELEKLVKRHTEEVERAVREAEKLVETLREELR

SEQ ID NO: 4304 - protein, 60 aa, Artificial Sequence
  Synthetic sequence.
SLEDLIREVEKRNKESVDTARRLLDEVRKKLKDSIDRSRKLLEEVRRKLEEVIKDAKRKL

SEQ ID NO: 4305 - protein, 59 aa, Artificial Sequence
  Synthetic sequence.
ERVVEEIMRRLEKSVERHTEEVKRVVREAEELVKDNTRKVEELVRRAEKLVEDLERRTR

SEQ ID NO: 4306 - protein, 60 aa, Artificial Sequence
  Synthetic sequence.
SLEELIREVEERLRKSVDDSRKLLEEVKRKLEDSKREVDRLIEEVKRELERVIEDVTRKL

SEQ ID NO: 4307 - protein, 59 aa, Artificial Sequence
  Synthetic sequence.
EKVVKELADEMRKLVRTNTEIVKDVVKKLDELVERNTRTNRDVVRRARELVEELERRER

SEQ ID NO: 4308 - protein, 57 aa, Artificial Sequence
  Synthetic sequence.
RELERVVEEARRLVEEHTEEIERSADKARKLNEEHSRRVDEIFERLERLIREAEKKN

SEQ ID NO: 4309 - protein, 56 aa, Artificial Sequence
  Synthetic sequence.
RELLEEIRKLVEESVERVKRLNEDVNRTSKESVKRLEDLVDEIRKRVEEVVRRLKK

SEQ ID NO: 4310 - protein, 56 aa, Artificial Sequence
  Synthetic sequence.
SELERVAEEAERIVREAEEKIKKSVTELKELVKRHSERVKRIFKELEELLRRLREK

SEQ ID NO: 4311 - protein, 56 aa, Artificial Sequence
  Synthetic sequence.
EDLLREVRKKVEEVVKKIKRLNEEVNRDVKRSAEELKRLIDDIRRILKKVIDDLKT

SEQ ID NO: 4312 - protein, 56 aa, Artificial Sequence
  Synthetic sequence.
DEMEEVVKRAEEIVKEARERIEESFRRLREENKEALERLKRIAEEMRRLLKEVLER

SEQ ID NO: 4313 - protein, 56 aa, Artificial Sequence
  Synthetic sequence.
EELLRRVEKEVRRVEEEIRRLNKEVNETSDRVEREAEKLVRELEEAVRKVVEDLER

SEQ ID NO: 4314 - protein, 59 aa, Artificial Sequence
  Synthetic sequence.
DLEEVIKEARKRLEDSHRRLEKLIREVEKEHEDSHRKLRELVERVKKKHKEVEEKIKRN

SEQ ID NO: 4315 - protein, 56 aa, Artificial Sequence
  Synthetic sequence.
VEELLKDLERMVRELNEEIERALEDAKRNVDRLDDEIRKLEERVDRNVKRLEEDIK

SEQ ID NO: 4316 - protein, 59 aa, Artificial Sequence
  Synthetic sequence.
SLEDVAREAKKRLEDLKKKITDLIREARRKHKESHDRLRELVEKIKEDLKRVLKKLEDD

SEQ ID NO: 4317 - protein, 56 aa, Artificial Sequence
  Synthetic sequence.
VREVKEKLRRTVEALDERIDKLRKELDENVRRLDKEIEDMVRKAKKVVDELREEIR

SEQ ID NO: 4318 - protein, 59 aa, Artificial Sequence
  Synthetic sequence.
DLDEVVKEVDRRLEESHERLRRLIKKVDEDHRRSHEDLKRVIDEARRLLEEVLERLRRN

SEQ ID NO: 4319 - protein, 56 aa, Artificial Sequence
  Synthetic sequence.
VEEVLKEVKKAVEKLNEDIDRLFEKARENVKRLDEDIKRLLEELRRKVKKAEDEIR

SEQ ID NO: 4320 - protein, 59 aa, Artificial Sequence
  Synthetic sequence.
DLERVVEEVKKLLRDSHEEHKKVVKEVKERLDRSHKESKRVSDEVRKKLEEVLKELEDR

SEQ ID NO: 4321 - protein, 56 aa, Artificial Sequence
  Synthetic sequence.
VEKVLRDVRRVVTELNKHIEDLKRKVTEDVERLNTEIKELKKRNDEAVRRAREEIK

SEQ ID NO: 4322 - protein, 60 aa, Artificial Sequence
  Synthetic sequence.
KEDEDLDRDVKRHIEETEKRVKEVEKRHKDEIRKVREDVKDVERRHKEKIDDVRRKLRDG

SEQ ID NO: 4323 - protein, 55 aa, Artificial Sequence
  Synthetic sequence.
EEILRKLRKRTEEIKREAERIHDRTREEIEKIKRDLDEIHKRTREVIKELEERSR

SEQ ID NO: 4324 - protein, 60 aa, Artificial Sequence
  Synthetic sequence.
KKEEDIEREIRDHIRRTREKLEKLAKELRDDIRRLREELKRIEDEIREESKRLEDILRKG

SEQ ID NO: 4325 - protein, 55 aa, Artificial Sequence
  Synthetic sequence.
EDILRRLREETEELRKEAERLLREYKRLTEELARELRELVKKLEEEVRDLERRSR

SEQ ID NO: 4326 - protein, 60 aa, Artificial Sequence
  Synthetic sequence.
SEEERIEEDIRRHIKRTRDRLDELRRRLEEDIKRLRERVEDLKRDLERNIRELRDRLRRG

SEQ ID NO: 4327 - protein, 55 aa, Artificial Sequence
  Synthetic sequence.
EEILRRMERLTRELAKDADRLLKKYRKLTEDLKRELEKILKTYRDLTEELKERSR

SEQ ID NO: 4328 - protein, 56 aa, Artificial Sequence
  Synthetic sequence.
SELDELRKRIEEAAKELKKRLEDHKRRLEEAEERFERDLERIHRRSREVVRDLKER

SEQ ID NO: 4329 - protein, 62 aa, Artificial Sequence
  Synthetic sequence.
DRILREVEDIVRKLKEILKEVRDRLRELSKRLEDRLKEVEDKLDKDVKDVEEELRRILEERK

SEQ ID NO: 4330 - protein, 61 aa, Artificial Sequence
  Synthetic sequence.
SRLEKAEEDIKRYIEEHKRRSEETLKELTDKAREITRRLDESLKTVEDTSREIKKDVEDRG

SEQ ID NO: 4331 - protein, 59 aa, Artificial Sequence
  Synthetic sequence.
EDLRRVIKRIRELLERLEREDRRIIEEIKKLLDRLKKKVEDIIERIERSLKRLEEELRR

SEQ ID NO: 4332 - protein, 60 aa, Artificial Sequence
  Synthetic sequence.
SEEELLRKLEEISRRVTRALEKLLEDHERLSREVAERLEDLLRRHKKLLEELIKLAEERV

SEQ ID NO: 4333 - protein, 56 aa, Artificial Sequence
  Synthetic sequence.
EEELDERIRRLKDKNKKNLDDLREHSKEVLERNKENLDELRKHSKKVLDEARKELK

SEQ ID NO: 4334 - protein, 59 aa, Artificial Sequence
  Synthetic sequence.
DEKERAKEEVKKLRDDAEKTDRDLEKEVEDTARELKETLERLRREVERLEEELERISRR

SEQ ID NO: 4335 - protein, 55 aa, Artificial Sequence
  Synthetic sequence.
KDLTEELKRVLDDHERTLRKIEEDLRRILEEHKKETKKITEELERILEKMRKDEE

SEQ ID NO: 4336 - protein, 56 aa, Artificial Sequence
  Synthetic sequence.
STKEELLERAKEIIKRLEELLRRNNRTLREILKDLKKRLEESNREIKRLIDEVTRN

SEQ ID NO: 4337 - protein, 56 aa, Artificial Sequence
  Synthetic sequence.
DEDLRRELERLKEEVDRAHKESEEIVKKLEKRIRDAIRRSKKRVDELEKELREAEK

SEQ ID NO: 4338 - protein, 56 aa, Artificial Sequence
  Synthetic sequence.
SEKEEVDETLRRLEEEHERVVRDAKRRLEEDHEKLRRVIRDSDRINDEINKKAEED

SEQ ID NO: 4339 - protein, 56 aa, Artificial Sequence
  Synthetic sequence.
AEELKRILDETRERIRESMEEIKRKLEESRRESEDIRRKLKEDNDRLKKELDDRAK

SEQ ID NO: 4340 - protein, 59 aa, Artificial Sequence
  Synthetic sequence.
SSEEEIRETVKRLKEIVKKHKKDVDEIAEELRRIVEELRRRNEEEIKKIRKILRELEEK

SEQ ID NO: 4341 - protein, 59 aa, Artificial Sequence
  Synthetic sequence.
EKLVRELERIVEEIKEELEKSDRELEKIIREIAKRLEEIHEETERAVREVKKRLDEVAK

SEQ ID NO: 4342 - protein, 56 aa, Artificial Sequence
  Synthetic sequence.
SEEEKLLERLERTVERLEREARRLLEKSKEKLKRLEDSSRELLDKLRKEVERLRRE

SEQ ID NO: 4343 - protein, 59 aa, Artificial Sequence
  Synthetic sequence.
EDFLRELEKLLEEIKRKIEEARERLERSNKELEDVIRDSERRLRKLLKEIEEVIRRKAT

SEQ ID NO: 4344 - protein, 56 aa, Artificial Sequence
  Synthetic sequence.
SEIERLLERLKKALEEIKRSSERLIRKLEEVLRDLEREVRKLLEDSRRTLERIRKE

SEQ ID NO: 4345 - protein, 59 aa, Artificial Sequence
  Synthetic sequence.
RDAVEELERLLKEIEKTIEESRRRLEELLERIERLIRKVIEELRRSNEELERVIREKSK

SEQ ID NO: 4346 - protein, 59 aa, Artificial Sequence
  Synthetic sequence.
KVEKRLRELVERIRESHERVLREVERLVEEHRETLKRILDRIREILKRIEEDIESIRRR

SEQ ID NO: 4347 - protein, 59 aa, Artificial Sequence
  Synthetic sequence.
EEVVREELERLERNIKESRDDIRRALKELKDTNEKAKEELERKLEELDRDLKRLREEAR

SEQ ID NO: 4348 - protein, 60 aa, Artificial Sequence
  Synthetic sequence.
SEVEDELRKSRKEIEDLAREAERELEEIKRHIERSERKAKEDIDRIEREIEELDKLRKEN

SEQ ID NO: 4349 - protein, 56 aa, Artificial Sequence
  Synthetic sequence.
EKALRKSHKELEDLVREVEKKLRELLERYRKRIEEVAKKLDDLLDKLREVVDRAKK

SEQ ID NO: 4350 - protein, 59 aa, Artificial Sequence
  Synthetic sequence.
SEVERELKRIKDEIRELAREAREDLERIKEHIKRSKERVEEELRRSEEEIKEIERLARE

SEQ ID NO: 4351 - protein, 56 aa, Artificial Sequence
  Synthetic sequence.
KDDLDRLLEELERVVREVKKRLRKLLEDYKELVDRVRKKLEDSHRRLKELAERTKK

SEQ ID NO: 4352 - protein, 60 aa, Artificial Sequence
  Synthetic sequence.
DVERELDRIHREHEELLRDIEKKLREILREHEELLKRIKEELDEILERLRKLVEDVKREK

SEQ ID NO: 4353 - protein, 59 aa, Artificial Sequence
  Synthetic sequence.
EEEVRDILRRLKEEIDRSRREAEEILRRLKKEIEDTKREVDETKKDLKRTLDEIREEAK

SEQ ID NO: 4354 - protein, 59 aa, Artificial Sequence
  Synthetic sequence.
SEVEEEVERIDRNIDRLRKEVEDNIRRSEEEIKRIKEEVEKNLEDLRREIDRIRELVEA

SEQ ID NO: 4355 - protein, 60 aa, Artificial Sequence
  Synthetic sequence.
MERMKRKLKELLDKHKKLVDDAKKKHDDSNRKLERLIREATKEHKKALEDLKKLIDDSRR

SEQ ID NO: 4356 - protein, 61 aa, Artificial Sequence
  Synthetic sequence.
KDTEEAEERWKAKDKKLEDDVRENLKRLREEITRLEKEVKDNVRRIKELIDKLRRDVEREG

SEQ ID NO: 4357 - protein, 59 aa, Artificial Sequence
  Synthetic sequence.
EEAKDSLRKLKKHSDDTVRRVKEEHERVLKEAKELLDKVEKEHRRLLEELERLLREARK

SEQ ID NO: 4358 - protein, 61 aa, Artificial Sequence
  Synthetic sequence.
SEEDKERKKWERRDEELRKRVERNEREWERADKELEEEVKREVERIRREIEELRRRVEKDG

SEQ ID NO: 4359 - protein, 59 aa, Artificial Sequence
  Synthetic sequence.
DEARKELERLLEHSRKLLEDVRRSHEELVKHSKERADRIRETLKKLLDDLRKLLEDARK

SEQ ID NO: 4360 - protein, 61 aa, Artificial Sequence
  Synthetic sequence.
SDIERRKEEWKREDEKLEKRSRKNVEDWERRDEELKRRSEENVRRIKEMIERLEDRVRRDG

SEQ ID NO: 4361 - protein, 59 aa, Artificial Sequence
  Synthetic sequence.
EEARKELEKLLRNSKRLVDESERRLRELERHSRELLKRSRRELERLMKELEDLAREIRR

SEQ ID NO: 4362 - protein, 59 aa, Artificial Sequence
  Synthetic sequence.
RESEKIKEDMDRSNEKHNKEVEETLKRLEEELKRLEDEVRDAKRELDELLERLERRARD

SEQ ID NO: 4363 - protein, 59 aa, Artificial Sequence
  Synthetic sequence.
KELEDLARDVAKKNKESVDRVKKELKRVDEEVKRLLDEVKKDLDKVREDLKRVIDEIRR

SEQ ID NO: 4364 - protein, 61 aa, Artificial Sequence
  Synthetic sequence.
SEVEKVITEVEELVREYRKRLEDKRREAKKRVDEYEERLKRMEDEVRKLLEEIERRIRKDG

SEQ ID NO: 4365 - protein, 56 aa, Artificial Sequence
  Synthetic sequence.
KDALRRAEEKLKKLIKENKEINDEINERSKELNERSKEVLKKIEEDLRRLIEEVRR

SEQ ID NO: 4366 - protein, 59 aa, Artificial Sequence
  Synthetic sequence.
SREDLVREVRERLKKLLKHSAELIKRVKEELEELLRHSEENVREVKKRLDEIKEEAKKR

SEQ ID NO: 4367 - protein, 56 aa, Artificial Sequence
  Synthetic sequence.
IEDERRAVEETEERWRRKDDTVRKEVEEEKEKWRREDEKHHRDVERALRKLKRDIE

SEQ ID NO: 4368 - protein, 59 aa, Artificial Sequence
  Synthetic sequence.
DEDELVREAKDRLDKLLEHSRKNVEEAEKRLRDLLEHSKKNVEEAERLLEEIEEEARRS

SEQ ID NO: 4369 - protein, 56 aa, Artificial Sequence
  Synthetic sequence.
LEEVRKEVKKEIDDWRARDEEHHRDVKRREEEWERKDEEHHRKVEEVIERLKRELK

SEQ ID NO: 4370 - protein, 59 aa, Artificial Sequence
  Synthetic sequence.
SVEELIKEVEERLKRLKEHSEDLAREVRERHKKLIEELRRILEEVKKRHKDLTEKLEKD

SEQ ID NO: 4371 - protein, 55 aa, Artificial Sequence
  Synthetic sequence.
EEMKKRVEEEEKKWKRDDERLEKRVRENIERLRRLLERLRKRVEDNIKRLDDERR

SEQ ID NO: 4372 - protein, 59 aa, Artificial Sequence
  Synthetic sequence.
REEDLIREVERILEELLKHSKRLIDEARDSHRRLLEHSKRLVEEVERLHKELLDRAREN

SEQ ID NO: 4373 - protein, 55 aa, Artificial Sequence
  Synthetic sequence.
DRMREEVRKTEERWRDKDRELEKRVRDNERRWEDRDRKLEKRVRDNIKRLRDELE

SEQ ID NO: 4374 - protein, 59 aa, Artificial Sequence
  Synthetic sequence.
KAEELVEKVRRDLEALLEHSKTLAEKVRRDHRKLKEELKELLERVKRRLEELKKRLEDS

SEQ ID NO: 4375 - protein, 55 aa, Artificial Sequence
  Synthetic sequence.
DELRKKVDEDRRRWEEDDRRLEKRVRENLRRLEKIIKDLEDRVRREVEKIDKDRK

SEQ ID NO: 4376 - protein, 59 aa, Artificial Sequence
  Synthetic sequence.
DREKLIEEVKDRLRRLLKHSRELLKEAEDRHRELLKHSERLVRESERRLEELLRRARKS

SEQ ID NO: 4377 - protein, 55 aa, Artificial Sequence
  Synthetic sequence.
DEVRKEVKKDEDDWRKADDDLRKRVEDNVRRWEERDRELKERSERNLEKLERERK

SEQ ID NO: 4378 - protein, 59 aa, Artificial Sequence
  Synthetic sequence.
SREDLVRRVDKALRDLTRHSEELMRRSDETLKELLKHSRRLAKESEDRLKELLDEARER

SEQ ID NO: 4379 - protein, 55 aa, Artificial Sequence
  Synthetic sequence.
ERLEEKVRREEEEWKKKDEELKKRSEKNVDEWRKRDDKLRRDSKRNLDKLREEIR

SEQ ID NO: 4380 - protein, 55 aa, Artificial Sequence
  Synthetic sequence.
SLVDEIRERVRRLDEDVRRLIEEIEKRIREIDKRAEDLIRKIEDDSRRTLEEVAK

SEQ ID NO: 4381 - protein, 58 aa, Artificial Sequence
  Synthetic sequence.
EELEKVVEENERSLRELVKTLEDVLRKNDKTVKELEKRLREVLDRTRRFMEELIRRAR

SEQ ID NO: 4382 - protein, 55 aa, Artificial Sequence
  Synthetic sequence.
SLKDKIREDSERTLKTVERLLREIEKEIRKLDRDIERLIEEIRRRIEKLDKDIER

SEQ ID NO: 4383 - protein, 58 aa, Artificial Sequence
  Synthetic sequence.
EELEKVLKDTRDEAERLKEEVRRVLEDNDRTAKELRKTLEEVLKRNEESARELKKRIT

SEQ ID NO: 4384 - protein, 56 aa, Artificial Sequence
  Synthetic sequence.
DEERRVEEELREVDKRLKKLLEESKRKLDEVIRRVREVVKKLKKRLDDVNRLVARD

SEQ ID NO: 4385 - protein, 55 aa, Artificial Sequence
  Synthetic sequence.
EKILRTVEKLVRDIERELRETNKRVREDVEKIIEDLKRILEENDKRADDWRRADK

SEQ ID NO: 4386 - protein, 56 aa, Artificial Sequence
  Synthetic sequence.
DESEEVARELEKVDRDVDKLVKDSRKELEDSNREVEELLRRSTERLKEVNTLVARD

SEQ ID NO: 4387 - protein, 55 aa, Artificial Sequence
  Synthetic sequence.
EKLVREVERRVEDIKRKAEKTLDDNRKLIEEWVRRLEKSLEDNRRLAKKWKDEDK

SEQ ID NO: 4388 - protein, 57 aa, Artificial Sequence
  Synthetic sequence.
SELDELKKEVDDVAREVRRHNKKLEEEVEREVRRMRRHNEENVKRVEESAKEARKDV

SEQ ID NO: 4389 - protein, 56 aa, Artificial Sequence
  Synthetic sequence.
LREVKKLVEEVTRRLERINKELERLIREVRKRMERVNDELHKRNRDVERKLREVVR

SEQ ID NO: 4390 - protein, 57 aa, Artificial Sequence
  Synthetic sequence.
SELEALEEDVKRVVKEIKDHNEKLIRELEETIRRIDRHNDENIRRTEEEIKRVLDKK

SEQ ID NO: 4391 - protein, 56 aa, Artificial Sequence
  Synthetic sequence.
EEDLRRLLEKLKEDLRKVNEDLERLLREAKRRLERVNEKLHELSRRIREKLEEVDR

SEQ ID NO: 4392 - protein, 57 aa, Artificial Sequence
  Synthetic sequence.
SELEKLVEKIKERVERARRHNERLREDVERVLTESDKENKDLIDDARRAVKEVLDRK

SEQ ID NO: 4393 - protein, 56 aa, Artificial Sequence
  Synthetic sequence.
EEELDRLIREIIKELEDVNRTLRKLLEEIKRRSKDVNRDLRRLLEEIKEKLRRKSK

SEQ ID NO: 4394 - protein, 57 aa, Artificial Sequence
  Synthetic sequence.
SEIDELKKDVERRVREVEETNRRLEKEVRERLERSRKHLKELIEDARREVERVEREV

SEQ ID NO: 4395 - protein, 60 aa, Artificial Sequence
  Synthetic sequence.
KKKVLDELKKVIKEVEDRLRKIDEELKKVIDEVRKELEKINRDLERVIREVKKRAEEVRR

SEQ ID NO: 4396 - protein, 57 aa, Artificial Sequence
  Synthetic sequence.
REIEELAKTVRKEVDDSRKHLKELREDAKRTLDEVKRETKKLEEDVRREVERVKREV

SEQ ID NO: 4397 - protein, 60 aa, Artificial Sequence
  Synthetic sequence.
KEKVLRELKKVIDEVRKLLEDINRELEEAIRDVKRKNEDTLRELRKVIKEVEKRLKDVTR

SEQ ID NO: 4398 - protein, 58 aa, Artificial Sequence
  Synthetic sequence.
KEVEDVVRELKKSLEENEKRVRDIERELREVVKKIAKRVEETREEVERMLEEIRRRSG

SEQ ID NO: 4399 - protein, 56 aa, Artificial Sequence
  Synthetic sequence.
IKKVVDEARKVLKEVHENTERIVDEARKLLKRMEEKNRKTEEDIRRVADEVREKAR

SEQ ID NO: 4400 - protein, 58 aa, Artificial Sequence
  Synthetic sequence.
SKVDKVREEVTRSLEDNKRKVEEIEREARESLERNRKKVEDSIREARKVVEEIERKKG

SEQ ID NO: 4401 - protein, 56 aa, Artificial Sequence
  Synthetic sequence.
IDTVTRRIREVMKKVHDNTRRIAEELRRLMKRVHDNTERSHEELKRLLEEVKRKAD

SEQ ID NO: 4402 - protein, 58 aa, Artificial Sequence
  Synthetic sequence.
REVEEVVKELKKSLDDNRDEVRKIIEEVTRLNKRNEEDVKRVTDEAEEVVKRIVEKKG

SEQ ID NO: 4403 - protein, 56 aa, Artificial Sequence
  Synthetic sequence.
IRKVVEEARRLLERVHRNTKRVADEIRKLDKRSSELLDKILKDLRKLLEDVEREAR

SEQ ID NO: 4404 - protein, 63 aa, Artificial Sequence
  Synthetic sequence.
DEKDEVRRRVDRELEDVHRETKKSSDDDKRLLEDVHRKLKESEKEVRRIADEVRKKLEDVRRR

SEQ ID NO: 4405 - protein, 55 aa, Artificial Sequence
  Synthetic sequence.
REVLEKIKRSLDENKERVEKSKKDSDDSLRENKDRVDKTDEEAKEMIKDLKRKTD

SEQ ID NO: 4406 - protein, 63 aa, Artificial Sequence
  Synthetic sequence.
DEKEKVTREVRRILEEVDKRLEESRERVERIAEEVHRRTEESHRRDEEVVERVKEELKEARRD

SEQ ID NO: 4407 - protein, 55 aa, Artificial Sequence
  Synthetic sequence.
REVLEELKRELRRLEEDVRRTDRKLEESLKDNERKVRRSKEESDRLLRELEERTR

SEQ ID NO: 4408 - protein, 63 aa, Artificial Sequence
  Synthetic sequence.
KEVEDVRRRVEKILEEVHKKTREVTERVRRILEEVHRKTEESHRRDEEVMRRVRDELEKARRR

SEQ ID NO: 4409 - protein, 55 aa, Artificial Sequence
  Synthetic sequence.
REVIEKVKESLRENERRARKVEKEIRDSLERNRERVEDSKRTSKKLIEDLREAVR

SEQ ID NO: 4410 - protein, 63 aa, Artificial Sequence
  Synthetic sequence.
DEEKELVRELRDILKKVHKETKESSDTDREVLKRVHEDTERSHRDDERVVEEVKKELDKIRDR

SEQ ID NO: 4411 - protein, 55 aa, Artificial Sequence
  Synthetic sequence.
REVEDEVRRSLEDNRRRVEESKRRSDESLRRNKRKVERSKEESDRLLKELEDEVR

SEQ ID NO: 4412 - protein, 57 aa, Artificial Sequence
  Synthetic sequence.
REVEEALKRNEAVVEESREAVERALRENETMVRESEKEAKRVKDENRKSIEELKRSN

SEQ ID NO: 4413 - protein, 59 aa, Artificial Sequence
  Synthetic sequence.
EEVLERVVRKLKELDDKSREDLEKVKKELRDVDTRSEELLREVEKRLREVDDRLRREEE

SEQ ID NO: 4414 - protein, 57 aa, Artificial Sequence
  Synthetic sequence.
SEVEEVEKENKKMVEESERELEKLERENDKLLKESEDEARKVEEELKRVVEELDRSN

SEQ ID NO: 4415 - protein, 59 aa, Artificial Sequence
  Synthetic sequence.
EEVLREVVKDLRRVDKESKERLKRMADKLRDVDRELKEKLKRALEDLRRIVTELRERAR

SEQ ID NO: 4416 - protein, 60 aa, Artificial Sequence
  Synthetic sequence.
DEVETVTRELEDTNRDIEKKVEEVERELRKTDREIREKVKRVEEELTRSDRELAEIVKKK

SEQ ID NO: 4417 - protein, 59 aa, Artificial Sequence
  Synthetic sequence.
GEDVKRIVEKARKINEDVRREIEKITEEVRRINEEVDDRIRRIAEEARRINEKVKRRLT

SEQ ID NO: 4418 - protein, 60 aa, Artificial Sequence
  Synthetic sequence.
KEVDDVAEELRRTNKEIKDRVKDVLRELEELLTDIEKTVRDVERELRESDERLEREVRRK

SEQ ID NO: 4419 - protein, 59 aa, Artificial Sequence
  Synthetic sequence.
GEEVRRIVEKARKINTEVKKKIEEIEKTVRKILKEVRKIIKDIRDEARRINEEVRKKLE

SEQ ID NO: 4420 - protein, 56 aa, Artificial Sequence
  Synthetic sequence.
KEVEDIVRELEEEVEKIRDHSRRVSEELDKSVKDNKRRVDEVKKTLEKSVRDIRRK

SEQ ID NO: 4421 - protein, 58 aa, Artificial Sequence
  Synthetic sequence.
EVLKDVARRAREMLEEVRRKDRENTERARRLLEEVHRRTEEVERRAREVLKKADEDVK

SEQ ID NO: 4422 - protein, 60 aa, Artificial Sequence
  Synthetic sequence.
SELDELRKRVRDLDERLKESDDTLRKLVKELIERVKKSDTELERLVERVIEEIERVLRDR

SEQ ID NO: 4423 - protein, 60 aa, Artificial Sequence
  Synthetic sequence.
VKDRLRELEEELRKRMKESDERNRDLRRRLEEMIKDSKRTNDELKKRVEKVAREAEEKLR

SEQ ID NO: 4424 - protein, 60 aa, Artificial Sequence
  Synthetic sequence.
DELERLEEEVEEVRRRLEKSDDDLRKLVDEVERRLRESDKRLHDLSEEVIRRIEDVLRKN

SEQ ID NO: 4425 - protein, 60 aa, Artificial Sequence
  Synthetic sequence.
VKDELRKLKEKIKKVADESRRRNEELRRKVDKVIKDSRETNKRNTEEVRKVAKDVDDTVK

SEQ ID NO: 4426 - protein, 60 aa, Artificial Sequence
  Synthetic sequence.
SEEERIAKEAEDLVRRVKENNARTIKEAREVARKVEAETKKIHDDARKLVEDVKRKVERR

SEQ ID NO: 4427 - protein, 55 aa, Artificial Sequence
  Synthetic sequence.
RELKERLERVIKEIEETIRRSARELDEVNRRNEKMVKENEDELRKVIEEIERRIR

SEQ ID NO: 4428 - protein, 58 aa, Artificial Sequence
  Synthetic sequence.
DEEEEIKKELRRVAEDVKRETKRIHEEIRRVLKEVKERLKRVHDELRRVAREVKEKLK

SEQ ID NO: 4429 - protein, 55 aa, Artificial Sequence
  Synthetic sequence.
RELTEEAKKLIKENEEEIERNEREARKVIEELERVVRTNKEDVKRVEKEIEDATR

SEQ ID NO: 4430 - protein, 58 aa, Artificial Sequence
  Synthetic sequence.
KEVEEIAKEAEDVLRRLDETVKEIADEAREVLRRLNESSKRIEEEARKAIKELRDRAR

SEQ ID NO: 4431 - protein, 59 aa, Artificial Sequence
  Synthetic sequence.
KDELRKILKEVRDVLEEVKRRNEDILRRLRKIAEEVKRRNDKIREELERVLKEAEDRLR

SEQ ID NO: 4432 - protein, 55 aa, Artificial Sequence
  Synthetic sequence.
SRLEKIKDDVKRLDDDSRRTLEEVHRRNKETARRVERLLEEAHRLNKKTVDEARS

SEQ ID NO: 4433 - protein, 58 aa, Artificial Sequence
  Synthetic sequence.
DEIRKIKTDVKEMVKKNREDVKRNNEDVKRVEDKLRKELKKNDDDVRRVLEELERRLR

SEQ ID NO: 4434 - protein, 60 aa, Artificial Sequence
  Synthetic sequence.
SEIEEVTRRLEELVKTVREVLREAHERTRRLVEKVRKLIEDVIRTNRKIKERVRELLERV

SEQ ID NO: 4435 - protein, 58 aa, Artificial Sequence
  Synthetic sequence.
DEIRKLRRRVEEVVRELEEELEKDRREVEKVIEELEREVDRSNEETRRVVKRLREEVE

SEQ ID NO: 4436 - protein, 60 aa, Artificial Sequence
  Synthetic sequence.
REKEEVRRKLREAERRVEEIDRRLEKLIRDVKRRVEEADRESEETSDRVRKEVERVDRRG

SEQ ID NO: 4437 - protein, 55 aa, Artificial Sequence
  Synthetic sequence.
EEVKERLKKVLEDNRRSIDELRRRIEEVLKENKRTVEEDKKRLEKVLEDVERRAR

SEQ ID NO: 4438 - protein, 56 aa, Artificial Sequence
  Synthetic sequence.
SDTEEVEKLTEEIVREVKRLDEEVKELIKEIRKESRRTLEEVRRLIEEVRDRVEKI

SEQ ID NO: 4439 - protein, 59 aa, Artificial Sequence
  Synthetic sequence.
SKDLERLRRELEEVLKENADSIRKLETELRDVLRRTREEAEKLKEELKDVLRRVEEKAK

SEQ ID NO: 4440 - protein, 60 aa, Artificial Sequence
  Synthetic sequence.
DEERKIREEAKRADDEIRRLLEENKRALDESNKRAEELVKRLADEVREALKRIEDLLRER

SEQ ID NO: 4441 - protein, 56 aa, Artificial Sequence
  Synthetic sequence.
VKKVVERLRRLIKEVKKRLEKIHEDSRRMVEESEKLLKEIVRKLRELIKEVEDKVK

SEQ ID NO: 4442 - protein, 60 aa, Artificial Sequence
  Synthetic sequence.
DEKEDLKRTAEESDREAKKLLDENRKRLEESNKKAEDLVRRNEETLRKVDTDIKDLLRKR

SEQ ID NO: 4443 - protein, 56 aa, Artificial Sequence
  Synthetic sequence.
VKKVLDELRRLVEESKELLKRIHDESEKMVEDSERLLEEVHRRSREVVERVREKIR

SEQ ID NO: 4444 - protein, 60 aa, Artificial Sequence
  Synthetic sequence.
SEKDRLSKRAAESDEELERLVRRNAEELDRSNKEIADLLKESKDTLKRAEDEIRRLLAER

SEQ ID NO: 4445 - protein, 56 aa, Artificial Sequence
  Synthetic sequence.
VEKVLKELEDVVKKSKELLERIHKESKEMVERSKRNNEKSLEDVRRLIERVLEKLK

SEQ ID NO: 4446 - protein, 60 aa, Artificial Sequence
  Synthetic sequence.
DEKRRLKEEAKKSDDELRKLVKDSADRLEDATRRIEELLRENAKRLEEAEKRIREELDKR

SEQ ID NO: 4447 - protein, 56 aa, Artificial Sequence
  Synthetic sequence.
VEEVLRRLKDLVERSKENNKRSLEEVERLIKEVEERLKRIHDESEKVVRTVEERLK

SEQ ID NO: 4448 - protein, 60 aa, Artificial Sequence
  Synthetic sequence.
REAEEIKKRLERVREEVEKELERIHRETDKIAKDVKRELDEIDKESKKVAEEIKKVAEEI

SEQ ID NO: 4449 - protein, 57 aa, Artificial Sequence
  Synthetic sequence.
KVDELKRRVEEVKRDLERKVRENNETIKKVKEDLRREVERNHKTIEDIKRELDERVR

SEQ ID NO: 4450 - protein, 60 aa, Artificial Sequence
  Synthetic sequence.
SEAEELLDRIRRVAEEVKRRLEEIHRTTRDIVRRIEELLKEIHERTREIVERIKRVLEKI

SEQ ID NO: 4451 - protein, 58 aa, Artificial Sequence
  Synthetic sequence.
DKVKRLEEEIRKIKRELEKIVRDNNEDIKRAKERLRKINKRNHDEIKKVKDELDETVR

SEQ ID NO: 4452 - protein, 60 aa, Artificial Sequence
  Synthetic sequence.
SEAEDLRRRIEEVARRVAEKLKKINRDTERIVRDVKKKLEEIHKRTEEVAEEVKEVLRRI

SEQ ID NO: 4453 - protein, 58 aa, Artificial Sequence
  Synthetic sequence.
DEVEELRKTIEDIRRRLEEEVRRNHDEIRKAEEELRELNRRNHERIKEIKEELDREVT

SEQ ID NO: 4454 - protein, 60 aa, Artificial Sequence
  Synthetic sequence.
SEVEKIDKRAKEVEKELEESNRRNRERIKEADERLRDLLRRNKEEIDRARKRLDEIVRRD

SEQ ID NO: 4455 - protein, 59 aa, Artificial Sequence
  Synthetic sequence.
KKRLKEVERRMEEIVKTVKKRSEDSHRESDEIVKRVLERLRKVHEETKEIVKRVEDRLR

SEQ ID NO: 4456 - protein, 60 aa, Artificial Sequence
  Synthetic sequence.
EEAERIDKKLEDEVREVERELEDVHRKVKEILEDVKRKHKKVHDELKKVIDEVKRKLEER

SEQ ID NO: 4457 - protein, 55 aa, Artificial Sequence
  Synthetic sequence.
KELEEKVRRIVRKLERRVEKNKDDTRRAVEEAEKLNEDNKRTSEKVEEDLRRTTT

SEQ ID NO: 4458 - protein, 60 aa, Artificial Sequence
  Synthetic sequence.
SEAEEIVRELRKAVEDVAREHKRIHEEVRKAAEDVKRKLKEILDRLERVVEEVARALEER

SEQ ID NO: 4459 - protein, 55 aa, Artificial Sequence
  Synthetic sequence.
DELREEAKEVVRDVRRLNEENRKATEDILRELKEIVERLERRAREVVKELKERAR

SEQ ID NO: 4460 - protein, 60 aa, Artificial Sequence
  Synthetic sequence.
DEREEIRRRLREDVKRVKRRLEEIHDEVRRLLEEVDRRLRKVHKELKEEVTEVEKRLRER

SEQ ID NO: 4461 - protein, 55 aa, Artificial Sequence
  Synthetic sequence.
RELKKEIDDVRKELEETVERNKRETERALRKAKEDLDRNREEVKRVVDELEKRTR

SEQ ID NO: 4462 - protein, 60 aa, Artificial Sequence
  Synthetic sequence.
SEKDEIRDELEKILRRVEELNRRIRKKLEEIRKEVERLLREIHEKLEEVVKEVEEKLRER

SEQ ID NO: 4463 - protein, 55 aa, Artificial Sequence
  Synthetic sequence.
EELKRRVEEVLKRARESLRELEEDVRRVLEEARKELERNRERVERVLRRLEETVR

SEQ ID NO: 4464 - protein, 59 aa, Artificial Sequence
  Synthetic sequence.
DEVEDLERRLKEVVDRSRRLDEELKRRDKKSVEDVRRKLEEVRKKLEDVARKLADLLRQ

SEQ ID NO: 4465 - protein, 55 aa, Artificial Sequence
  Synthetic sequence.
EKLERDVARAREENDRTLKEISKHSEKVLREVADMARKLRKEVKRIEDEIRERAR

SEQ ID NO: 4466 - protein, 60 aa, Artificial Sequence
  Synthetic sequence.
KLVEEVKREIEELVRRLEEVLDRVRRENERLAEELKKVVKDVEDNNERIARTVTELLKKV

SEQ ID NO: 4467 - protein, 59 aa, Artificial Sequence
  Synthetic sequence.
KEKVDELKRDVDRAEEKVRELIERIKRRSEEVKKRAEELLKKLEDDSRRVKKKLDDDAR

SEQ ID NO: 4468 - protein, 60 aa, Artificial Sequence
  Synthetic sequence.
SEVDEVRKEIKRLADEAREVVKEVRKNNEKIADDSRKLNERSIRESKKVTDTVRELLKRV

SEQ ID NO: 4469 - protein, 59 aa, Artificial Sequence
  Synthetic sequence.
EERVKELKERVDEVSKELRDLLKKLRDDSERVVEENEKLLRELKERSDRATKELDDASK

SEQ ID NO: 4470 - protein, 60 aa, Artificial Sequence
  Synthetic sequence.
KKAEKVDKEIEDLAREVREVLKEVEKDSDRLVKEVEDVLRRVKENNEDIRRRVSELDRRV

SEQ ID NO: 4471 - protein, 59 aa, Artificial Sequence
  Synthetic sequence.
EESVERLRRKVKEIEDELRELLERLRKKSEDAKRKLRELLERIKRDSERAKRELEERDK

SEQ ID NO: 4472 - protein, 59 aa, Artificial Sequence
  Synthetic sequence.
DTAREVKRKVKEIADEVRELIRRVHEETKKTSETVKKLIKEVHDTTEKIVREVRKLADE

SEQ ID NO: 4473 - protein, 59 aa, Artificial Sequence
  Synthetic sequence.
KKLVEELKREVDRISEELKRLLERNEREVRESKKTLERDLERNHEEIERAKRELDERVR

SEQ ID NO: 4474 - protein, 60 aa, Artificial Sequence
  Synthetic sequence.
REVDEVRKRVEKVAEEVRRLIEKVHRETERTSREVEKRIRDVHRRSDEVAREVDDLSRRV

SEQ ID NO: 4475 - protein, 59 aa, Artificial Sequence
  Synthetic sequence.
KKMVRTLAERVKEISEELKRRLKRNKDEVEESSRRLRELLKRNHDEIRRIKEKLKEETR

SEQ ID NO: 4476 - protein, 60 aa, Artificial Sequence
  Synthetic sequence.
EEVDRVKRKLEEVEKRVTEISKRTEELVEEVRKEVERISKRTEEDDRRVAKEVRERLKSG

SEQ ID NO: 4477 - protein, 56 aa, Artificial Sequence
  Synthetic sequence.
AKEIKEKVDEVIERLRRSNRKLHERIREVEKKLRELNERLHRHSREVIKELEERAR

SEQ ID NO: 4478 - protein, 60 aa, Artificial Sequence
  Synthetic sequence.
KEVEDILRDLERLSEESLRRNEEIHRELEELLRRVDEKNREIHKTLEEMVRRALTELRKR

SEQ ID NO: 4479 - protein, 59 aa, Artificial Sequence
  Synthetic sequence.
EKVVREVDRRVEESRKRLEKLLRENEKRVRDARRRARKLSEENERTVREVEKRAREEVK

SEQ ID NO: 4480 - protein, 60 aa, Artificial Sequence
  Synthetic sequence.
DEVEEIKRKLDKVADESRKLDEDIRDKLRRVADEIRRLHEESRKELEDVVREIERLLRER

SEQ ID NO: 4481 - protein, 59 aa, Artificial Sequence
  Synthetic sequence.
EKVIKEVRDTVEKILRENEKSLEEVRKTVKRIEEESRELLETSRDEVRRVLEKAEETEK

SEQ ID NO: 4482 - protein, 60 aa, Artificial Sequence
  Synthetic sequence.
SVADEIRKDLKRVADEVEERLRRLLEHNKKVRDEVKERVDESKKELKEVEEEVTEKLERI

SEQ ID NO: 4483 - protein, 59 aa, Artificial Sequence
  Synthetic sequence.
EKVVREIEERIRRVIRRLDEVDKTNEKISRDAARELEESDEELRRRVKEVKDRLDEKTK

SEQ ID NO: 4484 - protein, 60 aa, Artificial Sequence
  Synthetic sequence.
DEAEKIKKELDDVAREVERRLKELLDDNRRVAEEVEKRLRDSKRELEEVTRRVRKELERI

SEQ ID NO: 4485 - protein, 59 aa, Artificial Sequence
  Synthetic sequence.
KKLVDKIRDDIRRIARRLDEMNKKNKKLSDELEERLKKSNEEHRRRVEKVKEELEKKVE

SEQ ID NO: 4486 - protein, 60 aa, Artificial Sequence
  Synthetic sequence.
SEAEEIEKELREVAKEVRELMREMLKNNKEVAEEVKRRLERSRERLEEVEETVRDLLEKI

SEQ ID NO: 4487 - protein, 59 aa, Artificial Sequence
  Synthetic sequence.
DKVVKKIEDDIREVEKEARKLNRENRELSKKLAEELDRSNDRHRREVERVERELEKAER

SEQ ID NO: 4488 - protein, 60 aa, Artificial Sequence
  Synthetic sequence.
SLQERVRDKVRKVKKDLEDLNRRHREEIERVVRELDKSNEDHEREVRRVEKELEELIRRN

SEQ ID NO: 4489 - protein, 59 aa, Artificial Sequence
  Synthetic sequence.
KKFVEDVDRALKRIADEVKRRSEESKKELDDIKKEVEERLRESKEKLKRIVDEARERLR

SEQ ID NO: 4490 - protein, 57 aa, Artificial Sequence
  Synthetic sequence.
SELEEVIKRAEDELRDDERENKRVLEKSDRDIKRWEEEVKRVLKKARDELDKLRKEG

SEQ ID NO: 4491 - protein, 59 aa, Artificial Sequence
  Synthetic sequence.
KDVVEKLREELEKVLKESRDESKRLKEELDKVNDDARKRLEDLMRKLERVLEEVRRRRK

SEQ ID NO: 4492 - protein, 56 aa, Artificial Sequence
  Synthetic sequence.
SELERVIEEIRRALEEDHERNRDVLREAKEELERDKRRNDKVLTDIRKLVKDLERK

SEQ ID NO: 4493 - protein, 59 aa, Artificial Sequence
  Synthetic sequence.
EETVRRLTEELRKVLDEVTKRSKELSDRLREVLRRSKELSKELEKELRKVIKEADDRVK

SEQ ID NO: 4494 - protein, 56 aa, Artificial Sequence
  Synthetic sequence.
SEIERVLKEARDELRKDEEKNRDLLRRAKKVIEEDHKRNRDVLRRVKEELDRLREA

SEQ ID NO: 4495 - protein, 59 aa, Artificial Sequence
  Synthetic sequence.
KDALDRLRRELEEVLRRSKEESDRLAEELKRVLREIEERSRRLAKELKEVLDTAKRDKD

SEQ ID NO: 4496 - protein, 57 aa, Artificial Sequence
  Synthetic sequence.
SELERVIRENERTIREDMKKNEDVLREWEKLTRDLEDTIRRVLKKNRESLKRLKDKG

SEQ ID NO: 4497 - protein, 56 aa, Artificial Sequence
  Synthetic sequence.
RRELVKRLRDVDERSDDTSRKLKEELERVIRRTEELIRRVMEDAKRVDDEARKKTD

SEQ ID NO: 4498 - protein, 56 aa, Artificial Sequence
  Synthetic sequence.
SKVEEVLRELERRVKEDEDENRKVVRENERTVKEDEDTNRDALRRNEESIDKLRRD

SEQ ID NO: 4499 - protein, 56 aa, Artificial Sequence
  Synthetic sequence.
VDTLKRELDEALKRSEEESRRLKEEVTRIDERSKRESDRLVEEAKRLDKEAKDRSD

SEQ ID NO: 4500 - protein, 60 aa, Artificial Sequence
  Synthetic sequence.
SELEEVLKKAAEVIKEIEKRLRKVLEDSRRLTKEDEKRNKEVLKKLKEKIDEIEKRARDK

SEQ ID NO: 4501 - protein, 59 aa, Artificial Sequence
  Synthetic sequence.
DEVLRRLDRELKEVLDRVEREVERLKEENDRMNKKSKDDSEKLERDLERVAERLERELK

SEQ ID NO: 4502 - protein, 61 aa, Artificial Sequence
  Synthetic sequence.
SEAEKVLKEAREAAKRIEDEARKVLRESRELAKKAEEDDRRALKRAKEAAEKIKRDADRKG

SEQ ID NO: 4503 - protein, 59 aa, Artificial Sequence
  Synthetic sequence.
DKAIKEAADRLKKVLEDAEKKAREAAEENKRANEEWKKKSKRAAEEAKKVLDEAKKELD

SEQ ID NO: 4504 - protein, 59 aa, Artificial Sequence
  Synthetic sequence.
SDKERIKERVKKVHKESAKHIEDVRRRNEEINKRIKEEIDDVERRNREINEDIRRLVRE

SEQ ID NO: 4505 - protein, 55 aa, Artificial Sequence
  Synthetic sequence.
ERVIEDLERLIEENKRTLTEVIKRHRELLEDWKRRLDEVLKDHERSAREIDEEAR

SEQ ID NO: 4506 - protein, 60 aa, Artificial Sequence
  Synthetic sequence.
DEKEEVRRTVEERLKRVEDRVRELEKENEDINRELKERLKKVRRENEEINERLKKLLDEN

SEQ ID NO: 4507 - protein, 55 aa, Artificial Sequence
  Synthetic sequence.
EEVIRRVEEEIKRIEKRLRDVIKKHEDSVRKIRTDMERVVRDHERLAKKWEDDAR

SEQ ID NO: 4508 - protein, 59 aa, Artificial Sequence
  Synthetic sequence.
DEAKEIEDRVRTEIRDIERKVREARERSKRSDDELKKHSEEVARELEEILRELEEALRR

SEQ ID NO: 4509 - protein, 55 aa, Artificial Sequence
  Synthetic sequence.
KSVIDEVRKAVEDIARKLKKVLEDNKREIDKDRKRNEEVLRTAREKAEKIKEDAR

SEQ ID NO: 4510 - protein, 59 aa, Artificial Sequence
  Synthetic sequence.
DEKEKIKEDVRRVIRRIEEIVKRVDRESERSDRELEKHSRDVERRLREINDRLRRLLEE

SEQ ID NO: 4511 - protein, 55 aa, Artificial Sequence
  Synthetic sequence.
ERVIEEVKRLIDRIREELERVLEKNARLAKEDEERNERVLTENRKLIEDWEREAK

SEQ ID NO: 4512 - protein, 61 aa, Artificial Sequence
  Synthetic sequence.
SKLEEVVRRVDKDARDIRRRNEEVKRRNEKSAREIEKKVKKVLEEFRRLVEEIRKRLEEEG

SEQ ID NO: 4513 - protein, 59 aa, Artificial Sequence
  Synthetic sequence.
ERVLKELEERVRKVLKDNRDTSKELEERVRRIDEELDKTLRKAKEELRKIIRELEERLR

SEQ ID NO: 4514 - protein, 61 aa, Artificial Sequence
  Synthetic sequence.
SELEKVLERVKREAERIEKKNKKVLEENKKSAEEIHRDNERVLREVKDMADKIEDELRKRG

SEQ ID NO: 4515 - protein, 59 aa, Artificial Sequence
  Synthetic sequence.
RKVLRDVERRVKKILDDNKRTSDEMKKRLDRLDETNKRTSEKLEEDVRRIIEDLERRVK

SEQ ID NO: 4516 - protein, 60 aa, Artificial Sequence
  Synthetic sequence.
SKLEEVLKKLERLAREIERRLRDVIRRNKESADRIRKRNEEVLRKVEDVAREIEDKVRRG

SEQ ID NO: 4517 - protein, 59 aa, Artificial Sequence
  Synthetic sequence.
EEALRTLDKRVEDIIKRLKEEVDRVVRDLEELDKENEKSSREVEERLKEIIRELEETLK

SEQ ID NO: 4518 - protein, 61 aa, Artificial Sequence
  Synthetic sequence.
SKLEEVLKTLRRLIEEIKKRLKKVKDDNKKSLEDIHRKNKRVLEELEKRLRDIDKKLKDKG

SEQ ID NO: 4519 - protein, 57 aa, Artificial Sequence
  Synthetic sequence.
VLKEVEERVERIIRELRRRVEELKRRVEELDRRNEKTSDDLEEELKRIDKELKDRTD

SEQ ID NO: 4520 - protein, 60 aa, Artificial Sequence
  Synthetic sequence.
SKVEDVVRRVAEVAERIRRRNEEVAEENERSLKEIHDENKEVVERARKMAKRIEDEVRRK

SEQ ID NO: 4521 - protein, 59 aa, Artificial Sequence
  Synthetic sequence.
EEVLKTVADEVREILERNEKTSEELAERVRRLDEENRRTSREVEKRVEEVIEDLKRRLK

SEQ ID NO: 4522 - protein, 61 aa, Artificial Sequence
  Synthetic sequence.
SEVDKLEEDLRRIIKEIRRLVEEVKRKSEEIDRELKRLLEEAERTLEEIDRKLEDELRKKG

SEQ ID NO: 4523 - protein, 58 aa, Artificial Sequence
  Synthetic sequence.
DKVREVKKDVEKKLKELEEELRDITRRNRESLKRLEERLKEVAKKNRKTVDELRKELD

SEQ ID NO: 4524 - protein, 61 aa, Artificial Sequence
  Synthetic sequence.
DEVDDLKRRLEKIITEDEKLVKEVKDRSEKLDREIAKLLEDARRALEKLDKELEEILRKKG

SEQ ID NO: 4525 - protein, 58 aa, Artificial Sequence
  Synthetic sequence.
DKVREVVKRVRDEADKSRRKLEEITRRNRDSLERIKRKLERVLEENDRTLRELEERAR

SEQ ID NO: 4526 - protein, 58 aa, Artificial Sequence
  Synthetic sequence.
SELEKVVEDSRRKLDAWDDESRRVAEESRRRLEEWRKRLEEVAKRVEERLRDLKRKAG

SEQ ID NO: 4527 - protein, 59 aa, Artificial Sequence
  Synthetic sequence.
EELVKKMARELDELNKDLDRLNKESKRELERLNTELAELIKEVERELRELLRKLEEDLR

SEQ ID NO: 4528 - protein, 58 aa, Artificial Sequence
  Synthetic sequence.
DSLEDVVRRVKKKLDDNRKDVERVAKESEELLKRWRDRVKKVVRDVERRAEELRRRRG

SEQ ID NO: 4529 - protein, 59 aa, Artificial Sequence
  Synthetic sequence.
EELIKTFERTLEELHKTNKKLNEEVKKRLEELNTRLAKLIEDVRKELEKVLKELEDRAR

SEQ ID NO: 4530 - protein, 58 aa, Artificial Sequence
  Synthetic sequence.
DELDEVVREVKDRLRENKEEVKRVMDESRRLLERWNEESERVAKKVEEAVRKLTKDKG

SEQ ID NO: 4531 - protein, 59 aa, Artificial Sequence
  Synthetic sequence.
EDDIRRITKRLRDLHRENEKLNRDVKKELRELNERLAKLNRDSTRELEELLRKLEEDAR

SEQ ID NO: 4532 - protein, 58 aa, Artificial Sequence
  Synthetic sequence.
SELDKVVEESKRLLEEWDRRSKDVAKKVKEMLDRSRKASKEVVKEARDELERLKRETG

SEQ ID NO: 4533 - protein, 59 aa, Artificial Sequence
  Synthetic sequence.
EKDIREIKERLKRLNETLAELNERSKKRLKRLLDEDKKLNDDSSKELKELLKELEDRTR

SEQ ID NO: 4534 - protein, 58 aa, Artificial Sequence
  Synthetic sequence.
RELEDVARRARKKLEDNKRRVEEVAEEVERRLDESRKESDKVVREVEEVLKRLKEERG

SEQ ID NO: 4535 - protein, 59 aa, Artificial Sequence
  Synthetic sequence.
EELVKRMTEELERVHRENEKLNRDVRRELEDILRKDEELNKRSKKRLKDLLDELRRRLT

SEQ ID NO: 4536 - protein, 58 aa, Artificial Sequence
  Synthetic sequence.
SELEEVVKKVRTDLDRIDEKSKRVAKEVDRVLKESEDRSKKVAREVEEVLRKLKEEAG

SEQ ID NO: 4537 - protein, 59 aa, Artificial Sequence
  Synthetic sequence.
EDLVRRAVETLERLIRELEKLNDESKRRLEEILREDKRLNKESTEELRRLLEELRKTLT

SEQ ID NO: 4538 - protein, 58 aa, Artificial Sequence
  Synthetic sequence.
SEVERVAEELKRVLKELEDLDRESEKKLKRLNEELARLIEEVRRRLEEVLRTLEELAK

SEQ ID NO: 4539 - protein, 58 aa, Artificial Sequence
  Synthetic sequence.
REVEEVIRRIDEAIKRIEKHSREVIERSRERVEDWRRKVERVIEEVERRARKLREDTR

SEQ ID NO: 4540 - protein, 58 aa, Artificial Sequence
  Synthetic sequence.
SEVEKVAEEAKRVLDELEKLDRDSAKELKDLNDELRKRDKESEDALRKITRDLDELDK

SEQ ID NO: 4541 - protein, 58 aa, Artificial Sequence
  Synthetic sequence.
KDVEKVIRDLKRELERLAKHSEEVIRTSEELLKRWEDHSRKVIEEVKERARDIKRRTK

SEQ ID NO: 4542 - protein, 57 aa, Artificial Sequence
  Synthetic sequence.
SELEKVVKEVEEALERNNRENRRVIRRSRELLKRWREEVEEVVRRLRERAKKIADDV

SEQ ID NO: 4543 - protein, 59 aa, Artificial Sequence
  Synthetic sequence.
EEEVRKLEEDLRRILEEIDRESDRLVKRIEDLNRRVAELLKRVEEELEDLARKVEEEAK

SEQ ID NO: 4544 - protein, 60 aa, Artificial Sequence
  Synthetic sequence.
SIEEIVEEIERELEKLKRKLDELIKRSEELSRRLAEKTRRSNEEIKREIDKVADDIRKTL

SEQ ID NO: 4545 - protein, 59 aa, Artificial Sequence
  Synthetic sequence.
EDTIRRVLEEAREEIKKLERDVDKVRKEVEDAHRKNSELNKTVHDEVRKIIDEIRKEVK

SEQ ID NO: 4546 - protein, 60 aa, Artificial Sequence
  Synthetic sequence.
SIEEILREIEELIKDLLRKAEELLKESEKRSKELKDEMKRSNEEIRKLIEDLRRRAKDRV

SEQ ID NO: 4547 - protein, 59 aa, Artificial Sequence
  Synthetic sequence.
EDVIRDLLRRVREDIDRLRKELEKVVRELRRIHEEVRRDLKRVHEEVRKRIEDLEEELK

SEQ ID NO: 4548 - protein, 60 aa, Artificial Sequence
  Synthetic sequence.
KEVEDVVRRVRKLIEDNERRNKEVHEEVEKRARENVERNRELLEKIRRTVEEIRRELEEL

SEQ ID NO: 4549 - protein, 56 aa, Artificial Sequence
  Synthetic sequence.
KDLLDEVRRLLERVKRRTEESNRRVKKIVDDVKRTSEEILREVEELLRRLIDDARK

SEQ ID NO: 4550 - protein, 61 aa, Artificial Sequence
  Synthetic sequence.
DEVEKVFREVKKRIDENREKNRRVHEKVEREARRNSEENRRVHEEVRKTVEDIRRELDEKR

SEQ ID NO: 4551 - protein, 56 aa, Artificial Sequence
  Synthetic sequence.
EELLRRIEKLAREVRDETRRSNEKVKEIIRRVEKESEDSNREVKRLLDELTRDARR

SEQ ID NO: 4552 - protein, 60 aa, Artificial Sequence
  Synthetic sequence.
SEVEDVVRKAREILKRNEDENRRVLEKVREDLKRLTDENDKVVEDVREMVRRIKEMLDRN

SEQ ID NO: 4553 - protein, 56 aa, Artificial Sequence
  Synthetic sequence.
EELLREVDERIKDVKRKTDEILREVRERIKRNEERTERLRREIEELARRLLEDAER

SEQ ID NO: 4554 - protein, 59 aa, Artificial Sequence
  Synthetic sequence.
DEEDLLEKIERILEEVKRRLEDVIRRVRKSNEDIERELKKAVDRSRELLRKVEEDLRRN

SEQ ID NO: 4555 - protein, 55 aa, Artificial Sequence
  Synthetic sequence.
RDVFERLERIARRLTEEIEKALRDSDKLNEELKRKVEEVLRRSEESIRTVLEELR

SEQ ID NO: 4556 - protein, 60 aa, Artificial Sequence
  Synthetic sequence.
DEIEKVRKDVDEIIRRLEEELEEVAKRLEDLNREIERILREVKKESDDTIRTIERLRKEG

SEQ ID NO: 4557 - protein, 56 aa, Artificial Sequence
  Synthetic sequence.
ESIVKEVRDKLRRLEKRLDDLAKRNEESLRELKRTLEEIIKRSRKENKRIEDEVRK

SEQ ID NO: 4558 - protein, 60 aa, Artificial Sequence
  Synthetic sequence.
SEVEEVEKELRELIREDKERLDRLRKELKESIDTNKEKLDRVKEDLERLIEEIREEARRR

SEQ ID NO: 4559 - protein, 59 aa, Artificial Sequence
  Synthetic sequence.
RERLTKLVEKIREVLERSKEHSERVAKKIRDELDKLHKETERVDRKLKTEARRLKEELR

SEQ ID NO: 4560 - protein, 60 aa, Artificial Sequence
  Synthetic sequence.
DEVERVEEELKESIDRNDEELRRVRKENRESIEKDRRDLKRVEDDLRRLIKKIDEEVRRR

SEQ ID NO: 4561 - protein, 59 aa, Artificial Sequence
  Synthetic sequence.
EEALREVVRKLRKLLKELHEETKRVMEKLRKLDRESEEHTKEVDERIKKTIEDLERELK

SEQ ID NO: 4562 - protein, 60 aa, Artificial Sequence
  Synthetic sequence.
SEVDEVRKELRKVIKEDEDTMRKLEEENRKSIEEIRKELEKVEEELERVIRRIEDEIRKR

SEQ ID NO: 4563 - protein, 59 aa, Artificial Sequence
  Synthetic sequence.
REVLETLVRKIREELKRSKEHSKRVADDLRRMDEEIRREVKRVVDKVRELLKRLEDELK

SEQ ID NO: 4564 - protein, 60 aa, Artificial Sequence
  Synthetic sequence.
DEVEDVLRRLKELAEEDKTKLKEVEKENKESIKEDRKRLEDVRRELEKLIEEIRREVTER

SEQ ID NO: 4565 - protein, 59 aa, Artificial Sequence
  Synthetic sequence.
EKVLRDVSRRIKEEVEKSKKHSEEVKKELEDADRESKRHTEEVEKKIRELIERLKRETK

SEQ ID NO: 4566 - protein, 61 aa, Artificial Sequence
  Synthetic sequence.
DEIDRLREELKRLIDKDKTDLDRVRKENEESIRDDERKLREVEKELRDLIEEIRRKAKERN

SEQ ID NO: 4567 - protein, 59 aa, Artificial Sequence
  Synthetic sequence.
RRVLEEVARKIRELIRRSEKHSEDVMEKVRRNDERSKRHTEDVTRKIRTEIEKIDRELE

SEQ ID NO: 4568 - protein, 60 aa, Artificial Sequence
  Synthetic sequence.
KEKEDVKKRLDEEAEKNKRTSEEAKRRNRESIRRNKETSKRVKEENRRSFEELDDLLRRG

SEQ ID NO: 4569 - protein, 55 aa, Artificial Sequence
  Synthetic sequence.
KRVEEELDKLMEEIRRHNRESNEELKRLVEEIRKHNRESNEELKKLLEEIERKTE

SEQ ID NO: 4570 - protein, 60 aa, Artificial Sequence
  Synthetic sequence.
DEDKDVEKKLRDIIKRNKETSRDVARRLEEIIKRNKKTSDEVATEVRKLIKEIEDVLRRG

SEQ ID NO: 4571 - protein, 55 aa, Artificial Sequence
  Synthetic sequence.
EKVKEELRRLIEEIKEHNERVLRKLRKLVEEIERTNEDIRRELKELVEDIRRKAK

SEQ ID NO: 4572 - protein, 60 aa, Artificial Sequence
  Synthetic sequence.
SEKEEVRKRLRDKVEDNKRTSKEVADKLRKIIKENKDTSKKVMEDLRRIIEEADELLRRG

SEQ ID NO: 4573 - protein, 55 aa, Artificial Sequence
  Synthetic sequence.
DDVRRELDELVKRIAEENKRVEDELRRLVKEIEDHNEEVKRELKELVKRIEEKTR

SEQ ID NO: 4574 - protein, 60 aa, Artificial Sequence
  Synthetic sequence.
SEKEEVEREVEERLRDNKRTSDKVVEENRDSVRRNKKTSEDVKRENEESVRRIDEVLKRG

SEQ ID NO: 4575 - protein, 55 aa, Artificial Sequence
  Synthetic sequence.
EDVKRKAKRMVEEIRERNRKSNEELKKLAEEIRKHNKDSNKKLKELVDEIRRKAK

SEQ ID NO: 4576 - protein, 60 aa, Artificial Sequence
  Synthetic sequence.
DEERRVREKLKKIIKDNEDTSRKVREDVKKELDDNRRTSEKVARDNERSIEEIKKALERG

SEQ ID NO: 4577 - protein, 55 aa, Artificial Sequence
  Synthetic sequence.
EEVRRELDKLVKEIKERNDEVIEEARERVKRIREKNERSNRKLKKEAKKIEEEAR

SEQ ID NO: 4578 - protein, 60 aa, Artificial Sequence
  Synthetic sequence.
DEDREVERDLKKIIKDNKRTSEEVEKKLRDIIRKNEKTSKEVEKELRDIIRRADELLRRG

SEQ ID NO: 4579 - protein, 55 aa, Artificial Sequence
  Synthetic sequence.
EEVKKDLDRLAEEIKKRNEEVRKDLDDLVRKIEKRNEEVKEELDRLAREIEEKAR

SEQ ID NO: 4580 - protein, 60 aa, Artificial Sequence
  Synthetic sequence.
SEEDEVRRRLRRIIEENRRTSEEVRERLRKIVEDLERTSRDVRRKLREIVERIKEVLTRG

SEQ ID NO: 4581 - protein, 55 aa, Artificial Sequence
  Synthetic sequence.
REVEEELRRLIEEIERRNKEVREELDRLIEKLEDDNRKVHKELRELAKEIKDRAD

SEQ ID NO: 4582 - protein, 60 aa, Artificial Sequence
  Synthetic sequence.
RELEEVVKRIRDILREIHERSEKSAEENRRLIEKAEEDSKRSAKRIREIIREIREEVKRI

SEQ ID NO: 4583 - protein, 62 aa, Artificial Sequence
  Synthetic sequence.
RDVREKLERVAREVEKSNKDNRDHSKRVEEESRELLKKLRKHSEDVAREVKKLLDELREETR

SEQ ID NO: 4584 - protein, 60 aa, Artificial Sequence
  Synthetic sequence.
SELEKVVEDIRRLLRKIHEDSKRSVRKNEELVEELKRLSEKSEREIEELLRRIKELLKRI

SEQ ID NO: 4585 - protein, 62 aa, Artificial Sequence
  Synthetic sequence.
ERVKRKLDDVEREVRKSNEDNRKHSDEVRRKSEDMLEKLRRESERVADRVRKVLKELEDERR

SEQ ID NO: 4586 - protein, 60 aa, Artificial Sequence
  Synthetic sequence.
SELEKLAKEIEEILREAKERSKESAERIRKLVRDLRELSRESEERIRKIETDVKKKIDDI

SEQ ID NO: 4587 - protein, 62 aa, Artificial Sequence
  Synthetic sequence.
REVRRKVEDVERRVTKVLKELEDRSREVEEEVERVLRDLKRHSDEVRREVEEVLRRLTERTK

SEQ ID NO: 4588 - protein, 59 aa, Artificial Sequence
  Synthetic sequence.
SEREKIAEDIRKLVDESRRNLEDVVRRARELAERVRRNLKRVMETLERLAEEIRRIIES

SEQ ID NO: 4589 - protein, 55 aa, Artificial Sequence
  Synthetic sequence.
KDLERELKELLDKHKKDLDDVREEIRRMLETHKEELDRVKKRVEDVLREAAERTR

SEQ ID NO: 4590 - protein, 59 aa, Artificial Sequence
  Synthetic sequence.
DERERIREEVRKLARESKENLKRTEEDLKRRLEEVKRNLERVDEEVERLVRTVAEIVRK

SEQ ID NO: 4591 - protein, 55 aa, Artificial Sequence
  Synthetic sequence.
EELKKEAKKLLKEHRDKVKEIKEDLKRAHEEHRKRLEEVVEKLKRVLRDLAEKVR

SEQ ID NO: 4592 - protein, 59 aa, Artificial Sequence
  Synthetic sequence.
SEREEIVKTLRELVKRVKENLKRVTEEARKLADESRRNLERVAEEIRKIAEEVKRIVER

SEQ ID NO: 4593 - protein, 55 aa, Artificial Sequence
  Synthetic sequence.
KDLEKELEDVHREHKRRLDEVVREMEDLLRKHEDDLRKVKREAEKMLKELTETTK

SEQ ID NO: 4594 - protein, 59 aa, Artificial Sequence
  Synthetic sequence.
SEREEIAERAERLSREVKKKLEDIRREIEELAKRVLDNLRRVLRDVERLIEEVKDIIRR

SEQ ID NO: 4595 - protein, 55 aa, Artificial Sequence
  Synthetic sequence.
KKLKDDLDRADEELERRARKVDEDLKELHERHRRLLEDVRRELERVIKELKEETE

SEQ ID NO: 4596 - protein, 59 aa, Artificial Sequence
  Synthetic sequence.
SDRERIAKRARELSERVKEKLEEILKEVRKISKDMKKRLEDILREAEELSRRIKEIVES

SEQ ID NO: 4597 - protein, 55 aa, Artificial Sequence
  Synthetic sequence.
DELRKELEEVDDELRRKIEEIKKELETMDKELRDRAKEIEKRLEDSNREVEERRR

SEQ ID NO: 4598 - protein, 59 aa, Artificial Sequence
  Synthetic sequence.
SEREEIAKTVRKLSREMKETLKKITEEARRLSEEVKRALKKIVDDLRELMKDVKRIVES

SEQ ID NO: 4599 - protein, 55 aa, Artificial Sequence
  Synthetic sequence.
KDLKKELEDVDRELADTIRRVEEELKKVNEELRKRVEDVREEAERALRELEERVR

SEQ ID NO: 4600 - protein, 59 aa, Artificial Sequence
  Synthetic sequence.
DERERIAEELKKLTEEIRRRVEDVMREAERLAEEIKRKLEDVLEEVRRLSDRIREIIES

SEQ ID NO: 4601 - protein, 55 aa, Artificial Sequence
  Synthetic sequence.
DDLRREAEKVNRKVREDLKRIEDRMRELLKEVEDLLRKIEEEARKSNKELEDRTR

SEQ ID NO: 4602 - protein, 61 aa, Artificial Sequence
  Synthetic sequence.
SEAEKAREDVERAAKESKDKLDEIRKEVEKAARESREEAKRNEKDIKDAAKKLRELARDKK

SEQ ID NO: 4603 - protein, 55 aa, Artificial Sequence
  Synthetic sequence.
RDVLEELRKIAEDDKRRVDKVARELRELAKRDKEEAKKVHDENKKSAKEAEDELR

SEQ ID NO: 4604 - protein, 60 aa, Artificial Sequence
  Synthetic sequence.
SSDETLRRELEKAVEESRRLLEENRKTIEDMVRESKRLLDRNREEIKKLVEELKKLLRDN

SEQ ID NO: 4605 - protein, 55 aa, Artificial Sequence
  Synthetic sequence.
RDVLREIRELLKRDKERLKEVHKRNRESAKRDKDRVKDVHRKNRDSARRVKERLR

SEQ ID NO: 4606 - protein, 60 aa, Artificial Sequence
  Synthetic sequence.
SSDETARKEIEDMVRESKKLLEEIREELDRVVKRLRRELEENEKDIKRLVKRLRDLLREN

SEQ ID NO: 4607 - protein, 55 aa, Artificial Sequence
  Synthetic sequence.
RDVLREIRELAKRDKDTVKKVMEEIRDRLRKLDERIKEVHERNRRSLKDVEDKVR

SEQ ID NO: 4608 - protein, 60 aa, Artificial Sequence
  Synthetic sequence.
DEDREAKRRLDEAVKESRDRLEEIRKEVEKMVRENEELNRRNEEEIRKAVEELRELLRRQ

SEQ ID NO: 4609 - protein, 55 aa, Artificial Sequence
  Synthetic sequence.
RDVLREIEEELTKDRKRVKEVLEELRRIAKRLKERDEESHERNRRSLDKLKKEVK

SEQ ID NO: 4610 - protein, 60 aa, Artificial Sequence
  Synthetic sequence.
SSEDEARKEVDKMAKESEELLRRNEETIRRLVRENEEKNERNRREIERVVRELDRLLKER

SEQ ID NO: 4611 - protein, 55 aa, Artificial Sequence
  Synthetic sequence.
RDVLRELREIAERDKKKVEDVHRENRDSARRLKEEDDDSHRRNRKSMKEVKEDVE

SEQ ID NO: 4612 - protein, 60 aa, Artificial Sequence
  Synthetic sequence.
REIEEVAKRLRKLVKELKERSKESKDRSRKLMTELKKLSKDSLRELRRLLDELRKILKDR

SEQ ID NO: 4613 - protein, 62 aa, Artificial Sequence
  Synthetic sequence.
RDVKKKLDEIRREVKKVIEEDKRLNDESEKDSRRLIREDEDENRRIKEEIDRAVEELRRRRK

SEQ ID NO: 4614 - protein, 60 aa, Artificial Sequence
  Synthetic sequence.
SDIERVLEELRRLVERLKRETERFAKELRDLARRVKEMSKRSEEELRELATRLKDTLRRR

SEQ ID NO: 4615 - protein, 62 aa, Artificial Sequence
  Synthetic sequence.
RDVEEKLRRIKRELREVIKEDEKRNREIEREVDKVIRELEKLNKRIEDEVRKLEEELERRLK

SEQ ID NO: 4616 - protein, 60 aa, Artificial Sequence
  Synthetic sequence.
SDIERMRDRLRKLVEEAREKSDRSREELEKLVRELRRKTEKFLKELRDLARRLKETLKRR

SEQ ID NO: 4617 - protein, 62 aa, Artificial Sequence
  Synthetic sequence.
RDVKEKLDRIRKEVEEVARDLKRKNDEIEEEIKKVIRDDERRNEEIEKEVRKMAEELRRTLK

SEQ ID NO: 4618 - protein, 60 aa, Artificial Sequence
  Synthetic sequence.
SDIERVRKELRELLERVARRSEKSMRDDKKSMDDLKKEIREVEEELRRLATEVKKTLKDR

SEQ ID NO: 4619 - protein, 62 aa, Artificial Sequence
  Synthetic sequence.
RDVKKKLEEIEREIREAIKDLRRKNREIERTNREVIKELREELKRIDTEVKKLVKELRETSK

SEQ ID NO: 4620 - protein, 60 aa, Artificial Sequence
  Synthetic sequence.
SELEELERDLERELEEDKRRNEEVMERNERRLRKLKEDVDRVVKELEDLLRKLEKILREE

SEQ ID NO: 4621 - protein, 59 aa, Artificial Sequence
  Synthetic sequence.
ESELERLDRRLKKLIKESRETVDEIEERSERAIRDLERKLKELEERLRKKIKELRDETR

SEQ ID NO: 4622 - protein, 59 aa, Artificial Sequence
  Synthetic sequence.
DETKKVEDDLRRVDTESKKHLDDVHKESKRVADELRKKLEDVHRRSEEMVRRLRRLLEE

SEQ ID NO: 4623 - protein, 55 aa, Artificial Sequence
  Synthetic sequence.
EEVKKRIDDALRENERRAEENRREIERVLKELEDRVDENRRRIEEVRKELRDRAT

SEQ ID NO: 4624 - protein, 59 aa, Artificial Sequence
  Synthetic sequence.
DETREVDERLKEADRRSKKHLDDVHKTSKKVLDELRRKIEELERRVRKVVKELEELLRE

SEQ ID NO: 4625 - protein, 55 aa, Artificial Sequence
  Synthetic sequence.
EDVRRKVDKIIKENRKMLEDNKRTIEEVLRELKERADEIKERVKKVLKKLEEDRR

SEQ ID NO: 4626 - protein, 60 aa, Artificial Sequence
  Synthetic sequence.
DEEEKVERDVERVDKESKEHLDRVHEETRDINRRSEEHLRRVHRDSEDVARRLRDAVRRR

SEQ ID NO: 4627 - protein, 55 aa, Artificial Sequence
  Synthetic sequence.
EKVKRRVEEAIKRNRDEARRDEEEVKKAIKRNREEADRNRREIEKVVEELRRRAT

SEQ ID NO: 4628 - protein, 60 aa, Artificial Sequence
  Synthetic sequence.
SEKEEVKRRVDEITKRARKKLEDVHRRSEKIDRDSREHLERVHKRTKEILDELRDELRKR

SEQ ID NO: 4629 - protein, 55 aa, Artificial Sequence
  Synthetic sequence.
EDLRRRLEKVFRELKETLDRNREEIDRMVKRNRKTLRDNKEEIDRAVREARERLK

SEQ ID NO: 4630 - protein, 60 aa, Artificial Sequence
  Synthetic sequence.
REDEEVLKDLKRIVDELRKKLKELHDRSEEIDKRSKKHLDDARRRVEEIMRRIEKRLREE

SEQ ID NO: 4631 - protein, 55 aa, Artificial Sequence
  Synthetic sequence.
DKVRKDLKDVAKEMRDRLEENERRIREAAKRNRTELERIERELKEFKDRLDETAR

SEQ ID NO: 4632 - protein, 60 aa, Artificial Sequence
  Synthetic sequence.
SEVEKVMEEAKRIVTELEEKIRELERKVKKIDEDSRRHLKEVHDRTAEIAKTLRDILRKE

SEQ ID NO: 4633 - protein, 55 aa, Artificial Sequence
  Synthetic sequence.
DKIRREIEEAVERLETEARRLRREVEEAVRRNREMLKRNEKEIKDVAKELRDRLR

SEQ ID NO: 4634 - protein, 60 aa, Artificial Sequence
  Synthetic sequence.
REDDRIRDEIRKLVEDNRRLLREILERLKTLADRLREINKKSNDDNERSADELREVLKKV

SEQ ID NO: 4635 - protein, 55 aa, Artificial Sequence
  Synthetic sequence.
EEVRREVEKAIRDSKEKLDELEERVRRMIEESEKLVEDNHRRIEEVEREMEEALR

SEQ ID NO: 4636 - protein, 58 aa, Artificial Sequence
  Synthetic sequence.
KDEEEIKKAIEELVKRNEDIVEEIKRRSDKLADDLRDINRRSNEDNDRSLKTLEELLR

SEQ ID NO: 4637 - protein, 55 aa, Artificial Sequence
  Synthetic sequence.
KEVRDRVRRAIEKSKEDLDKSEDDSRKVIEESKRLVEENHRRIRKAVRKAEEATR

SEQ ID NO: 4638 - protein, 59 aa, Artificial Sequence
  Synthetic sequence.
SEEEEARKKLKEAADRNRKVNEDAKKKAEDAARKNKKANEELAKKLKDAAEELKRVSRD

SEQ ID NO: 4639 - protein, 55 aa, Artificial Sequence
  Synthetic sequence.
EEIKERAKEVLERHKRSAEKIKEEAKRVLDEHRKRARDWEEEARRVLKEAEEEAR

SEQ ID NO: 4640 - protein, 59 aa, Artificial Sequence
  Synthetic sequence.
REEEEVRKEVKKLKKENEDVNDKVRRDLEELLERNRKVNKELEDKIRDAKRRADEMLRV

SEQ ID NO: 4641 - protein, 55 aa, Artificial Sequence
  Synthetic sequence.
EEIEEELRKVLKEHKELVERWKREAEEVLEESKRLIDKWKEDLERVLEDFRRKAE

SEQ ID NO: 4642 - protein, 57 aa, Artificial Sequence
  Synthetic sequence.
SEAEEIEKRLKEVLDRHDKSAREIKDRLRKVIEEHRKLVEEWEKEARDVVKELKDEN

SEQ ID NO: 4643 - protein, 56 aa, Artificial Sequence
  Synthetic sequence.
TRRLRERLRKMEEDNRKINKEIRDEVKELEKENREINKRVEEELKRVRDELKRTAD

SEQ ID NO: 4644 - protein, 57 aa, Artificial Sequence
  Synthetic sequence.
DEVEDIKRELEEVVKEHEKSVEDDERKNEDVVRRHDELVKKWEEDLRRVIEKLKRDN

SEQ ID NO: 4645 - protein, 56 aa, Artificial Sequence
  Synthetic sequence.
ERDLRRRVKDLKRRNKEMNERSKKHSDEVKEENKRINEEVEKKLRDVKEKLDRDIK

SEQ ID NO: 4646 - protein, 59 aa, Artificial Sequence
  Synthetic sequence.
SELEKLIKEVEDLAKEVADKLRKSNKELRELVRKIAKALEETNREIEKVVRRVKRLLES

SEQ ID NO: 4647 - protein, 57 aa, Artificial Sequence
  Synthetic sequence.
KLKKIKEDLKRIADEIRKIVEDSKRDLERVADEARKIVEKSKEDLKRAKEEAEKETK

SEQ ID NO: 4648 - protein, 59 aa, Artificial Sequence
  Synthetic sequence.
DELDELTKRARELVERNRRHIERSNRELKRLVKEVLDRNRENHKTVEELVKTVLKLAKD

SEQ ID NO: 4649 - protein, 59 aa, Artificial Sequence
  Synthetic sequence.
RSDVERVRKELKDSTDDIKRLVDKSREDLKRAKEKDEKSVRDNRERLRRVLRRLEEEVR

SEQ ID NO: 4650 - protein, 59 aa, Artificial Sequence
  Synthetic sequence.
SELEKLTKEVRDDVRRVMERLKRSNDDIRRLAEEVIRRNDESRKKLEKLVEEVKDLFRR

SEQ ID NO: 4651 - protein, 57 aa, Artificial Sequence
  Synthetic sequence.
KVREIERELDEVRKRLEDLVRKSKEDLDRVREELERLVEKSKRDLDKARRDLDEARR

SEQ ID NO: 4652 - protein, 59 aa, Artificial Sequence
  Synthetic sequence.
DELEELEKKVREDVRRVKEKMERSHRETEKLARDVKKRLEDTNREIKKLVKEVEDILRR

SEQ ID NO: 4653 - protein, 59 aa, Artificial Sequence
  Synthetic sequence.
KSKVEKVRRDLDEARKRLEELDRRNRKRLEEVRKEIREIVEKSKEDLKRAKDRARETVR

SEQ ID NO: 4654 - protein, 59 aa, Artificial Sequence
  Synthetic sequence.
SEAEALIEEVKTLVRRNKEHAKRSHEKTEKLVRDVADALRKTNDEARKLVEEVRRILES

SEQ ID NO: 4655 - protein, 59 aa, Artificial Sequence
  Synthetic sequence.
KSKLERLKRELTRSAEELRELDKRNEDELRRAAKRIRDIVRKSEEDLKKVRDDAREKTR

SEQ ID NO: 4656 - protein, 60 aa, Artificial Sequence
  Synthetic sequence.
KDVEEVRKELDEIARRVTEEIKRVHDETARIVDRLRERLEKVTRDNRRSVRELEKELERN

SEQ ID NO: 4657 - protein, 59 aa, Artificial Sequence
  Synthetic sequence.
EKKLREAKKRLDELAERLKRLIDRNREEIKRVAREADERIRENEKEVEEVEERLDRKIK

SEQ ID NO: 4658 - protein, 60 aa, Artificial Sequence
  Synthetic sequence.
KDAEKVVEDLERKADAVMRKLEDVSRRHREIAKRIKDRLEKVHRDNEKSVEDLKRILKRN

SEQ ID NO: 4659 - protein, 59 aa, Artificial Sequence
  Synthetic sequence.
EEIVRRAEKKVEDFERRLRKLIEDNKREVDKVEKELRDTIRRNEERIREAVEELKRTSD

SEQ ID NO: 4660 - protein, 60 aa, Artificial Sequence
  Synthetic sequence.
EDVRRVVEELRKIAEDAKEKARRVHERDRERVRKVEEDAKKVHEENEESVTRLERLLDRR

SEQ ID NO: 4661 - protein, 59 aa, Artificial Sequence
  Synthetic sequence.
EDDVRRIREEVEKVRKDLKDIVKRNKEANDEVEKRLRDIVRRNRERIEEMRRRLEEKKR

SEQ ID NO: 4662 - protein, 60 aa, Artificial Sequence
  Synthetic sequence.
EDVKRVVKELEDIAEEVRRRLEKVNRENRESMKRLEEELRKVHEENRESIERLKRTLKDR

SEQ ID NO: 4663 - protein, 59 aa, Artificial Sequence
  Synthetic sequence.
EEIVKEAKERVDKVKDDLRRLIEENERDIRRMDRKLEDEIRRNDEELRRVVREAEETVR

SEQ ID NO: 4664 - protein, 60 aa, Artificial Sequence
  Synthetic sequence.
SDVERVRRELREIAETVKERLREVNERNRKSVRDVEEIVKKVHEEDKDLARKVEEILERN

SEQ ID NO: 4665 - protein, 59 aa, Artificial Sequence
  Synthetic sequence.
KERVDDIKREVDKAREDLRRLIEENKRDIKEVVERLEKLIKDNRDDNDRLRRRLEEKSR

SEQ ID NO: 4666 - protein, 60 aa, Artificial Sequence
  Synthetic sequence.
SELEKVEKELKRIVDEVKKELKRVHEDDERLVRELEESLKKVTEDDRRLARELEDTLRKR

SEQ ID NO: 4667 - protein, 59 aa, Artificial Sequence
  Synthetic sequence.
EEDARRAEERVRRVVKELKELIERNKKRNKEAVERLRRLIEENKRENREVEKRARDTAR

SEQ ID NO: 4668 - protein, 60 aa, Artificial Sequence
  Synthetic sequence.
KDAEEVLERLKKIAEEVAKELRDVDEENRRLLKRWAEILEEVTREDERLARELEERLERR

SEQ ID NO: 4669 - protein, 59 aa, Artificial Sequence
  Synthetic sequence.
EEKLRRAKEEVDRAEKELRELIKRNKDNLERAVRELEKLIEENERRNREVEKRLEDRER

SEQ ID NO: 4670 - protein, 60 aa, Artificial Sequence
  Synthetic sequence.
KDVEDVVRRLEEIAKRVKERLKEVDKRNKDKAREWLKEVKEVHERNEKLAEEVRRTLKDN

SEQ ID NO: 4671 - protein, 59 aa, Artificial Sequence
  Synthetic sequence.
EEIVREAEKRVREMERELRELIERNKRNVEEMDRRLEELIKENEERNKRVEEDLRRKTK

SEQ ID NO: 4672 - protein, 60 aa, Artificial Sequence
  Synthetic sequence.
DEVEEAKRRLTELVDRLRKTLEKVSREDRELEERVRKITKDSHDTTEEILKRLKRELEKG

SEQ ID NO: 4673 - protein, 59 aa, Artificial Sequence
  Synthetic sequence.
EKDLRELEERVRRAVKKLRDDLRRNKKESEEVKKKLEDENKKNRDRVAEAEEELRRRTT

SEQ ID NO: 4674 - protein, 59 aa, Artificial Sequence
  Synthetic sequence.
DEVREMLRTLDEIARRLKKRTKESIDTDRRLVKKLREETDKSIEDDKKLVKEVEELLDG

SEQ ID NO: 4675 - protein, 59 aa, Artificial Sequence
  Synthetic sequence.
ERKLRELEKRIRKAEEELRRDNERSKKETEDVERDLERKNEESERRTREAEKRLKERSD

SEQ ID NO: 4676 - protein, 59 aa, Artificial Sequence
  Synthetic sequence.
SEVEEVLKRLRDIARELEKLIEEVIRRDRKLVEELKRRSERSIETDRRLVKRLKEMLDG

SEQ ID NO: 4677 - protein, 59 aa, Artificial Sequence
  Synthetic sequence.
EEKVRRAEEEIREVERRLRKLLRDSKEETKEVVKELRRLNEESKKETEKVVREAEKRTK

SEQ ID NO: 4678 - protein, 59 aa, Artificial Sequence
  Synthetic sequence.
KDAEEVVRRLTKLVEDLKRKIEEVIREDKELVDRVRDTSRKSDETLEKLVREVKKLLRE

SEQ ID NO: 4679 - protein, 59 aa, Artificial Sequence
  Synthetic sequence.
EEKLKRLEDRVREAEKELRELLERSEDTTRRAERELEELNRRLEDKIRRVVEELKEESR

SEQ ID NO: 4680 - protein, 59 aa, Artificial Sequence
  Synthetic sequence.
SEVEDVLRRLERLVRELEKETKRSLEENEKLARRLKKKLEDVVRDNKRLVDEVKELLKE

SEQ ID NO: 4681 - protein, 59 aa, Artificial Sequence
  Synthetic sequence.
EEKLRRLEKLVRDAARRLKELNDRLRKRSKEVKEELERILRELKERSDRAKEDLRRAAK

SEQ ID NO: 4682 - protein, 60 aa, Artificial Sequence
  Synthetic sequence.
SELEKVEKDLEKLIRDDEEENKRVLEELERLVREDKEKNKRVHDETRKLEDTLRRILEKS

SEQ ID NO: 4683 - protein, 62 aa, Artificial Sequence
  Synthetic sequence.
EEAKEKLRRLKERIREAEEKSRKSLRDIEETLKKVKRESEETDRRNRDTLRRAKKRLKDETR

SEQ ID NO: 4684 - protein, 60 aa, Artificial Sequence
  Synthetic sequence.
DEVEEVKKTIRDLLRRNKEISRETLERLKKLVDENRERNKKVHDETKKLTEEIKKILEEI

SEQ ID NO: 4685 - protein, 62 aa, Artificial Sequence
  Synthetic sequence.
EEAEKELRKLEKEVKDAKEESERSDRRLEKEIRDVERDSERSDRENRDEIRRVAEELDERSR

SEQ ID NO: 4686 - protein, 60 aa, Artificial Sequence
  Synthetic sequence.
SEAEKVLRDLEELVRENEEKSERSLRELEKLVRDNEEKNKEVVKRIKDLAERIRRILEEI

SEQ ID NO: 4687 - protein, 62 aa, Artificial Sequence
  Synthetic sequence.
EDAKRKLEEIRKTLEEVKRRSEDSNRELRRRLEEVKRRSEKSLRDLEELVRRIKKELDDRSR

SEQ ID NO: 4688 - protein, 60 aa, Artificial Sequence
  Synthetic sequence.
SEADKLREDLERRVREIEKRSRDSDKRLEELLEEIRRRSKRTLDELERRLREVEEELERE

SEQ ID NO: 4689 - protein, 59 aa, Artificial Sequence
  Synthetic sequence.
KKKVDRVRDEVRKVKRKLEEEHKKLERKVREARKELEKSHRDLNREVKKAKERLDRKRD

SEQ ID NO: 4690 - protein, 60 aa, Artificial Sequence
  Synthetic sequence.
DEVEKLRKELEDLAEKIKRESEKTLRELKKLADEIRKLSEDTLRRLKELLDRVEELLRET

SEQ ID NO: 4691 - protein, 59 aa, Artificial Sequence
  Synthetic sequence.
ERKVRELEKTVEKIKRELEKSHEDLNREVEKIKRDLERSHKELNELVKRAEERLRRETK

SEQ ID NO: 4692 - protein, 60 aa, Artificial Sequence
  Synthetic sequence.
SRVEELKRRLEELIERIDRESKRTLKELKDLAREIKELSERTLRELERLAKEVKEELDRI

SEQ ID NO: 4693 - protein, 59 aa, Artificial Sequence
  Synthetic sequence.
EEKVKELEERVRRVDEELERSNERLRREVKKIKEELKESHERLNKRVEEIRRELRERSR

SEQ ID NO: 4694 - protein, 60 aa, Artificial Sequence
  Synthetic sequence.
DEAERLEEEIRRLAEEIKRLSKESLERVEKLLEEVRRESKRTLEDLERLVRDVEDKLRKI

SEQ ID NO: 4695 - protein, 59 aa, Artificial Sequence
  Synthetic sequence.
EEKVRRLKKRIDEIKEELKKSNEDLHRRIEEAKRELEELHERLNRDVERVKEKLRRDAK

SEQ ID NO: 4696 - protein, 60 aa, Artificial Sequence
  Synthetic sequence.
RELEELLKTLEELLKKIEEESRRSLEELKRLVDDIRRKSEESLERLERLAERVKEVLDRE

SEQ ID NO: 4697 - protein, 59 aa, Artificial Sequence
  Synthetic sequence.
KEKIDRLEKRVRDAKKRLEDLHRELNKRVEDVKRDLEESNKRLHDTVREIKKELRERTR

SEQ ID NO: 4698 - protein, 60 aa, Artificial Sequence
  Synthetic sequence.
DEVRELEERIDRILKKIEDESRRTLEEIKKIAREVEKRSEDTLRELDDLVRRVEELLERI

SEQ ID NO: 4699 - protein, 59 aa, Artificial Sequence
  Synthetic sequence.
EKDVRRLEKKIREAEKRLRESNERLEKTIRDIKKRLEKLNKELKDRVDEVVKRLRDKTE

SEQ ID NO: 4700 - protein, 60 aa, Artificial Sequence
  Synthetic sequence.
SELEELLERLKRRADEIRKESEKTLEELDRDARRIEKESRETLEELKKRLDDVRRALEET

SEQ ID NO: 4701 - protein, 59 aa, Artificial Sequence
  Synthetic sequence.
KKKIDDLRRKVEEIEKDLKRSNDELRKRVKEIKDRLKELHDKLNEDVKRARKELEERRK

SEQ ID NO: 4702 - protein, 60 aa, Artificial Sequence
  Synthetic sequence.
SEAEELLERLDRRLRRVEETSKRTLDELKRLLEDIERKSRKSLKELEDLVRKVKDMLRRE

SEQ ID NO: 4703 - protein, 59 aa, Artificial Sequence
  Synthetic sequence.
EKKIRDLERRVEEAARRLEKSNRDLAEEVERAERRLDRSNRELRRRVEKVLKELEDTER

SEQ ID NO: 4704 - protein, 60 aa, Artificial Sequence
  Synthetic sequence.
SELEELEKRLEDLAREIKRRSRESLKELEELVKRIEETSKRTLDELKRLLDEVVKELRRI

SEQ ID NO: 4705 - protein, 59 aa, Artificial Sequence
  Synthetic sequence.
EEDIRRLEERVEKIREDLERLNRELHETVKRVKKRLEDSNRRLKEEVRKAKRRLDEELK

SEQ ID NO: 4706 - protein, 60 aa, Artificial Sequence
  Synthetic sequence.
SEAEELTERIRKILKEIRELSEKSLRELRELVKTITELSKESVERLKRRVEEVKEELRRI

SEQ ID NO: 4707 - protein, 59 aa, Artificial Sequence
  Synthetic sequence.
ESKVRELEERIRRAEEELKKRNEDLHREVRKVLKELRDSNKELEKEVKRVKKELRDESR

SEQ ID NO: 4708 - protein, 60 aa, Artificial Sequence
  Synthetic sequence.
SELEKLAEDLERLAEEIKRESDRSLEELRELAERIKRESRKTLEDVKKLLKEVKEVLDRE

SEQ ID NO: 4709 - protein, 59 aa, Artificial Sequence
  Synthetic sequence.
DKKIEDLRRRVEEIIKRLEKSNRDLRKEVEDIKRELEKLNKELHDTIREAKERLDRTTK

SEQ ID NO: 4710 - protein, 60 aa, Artificial Sequence
  Synthetic sequence.
REVEELLKELEKVVRENEKKIEDLHKRNEDVVRKIEKDHRDSEKELKEVADRVRELLERK

SEQ ID NO: 4711 - protein, 59 aa, Artificial Sequence
  Synthetic sequence.
EDDVRRLKKRAEESLKKIEDDLRRDEDRLRRVIEKSKRLVDKLREELERVLREIEKRIR

SEQ ID NO: 4712 - protein, 60 aa, Artificial Sequence
  Synthetic sequence.
SEAEKLKEDLDRVVEKVKEDLKRLHDENRRVAEKNERVIEELHRRNREVTKELEKRLEEK

SEQ ID NO: 4713 - protein, 59 aa, Artificial Sequence
  Synthetic sequence.
EEKVKRLRDAVRKVLKEIEEELERDERAVAKTLRKIEELLKRDKKELDKVRKRLEERLR

SEQ ID NO: 4714 - protein, 60 aa, Artificial Sequence
  Synthetic sequence.
SEAEKIEEELRRAAETAKKRHEDSERELEEAAKTAEERAKRIHDRNERAAEEAKKRAEDD

SEQ ID NO: 4715 - protein, 59 aa, Artificial Sequence
  Synthetic sequence.
EEKATRIKREADEARKESKKLAEKLKKRADEARRKLEEEAKRDKERADRAAKEIEDRAR

SEQ ID NO: 4716 - protein, 60 aa, Artificial Sequence
  Synthetic sequence.
SEVEKLKEDLKRVVERVKRDHERSLKRLEDVAREVEKRIRDLHERSKDVMRRLKDLIDKK

SEQ ID NO: 4717 - protein, 59 aa, Artificial Sequence
  Synthetic sequence.
EDELRKLAEDIKRAEDESRKLVERLKKKAEEVRRKIKKLLEENEEELKRILDRLREAAK

SEQ ID NO: 4718 - protein, 60 aa, Artificial Sequence
  Synthetic sequence.
SEVEELLERLKKVADDIRREIEKLHKRTKEVADEVRKRHEDSRRELEKVADEVRDRIEKD

SEQ ID NO: 4719 - protein, 59 aa, Artificial Sequence
  Synthetic sequence.
SKALKRLSDEIKKIEDEIRKLLEDNRREVEEAEKESRKLVEELERRAKEVEEEIKRARD

SEQ ID NO: 4720 - protein, 60 aa, Artificial Sequence
  Synthetic sequence.
SEVEKILEDLKRVVDEVRKRHKESLDRNKKVADEVRELHERSDKELEDVVREVKDKLEKN

SEQ ID NO: 4721 - protein, 59 aa, Artificial Sequence
  Synthetic sequence.
SKDVKRIEDELRKANEESRRLVEELRKHSEDVNRESRKLVEDLERKLRKAEKDIEDDAR

SEQ ID NO: 4722 - protein, 60 aa, Artificial Sequence
  Synthetic sequence.
SEVEDLLRRLKEVVEEVERLIKKLHKETKEVVDEVRRLHEKSLRELKKAADDARDALRRN

SEQ ID NO: 4723 - protein, 59 aa, Artificial Sequence
  Synthetic sequence.
EEKVRRLAEEVKRALDRIKELIKRNRDELKRANEESKRLVERLREEAERILRDLRRKLD

SEQ ID NO: 4724 - protein, 60 aa, Artificial Sequence
  Synthetic sequence.
SEVEKIKKDLEKVADEVRRLHKESLDRLKKVVREVEERLKRLHEESEKVAKDVRRKVEEK

SEQ ID NO: 4725 - protein, 59 aa, Artificial Sequence
  Synthetic sequence.
EREVKKIKDDLDRVNEESRRLVEKLERDVTRVRKKIKEELKKNADRLKEVEEDIKRRAK

SEQ ID NO: 4726 - protein, 60 aa, Artificial Sequence
  Synthetic sequence.
SEVEELERELKEVVDRVRKLHRESLERNREVVRKVDEDIKKLHRESEEVAKEVEKLIEEV

SEQ ID NO: 4727 - protein, 59 aa, Artificial Sequence
  Synthetic sequence.
ERDLKRLEDEARKANKESRDLVREIERHSREAMKRIEEELRRNKERLERVLKKIEDKAR

SEQ ID NO: 4728 - protein, 60 aa, Artificial Sequence
  Synthetic sequence.
SEVEKLLEDLKRVAREVEKLLEDLHRRTDEVMKRNEDDIRRLHEESDRVVKRVKDEIEKK

SEQ ID NO: 4729 - protein, 59 aa, Artificial Sequence
  Synthetic sequence.
ERDLKRLKDEAKRIEDKIRELLERNREKARRTKEKIKKLVERNRRELEKVLDEIRRRIK

SEQ ID NO: 4730 - protein, 56 aa, Artificial Sequence
  Synthetic sequence.
KEVEDVEKRNREVHRRIEKLIEENERRLKEVRDRIRKLVREIEDLNRRVREEVDRR

SEQ ID NO: 4731 - protein, 59 aa, Artificial Sequence
  Synthetic sequence.
EEVLRDLLRRNEEVVKRVEDNLRRDTERLEKVAKDVEKKLREVLKRNKEMVDEVRKKTK

SEQ ID NO: 4732 - protein, 60 aa, Artificial Sequence
  Synthetic sequence.
SEEEDVLRKLEKIVTDLRETLKRMHEDSERIVEESRKHARKVHEDSKKIVRELKKVLDEK

SEQ ID NO: 4733 - protein, 55 aa, Artificial Sequence
  Synthetic sequence.
EEVRRRVEEIRREIERELKRNRERLEEVERENRKLLRENKEELDKVEKDLRDTAE

SEQ ID NO: 4734 - protein, 57 aa, Artificial Sequence
  Synthetic sequence.
DDIKRLEDEVRKAAEENKDEVRKNREELKRIKDEIDKLVKDVEETIRRAEDEIRKRV

SEQ ID NO: 4735 - protein, 59 aa, Artificial Sequence
  Synthetic sequence.
KRVMEKVLRELKEIVDRSRDHLRRVHEDSKRIADELRRKIEELLKRIKKVVDELREAIR

SEQ ID NO: 4736 - protein, 58 aa, Artificial Sequence
  Synthetic sequence.
DDLRRIEKELKRLADRARKINRESDERIKKLEEEIRRINEDSLRRDRDLARRLREMLK

SEQ ID NO: 4737 - protein, 58 aa, Artificial Sequence
  Synthetic sequence.
REVKKLKEDLDRVKRELEKLNEEIRDRIRRVKEELKRLNDRSKKHTKEVEEEVERRKK

SEQ ID NO: 4738 - protein, 60 aa, Artificial Sequence
  Synthetic sequence.
SEAEDILRRIKRLADENRRILKEILDRIKELADRVRKINEDSLRTLRKLAEELRRVAEKV

SEQ ID NO: 4739 - protein, 58 aa, Artificial Sequence
  Synthetic sequence.
EKAERLEREVRKIEKESREMLKRIEDEIRKVEEDLRRLNEELERDVRRVEEEVKRAAD

SEQ ID NO: 4740 - protein, 58 aa, Artificial Sequence
  Synthetic sequence.
DELDDIRRRLEKLEEEAERINRESEKRDRELARRIREINKRSKEEDRRLAKEVDEILR

SEQ ID NO: 4741 - protein, 58 aa, Artificial Sequence
  Synthetic sequence.
EAVEELRKKIEEVEKKLRRLNEKSKKHTKDVRDELRRLNEDSKRHTDEVKDRLEEATR

SEQ ID NO: 4742 - protein, 60 aa, Artificial Sequence
  Synthetic sequence.
DELRKIREDLKRLATEAREINKRSDEDIKRLTDDVRRINKESLERLKKLADDLRDALRKV

SEQ ID NO: 4743 - protein, 58 aa, Artificial Sequence
  Synthetic sequence.
EAVKELEEEIRKVKEELKKLNKEIEDKIRDVERELRETNKRLEDEVRRVEEEVRRATK

SEQ ID NO: 4744 - protein, 60 aa, Artificial Sequence
  Synthetic sequence.
DDAERILDEIRRLTEELREINKESLKKVERLAERIREINKDSLRRDKELADRLRRMLEEV

SEQ ID NO: 4745 - protein, 58 aa, Artificial Sequence
  Synthetic sequence.
EKVERIERTIRKVARELEKLNEDIRKRVDEVEEELKKLNKESEDHTRRVREEVRRRTQ

SEQ ID NO: 4746 - protein, 59 aa, Artificial Sequence
  Synthetic sequence.
SELETVEERLKRLEEEIRRLLEKVDRDLDRLADEVRKKNKRSHERNKEIEDRIDKLLKD

SEQ ID NO: 4747 - protein, 62 aa, Artificial Sequence
  Synthetic sequence.
EELKKMLRKLEERVKEVTRELEDLLKKAEEKVRRVKDELRRSNKKDEDRLREVEEKLREDSR

SEQ ID NO: 4748 - protein, 59 aa, Artificial Sequence
  Synthetic sequence.
SELEEVRKRAKDIADEDRELNRRVHEENKRLADDVRRKNEKSHRDNERIATELRELLRD

SEQ ID NO: 4749 - protein, 62 aa, Artificial Sequence
  Synthetic sequence.
EELKKLLDELRKRVEDVKEESKRSLDRDRRELERVKKELDDSNDEDRKRIEEVIKEVRDRSK

SEQ ID NO: 4750 - protein, 60 aa, Artificial Sequence
  Synthetic sequence.
DEEREVKERLKELIERLRRLHEESLRELKRIADELRRLHEESHKRNEDIARELERLLAEV

SEQ ID NO: 4751 - protein, 55 aa, Artificial Sequence
  Synthetic sequence.
DELERRVRKVEEESKKLHEEIRKRIEEIERESRKLHEDDRRRIEEVLKRIKDAVR

SEQ ID NO: 4752 - protein, 58 aa, Artificial Sequence
  Synthetic sequence.
SDEDRLREEAKKVADELRKLHEESHKRNKEIADELRKLHKKSHDDNKRIADEITELLK

SEQ ID NO: 4753 - protein, 55 aa, Artificial Sequence
  Synthetic sequence.
EELRDRLRRVEEESRELHKRDREEVERIRRESEKLHREDREDVKRIEKKLRDDAR

SEQ ID NO: 4754 - protein, 60 aa, Artificial Sequence
  Synthetic sequence.
DEAEKVLEELRRRAEKVLREVKKVLEDHKRLADELRKELKRVSDENRDSLRRLLEEIDRN

SEQ ID NO: 4755 - protein, 59 aa, Artificial Sequence
  Synthetic sequence.
EDLLRRLRELLDEIRKELRDLIRKLRELNDRVERDLRRIIRENRELVRRAEKELEDRTR

SEQ ID NO: 4756 - protein, 60 aa, Artificial Sequence
  Synthetic sequence.
DEAEEVLERIKDLARKNEEKNRRVLEEHEKLIRESEERDEKSSRDNKRSVDEIRDIIRRK

SEQ ID NO: 4757 - protein, 59 aa, Artificial Sequence
  Synthetic sequence.
EEKIKRIRDELARWAEKIKKTIDELRKLNKEAHDRNRKTIKENEDLVREAKEDLERKTT

SEQ ID NO: 4758 - protein, 60 aa, Artificial Sequence
  Synthetic sequence.
SEAEEVLKEIKKLADELRKKNRESVEKVRESSKRLKDEIRKVLEDIKRLAEKLREILREM

SEQ ID NO: 4759 - protein, 59 aa, Artificial Sequence
  Synthetic sequence.
EKLLRELEKLIRDIKRELDRSDEKLEELVRRSAKELDDLLDTLREIIERIKRDLDEKLR

SEQ ID NO: 4760 - protein, 60 aa, Artificial Sequence
  Synthetic sequence.
REAEEVLKRIKELADEIRKRNRESLERIRKSSEDLKRENEDSIRRVRELIDTLRRRLEKE

SEQ ID NO: 4761 - protein, 59 aa, Artificial Sequence
  Synthetic sequence.
KELVDRIRDLIRRIKDELKESDDRIKELIDKSKEDLDKSDEDLKREIDKAREELAKAIK

SEQ ID NO: 4762 - protein, 59 aa, Artificial Sequence
  Synthetic sequence.
DEVEELLKEVEELAREIVERLEKNLRDTKKLIDEIEEYARRNEERTRKLIEEAERLARR

SEQ ID NO: 4763 - protein, 59 aa, Artificial Sequence
  Synthetic sequence.
EELERRLRRLLEELERRLKRLEDEHRRLVEEVRDKLRKIEETHREIVERVRRTLDEEKR

SEQ ID NO: 4764 - protein, 59 aa, Artificial Sequence
  Synthetic sequence.
DDARRLLEEVKELLERSKRHLTKNLEDTRRLIKELLDYARRNLEDTRRLIEEVLDLLKR

SEQ ID NO: 4765 - protein, 59 aa, Artificial Sequence
  Synthetic sequence.
EEVKETLKRLLDEIRRENEKVARDHKKLVDDVERELEDIERRHKELVDRARKVAEDEKK

SEQ ID NO: 4766 - protein, 59 aa, Artificial Sequence
  Synthetic sequence.
SDAERILDEVRKLVEDSKRHLDENLKRTAELSKRSKEYAEENLDRTRRLAKEAADIARR

SEQ ID NO: 4767 - protein, 59 aa, Artificial Sequence
  Synthetic sequence.
EKVKEDLKRLLDEIRKENKRAEDAHRDLARRSREELEKAERKHKELVDRIRKALEEIKK

SEQ ID NO: 4768 - protein, 59 aa, Artificial Sequence
  Synthetic sequence.
DEVRKLLKDVRELAREIERRLEENLRRSEELLKRIEDYLRKNLEDTRRLIEEVKELADR

SEQ ID NO: 4769 - protein, 59 aa, Artificial Sequence
  Synthetic sequence.
EEFKDRLRRLMKRIKERLEDVKRRHKELVKKARKSLEEVKRRHRKLVEDVRRTLEEEKR

SEQ ID NO: 4770 - protein, 59 aa, Artificial Sequence
  Synthetic sequence.
DEARKILEDLKRLAEESIRHLEENLRRSEKLVEDVERYAEENLERTKKLVRDVDEIIRR

SEQ ID NO: 4771 - protein, 59 aa, Artificial Sequence
  Synthetic sequence.
EEVKKRLEDLAREIRKANEDVKRRHKKLVDDVRKRLKEIEKKHRDLVRKIEEKLRDARK

SEQ ID NO: 4772 - protein, 59 aa, Artificial Sequence
  Synthetic sequence.
SEAEELLKTVRDLVEKSRKHLKENLKRSEELSRKSKEYADKNLERTKRLVKTVADILDR

SEQ ID NO: 4773 - protein, 59 aa, Artificial Sequence
  Synthetic sequence.
KKLEDELRRLVEEAKRENDEVRREHKRLVEDSERKLEKIERDHRELVDRVEKEMREKKR

SEQ ID NO: 4774 - protein, 59 aa, Artificial Sequence
  Synthetic sequence.
SDVERILEDLDRVVKESKRHLEENLRRSEKLTREVEEELKRNLKESEELVKRVEDIARN

SEQ ID NO: 4775 - protein, 59 aa, Artificial Sequence
  Synthetic sequence.
EDAKRRLRELVEKVKEDNKKVKEEHDDLVRKVERRLEEIRKRHEELVRRIRRRLEEEKR

SEQ ID NO: 4776 - protein, 59 aa, Artificial Sequence
  Synthetic sequence.
SDVEELLRRLEELLKESEKHLTENLRRSEKLVRDSKRHLDENLKRSKDLAREVVRLAEK

SEQ ID NO: 4777 - protein, 59 aa, Artificial Sequence
  Synthetic sequence.
RKVKERARELVERIKRRNEKVERDHEELAREVRERNKEVEKRHRDLVEELRRRLDERKR

SEQ ID NO: 4778 - protein, 59 aa, Artificial Sequence
  Synthetic sequence.
SEAEELLERVKKLTDESLRYLEENLDRLRKLVKESEDHLKDNLRKSEKRVREVIDLARR

SEQ ID NO: 4779 - protein, 59 aa, Artificial Sequence
  Synthetic sequence.
KDMEDKLRRLVEESRRALEEVLKRHEDLVEEVRKSNDKVRKEHEELVKRVRDALREIKR

SEQ ID NO: 4780 - protein, 55 aa, Artificial Sequence
  Synthetic sequence.
SVEERLEKLLKEAEERLRESEDRTRKLVEEVRRELEKLKKRSKELADRVREELRK

SEQ ID NO: 4781 - protein, 59 aa, Artificial Sequence
  Synthetic sequence.
EEELEKILDTLRRIAEKLVRKNEDILRRLKEIVKKVIRENEEILRRLEEIAKELAKRLE

SEQ ID NO: 4782 - protein, 55 aa, Artificial Sequence
  Synthetic sequence.
SLDEEAKRVVEEVRKRLRESKERSREIVERARRELERLKEESKRLADRIREEVKK

SEQ ID NO: 4783 - protein, 59 aa, Artificial Sequence
  Synthetic sequence.
TELVKRLLDDLRRIIRELEEKNRALNETLRKIVEEAIKKNREILEELREEVDRVRKRLK

SEQ ID NO: 4784 - protein, 60 aa, Artificial Sequence
  Synthetic sequence.
SEVEKVLREAREILKKNKRENEEVHKKSKEIAERNREKNEKVHRDSRKIIEELKELADRG

SEQ ID NO: 4785 - protein, 56 aa, Artificial Sequence
  Synthetic sequence.
EDEARKLVKEVRETLEDSARRDEKLIEDLKRTLDESKKEDDKLIEELERRLREAER

SEQ ID NO: 4786 - protein, 60 aa, Artificial Sequence
  Synthetic sequence.
SEVEKVLREAEEIAKKNEEDNRRVNDRSEKIIEENERRNRKVHKESEDIVRDLERLAAEG

SEQ ID NO: 4787 - protein, 56 aa, Artificial Sequence
  Synthetic sequence.
EEEVRKLVEKLERLLEKSKRDDEESIKKARELLRRSEEADKKLIREAEEAIRTRKK

SEQ ID NO: 4788 - protein, 60 aa, Artificial Sequence
  Synthetic sequence.
SRLEELLKKAKKLVEDVEDTNRKMLEKLRKLADDLRRINKRVLDELERLARELEDIARKI

SEQ ID NO: 4789 - protein, 59 aa, Artificial Sequence
  Synthetic sequence.
EEVLRELKKLLDEAKKKLEEIDKRLEDELRKIEDDLRRSNERVRRLLEEVRRRIKEETD

SEQ ID NO: 4790 - protein, 60 aa, Artificial Sequence
  Synthetic sequence.
DELEEMLKRLEKLARDLDRINKEVLRRVEEEVRKLEEENEEVLRTLRRLAEEVERILDEI

SEQ ID NO: 4791 - protein, 59 aa, Artificial Sequence
  Synthetic sequence.
KEVLDKLEKLLEDIARELEKSNRRLEELLKEVERRLREMDERLRKELEEVKRRLEEKRR

SEQ ID NO: 4792 - protein, 60 aa, Artificial Sequence
  Synthetic sequence.
SRVEKVLEELKELMKELDDSNRRVLEELERLVRENTRRNEEVLRRVRELAERLKDELDKI

SEQ ID NO: 4793 - protein, 59 aa, Artificial Sequence
  Synthetic sequence.
EELLRRAKELLKRIKERLEESDRRLKRLLDEARKRSEDIIRALEKLLRDVKRELEEKLR

SEQ ID NO: 4794 - protein, 60 aa, Artificial Sequence
  Synthetic sequence.
KDAERLFEDLRRLVDENREKNEKVLREIEERVERLERENEKVLRDLEDLIRRVREEIDRT

SEQ ID NO: 4795 - protein, 59 aa, Artificial Sequence
  Synthetic sequence.
EEMLRELKKLLDRAREESRRIIEELERTLEKVKERLDRTDKEIEELLKRAEEELREKER

SEQ ID NO: 4796 - protein, 60 aa, Artificial Sequence
  Synthetic sequence.
DDLERLLKEVKERIDEVKRRNEEVLKRLRELVKRNKEKNDRVLREAEKLMKKLRDIVRKI

SEQ ID NO: 4797 - protein, 59 aa, Artificial Sequence
  Synthetic sequence.
EEVLRRLRELLRTAERELEESNRRAEELLKDARRKSEEIIRRLERLLEEVDRDIKRALK

SEQ ID NO: 4798 - protein, 60 aa, Artificial Sequence
  Synthetic sequence.
DDVRELLRTLRKISEDTLRRVEEINRKLERLSRETLKRVEDINRKVKELMEEVLKELDRI

SEQ ID NO: 4799 - protein, 59 aa, Artificial Sequence
  Synthetic sequence.
EDALRELKRLVDDNETKLRRLRDTHRELLERNRTELEKLKRTHKKLVDEAEEELRKKDK

SEQ ID NO: 4800 - protein, 60 aa, Artificial Sequence
  Synthetic sequence.
SDVERLLEKLRDLSRRTVRELERINEEVREIIKTLKKELDRTNKELRDIIEEIKKELDKI

SEQ ID NO: 4801 - protein, 59 aa, Artificial Sequence
  Synthetic sequence.
EKLLDELRRLLEENEKTLEDVRRTHEELVKRAKRELEKNIEEHERLVRDVKEKLERKIR

SEQ ID NO: 4802 - protein, 60 aa, Artificial Sequence
  Synthetic sequence.
SDAEELLKEAREVSKRTKDTLDEINKDVKRISEETKKRLKKTNEEIKEIADRLRKELERI

SEQ ID NO: 4803 - protein, 59 aa, Artificial Sequence
  Synthetic sequence.
EDILRELKKLVDDNRKTLKEVLETHEELLRDNSRKLERNVERHAKLVRDIKEELKETTR

SEQ ID NO: 4804 - protein, 60 aa, Artificial Sequence
  Synthetic sequence.
SDAERLLKEVEEIARRLEKKMRETNKEVDRIVKEIEDDARRLNKELREIAERIKDELDKI

SEQ ID NO: 4805 - protein, 59 aa, Artificial Sequence
  Synthetic sequence.
EKVLKELKRRLEEIKKKLDDNLRRHKKKVDDVARELEKIVKTHRDLVEEIRRRLRKKEE

SEQ ID NO: 4806 - protein, 59 aa, Artificial Sequence
  Synthetic sequence.
SDAERLLEELKRISEETKRRLAETNKKVKKIMKELTETLTETNKKLKKIIDDLRDRIDK

SEQ ID NO: 4807 - protein, 59 aa, Artificial Sequence
  Synthetic sequence.
ERVLKELRRLLERNREELRRNKEKHKELVERIKRRLEENKERHKRLVDEARKELKEKEK

SEQ ID NO: 4808 - protein, 60 aa, Artificial Sequence
  Synthetic sequence.
KDAEELLKTLERLSRETKRRLERTNRELKEISKETEKDLERTNRKLKEIIDRLREELDKI

SEQ ID NO: 4809 - protein, 59 aa, Artificial Sequence
  Synthetic sequence.
EEMLRELRRLVEENKKRLRENIRRHERLLEENRRKLEKNIRDHERRLEKADKDLEDKRR

SEQ ID NO: 4810 - protein, 60 aa, Artificial Sequence
  Synthetic sequence.
KDAERLLEEARRIVKEADDILRELDEEVRRIVEKIKRDAERTNEEIREIAKRIRDEIERI

SEQ ID NO: 4811 - protein, 59 aa, Artificial Sequence
  Synthetic sequence.
EDVLRELRKLVEDVKRRLKEVADHHRELVRRAEEELKKNRDEHERLVREIEKELRKARE

SEQ ID NO: 4812 - protein, 60 aa, Artificial Sequence
  Synthetic sequence.
DEAERLLERVKELMERLTEEARRTNETLREIVERAERRLRELDERVRKIAEEIRRRLEKI

SEQ ID NO: 4813 - protein, 59 aa, Artificial Sequence
  Synthetic sequence.
EKVLTKLRKLLEDIRRRLEKNLKDHEELVRRVEEKLKRVREHHEELVRRIKEELDKAEK

SEQ ID NO: 4814 - protein, 63 aa, Artificial Sequence
  Synthetic sequence.
RDAEELLRTMEEITRRVKKELEDLLRTDEELSERVKEEARKLDEKLKELARDVTEKARDIKKG

SEQ ID NO: 4815 - protein, 59 aa, Artificial Sequence
  Synthetic sequence.
DEVKKELKRLIEEVRDRLKKVKDTLEKLIKENEDELRKVEEHHEKLLREIEETLERMRK

SEQ ID NO: 4816 - protein, 63 aa, Artificial Sequence
  Synthetic sequence.
EEAERLLKKAEDLSRDTARKAKELLEEDEKLVRDAEKKARELDRELEKLAEEAARAATRAKKD

SEQ ID NO: 4817 - protein, 59 aa, Artificial Sequence
  Synthetic sequence.
EEARKRAEDLIRESEKRARDAKRRAKELIDRSRKSAKEAKEHHEKLIKEARDELEKAKK

SEQ ID NO: 4818 - protein, 60 aa, Artificial Sequence
  Synthetic sequence.
DEAEKLLRELEKLSRETEKRVREIIKKDRDLSEEVRRRAERLDDELRKLVEDAERELRRI

SEQ ID NO: 4819 - protein, 59 aa, Artificial Sequence
  Synthetic sequence.
DKVRKRLEELIRESDERLKELTKELRKLIEDNRRELEKIIRHHKRRVDEVRKRMTELRR

SEQ ID NO: 4820 - protein, 61 aa, Artificial Sequence
  Synthetic sequence.
SEVEDLLRRLEEIVKRNDDELRADEERTRKIIKENKETLDRLLEDLKRILRELEKIVRDKG

SEQ ID NO: 4821 - protein, 59 aa, Artificial Sequence
  Synthetic sequence.
EEAKRRAEEKLKRLEERSREIERRLKKLNEELKRISDEVEKTAREILERIKRRIEEEER

SEQ ID NO: 4822 - protein, 61 aa, Artificial Sequence
  Synthetic sequence.
SRVEKLLDDVRKILEDNERRLRDDMRRTEEIIRKNKRDLERLKERHEEIVKRLDEIIKKEG

SEQ ID NO: 4823 - protein, 59 aa, Artificial Sequence
  Synthetic sequence.
EDARREAERLLKEVEDTSREAEKRLRELNEELERRSRKVEEELKKSDEELKRRIEEAER

SEQ ID NO: 4824 - protein, 60 aa, Artificial Sequence
  Synthetic sequence.
SIEDRLRKIVRDLEKVLRDLKREHDDVVRELEKRLRDIEERHRELVEELKKRIEEIERER

SEQ ID NO: 4825 - protein, 59 aa, Artificial Sequence
  Synthetic sequence.
EKDLEELLKELEDIIREVRKRAKENLDRTRKLIKDIEDYLKKNLDRVRKLIEDITRALK

SEQ ID NO: 4826 - protein, 60 aa, Artificial Sequence
  Synthetic sequence.
SIEERLREVERRLREDLKRLEKAHRDIVRDIERTLRKVEEDHRRVKEKLKRTIEDVERRR

SEQ ID NO: 4827 - protein, 59 aa, Artificial Sequence
  Synthetic sequence.
EKELEKLLRDLKRIIDEVRKYATRNLEELKRVLKRVKEEAEKNLERTERLIEEIRRRAE

SEQ ID NO: 4828 - protein, 60 aa, Artificial Sequence
  Synthetic sequence.
SIEETLREIVKDLERVLEEIERRHREIKKELEDILRELKKRHEDVVREAEKELRDAKRRR

SEQ ID NO: 4829 - protein, 59 aa, Artificial Sequence
  Synthetic sequence.
REELKRLLDELKKLIDRVREEAKKNLDRSKKMIEDVERYARENLRRTKELIDDVKEKLR

SEQ ID NO: 4830 - protein, 60 aa, Artificial Sequence
  Synthetic sequence.
KIEEEVDKVRRTLEKELKEIDERHKRIVEKLREELKEAEKRHEELVKRAKEELDDVKRRE

SEQ ID NO: 4831 - protein, 59 aa, Artificial Sequence
  Synthetic sequence.
EDLLRKLLEELDRIRKEVRERLKRNLDRLKKLIDEVREYLERNLRRTKKLIDRVREDAR

SEQ ID NO: 4832 - protein, 60 aa, Artificial Sequence
  Synthetic sequence.
DVEEELRELIERLKEVLDRLREESKRVIKELRDTLRELEERSRDIIRKLEETLRDVARKS

SEQ ID NO: 4833 - protein, 59 aa, Artificial Sequence
  Synthetic sequence.
DEFLRRVLERAKKIVRKLEEDARRVLEETEDLIRRLREKAERVHEKTKKIIKEITEELK

SEQ ID NO: 4834 - protein, 60 aa, Artificial Sequence
  Synthetic sequence.
SVEDALRKLIEELKRVLKKLEDDSRRIIEELRKVLKDLEDRSRKVIEEIKDDLRKIAEKS

SEQ ID NO: 4835 - protein, 59 aa, Artificial Sequence
  Synthetic sequence.
EEVAKRLLDKARDIVRTLKEEAERVHERSRRIIEELRREAEEVLEETRDILRRLREEAK

SEQ ID NO: 4836 - protein, 60 aa, Artificial Sequence
  Synthetic sequence.
SELEKVLEKLKDLLRKVREKNERVLREVEERTRRVKRDLERVLKEAKDILRKAKKLADDG

SEQ ID NO: 4837 - protein, 59 aa, Artificial Sequence
  Synthetic sequence.
EEIARRIKKVLDDWKRVSEESKRRIEELLKRDKEELEKIKRAAKKVIDELKRLLEEAER

SEQ ID NO: 4838 - protein, 60 aa, Artificial Sequence
  Synthetic sequence.
SRAEEILKRLEELIKRLKEENDRVLEENKRLIEELEKKNRDALRRIEELLKELKDIARRI

SEQ ID NO: 4839 - protein, 59 aa, Artificial Sequence
  Synthetic sequence.
EDLEEKLRRLLDELRKISEEVEERSERSNKELEDVSEDSKRKLRKILEDLRDLLRRTEK

SEQ ID NO: 4840 - protein, 60 aa, Artificial Sequence
  Synthetic sequence.
SRAERILEEMERLIEEVRKENERVLRENRRLIKELKEENERILRELKRLIKEAKEIVERI

SEQ ID NO: 4841 - protein, 59 aa, Artificial Sequence
  Synthetic sequence.
EEVDERLERLLKTAEDDSRRSDKRSEDSNRELRKVSEDSRKRLEELLKDAERKLREDEK

SEQ ID NO: 4842 - protein, 60 aa, Artificial Sequence
  Synthetic sequence.
DDVDRILEELKRLVEENRKRNEDIERELEKLIKEVEDSNRTMLERMEDLIRELRDIVRRI

SEQ ID NO: 4843 - protein, 59 aa, Artificial Sequence
  Synthetic sequence.
EDAERRLKELLEDAKRVSDEVLRRLTELLKKAKDVSDESRERLRRLLEDLERDLKRERT

SEQ ID NO: 4844 - protein, 60 aa, Artificial Sequence
  Synthetic sequence.
SDAERLLRELERLVEENRRRNKKVLDDNERLVEKLEKSNRRALEELKELVDRLEDIARRI

SEQ ID NO: 4845 - protein, 59 aa, Artificial Sequence
  Synthetic sequence.
ERVREELERLLEEAKRDSDEVRERSKKSNKKLEDVSRKSKKDLRDLLKKARDILKETER

SEQ ID NO: 4846 - protein, 60 aa, Artificial Sequence
  Synthetic sequence.
SDAEEVLKELERLIREVEERNKDILRKAKELVRDNERKNREVMERLKKLIEDLKKIAKEI

SEQ ID NO: 4847 - protein, 59 aa, Artificial Sequence
  Synthetic sequence.
EEVEKRLKDLLREAEEVSRRSEERLRELLKELEDVSREVKRRLERILEELKRILDEVEK

SEQ ID NO: 4848 - protein, 59 aa, Artificial Sequence
  Synthetic sequence.
DEVEELTERLKRVLEDNRRTAEEVKERTRRVIDKVRRDYEELEKRLKKILKEIEDLSRE

SEQ ID NO: 4849 - protein, 56 aa, Artificial Sequence
  Synthetic sequence.
EDTVRRLIKEAKDDNDRMEEENRRLIRELEEVSKRAHKRLRELIRRIEELLRREET

SEQ ID NO: 4850 - protein, 59 aa, Artificial Sequence
  Synthetic sequence.
SAEEEVRKIKREIEKVLRESEREIERVEKEIRDVLRKSEREIERVKREVDKVLEEVRRA

SEQ ID NO: 4851 - protein, 56 aa, Artificial Sequence
  Synthetic sequence.
LEDLLREVKKAIEKNEKDNRDVLREVEEKIRRDEKRNKEVLEDAKRKIEELKKRAD

SEQ ID NO: 4852 - protein, 59 aa, Artificial Sequence
  Synthetic sequence.
SAEDAIREVERKAREVLKRSKEEIDKVVKKAEEILKRSKDEVKKVADEIRRILEEVRRA

SEQ ID NO: 4853 - protein, 56 aa, Artificial Sequence
  Synthetic sequence.
LEDVLRRIEKIIRDNAEENKRVLEEAEEVLKKDEKDNRDVLEELKKILEELKRKAD

SEQ ID NO: 4854 - protein, 59 aa, Artificial Sequence
  Synthetic sequence.
SVEEAVKRLADEIRKVLERSKEELERVAKEAEDVLRRSREELKKVADEVRKVLDDVRRA

SEQ ID NO: 4855 - protein, 56 aa, Artificial Sequence
  Synthetic sequence.
LEDALRRLKEIIDENKRENEEVLKRAREIIEENKKRNKEVLDEAKEIIDRVREKAR

SEQ ID NO: 4856 - protein, 59 aa, Artificial Sequence
  Synthetic sequence.
SAEDAIRKIAEDAKKLLEDSRRELRRVVEKVKRLLEKSKEDLDRVAEEVKKVLEEADRA

SEQ ID NO: 4857 - protein, 56 aa, Artificial Sequence
  Synthetic sequence.
LEDAVREVREVLKKNKEDNDRVLREAEEVLKRNEEENRKVLEEAKRIIDELKKRID

SEQ ID NO: 4858 - protein, 60 aa, Artificial Sequence
  Synthetic sequence.
SVREELTRVKKRARDVLERSREEAERVAKRAEEVNRESEREIERVLEEVERILEDIREKV

SEQ ID NO: 4859 - protein, 59 aa, Artificial Sequence
  Synthetic sequence.
EEAVRDVLRKVREIIRRNRKENEEVLRDVERLIRELEERNRRVLKKAKEILKRIRDKAE

SEQ ID NO: 4860 - protein, 60 aa, Artificial Sequence
  Synthetic sequence.
SVEEELEKVKRKAEKLLEDSDREIKRVTKKAEKVLEDSRKAVEEVEKEVKEVLDEIRANV

SEQ ID NO: 4861 - protein, 59 aa, Artificial Sequence
  Synthetic sequence.
EKKAREVLKKVEDRIEENRRRNEEVLEKAEKIIEDNRRKNKTELDKVKEIIRRIREEAR

SEQ ID NO: 4862 - protein, 59 aa, Artificial Sequence
  Synthetic sequence.
SAEDALRKLKEDSKRVNDESRREAERLKREIEKINEDSDREVEKVKKKIEELLEKVERD

SEQ ID NO: 4863 - protein, 59 aa, Artificial Sequence
  Synthetic sequence.
ERELKRVLEEVERLIEKVKTDNKRVLDEIRKILEEIERKNRKVLKEVEDLLKTMEDEAR

SEQ ID NO: 4864 - protein, 59 aa, Artificial Sequence
  Synthetic sequence.
SLEEAVREVERKAKKVNDDSREEVKKVKKESKDVNKKSEDDARRVVEEIKKILKRIAEK

SEQ ID NO: 4865 - protein, 59 aa, Artificial Sequence
  Synthetic sequence.
ERLAKKVLDEVEKIIEDIKRRNEEVLRRVREDIKRVEEENKKVLKRVKERVEEMRRRAD

SEQ ID NO: 4866 - protein, 59 aa, Artificial Sequence
  Synthetic sequence.
EMEDEARKVIKKIKEVNRRSREESEKLSRKSERVNRESKRASEELREEIRRVLEEIRRK

SEQ ID NO: 4867 - protein, 59 aa, Artificial Sequence
  Synthetic sequence.
RRKMKTVLDEVEKEIRRIEEENKKVLKESEDLIREVEKENREVLERTKRIIDEARKRAD

SEQ ID NO: 4868 - protein, 59 aa, Artificial Sequence
  Synthetic sequence.
SVDEAVKEVEDRLRKVNEESTRESKKVVDKARDVNRKSEEASRELEDRIEKVLTDIRRK

SEQ ID NO: 4869 - protein, 59 aa, Artificial Sequence
  Synthetic sequence.
ERLAKRVLDEAKRILDEVKEKNRRVLEDSERIIKEVEDRNRRVLEETRRIIEELRKEAD

SEQ ID NO: 4870 - protein, 59 aa, Artificial Sequence
  Synthetic sequence.
SVEEMVKELIRKLREVNKRSADELDRVRKRMKKLNDDSRKAVKEVREKIERLLDAARRR

SEQ ID NO: 4871 - protein, 59 aa, Artificial Sequence
  Synthetic sequence.
ERLAEEVLRRVEKKIEDIRRRNEKVLRELEKILREVSEENERVLRDLERKLRKLAEDDR

SEQ ID NO: 4872 - protein, 59 aa, Artificial Sequence
  Synthetic sequence.
SVEDEIRKVKDELRRVNEKSTRDSKRVRDRMETVNRESEKRARDVKKRIKEVLDKIRER

SEQ ID NO: 4873 - protein, 59 aa, Artificial Sequence
  Synthetic sequence.
KRLADDVLRKVRDEIRKIEEDNREVLRRSEDILRKIKERNKKVLDDVRRKIDKARRDAE

SEQ ID NO: 4874 - protein, 59 aa, Artificial Sequence
  Synthetic sequence.
KAEEAAERIKKKLEDILKRAKEESEKILDKLREVLERSKRKHEELIRRAEEVLKDIARK

SEQ ID NO: 4875 - protein, 55 aa, Artificial Sequence
  Synthetic sequence.
RDVLTELEKIIKELEKRAKEVLDTSRKSIEDLERRNEESLKRLTDDLKRAKEEAD

SEQ ID NO: 4876 - protein, 60 aa, Artificial Sequence
  Synthetic sequence.
SEVEEVLKRLEELLRDSERKVEEMERRLKEIIDRLREEAKRVLDESKESSKRLDELAKKG

SEQ ID NO: 4877 - protein, 59 aa, Artificial Sequence
  Synthetic sequence.
EEADRALRDLERKHEKRVREVDDRLKKIEDELKRVVEEIRKRLEDLKEENRRIVDRTAT

SEQ ID NO: 4878 - protein, 60 aa, Artificial Sequence
  Synthetic sequence.
SDVDEVLKRSEDSTRRLRERAERMLEELERLIRESKRTADEVLKRSRESSKRLDEEVRAG

SEQ ID NO: 4879 - protein, 59 aa, Artificial Sequence
  Synthetic sequence.
EEVRKELERLRRENEKVVREAKKRLEDIIRKHEKIVKEIKEALDKLLEDNKRIVDRTSK

SEQ ID NO: 4880 - protein, 60 aa, Artificial Sequence
  Synthetic sequence.
DELEDVLRKAKELIKRDRDEVRRVLEELKRSTEDLRRKVRDVERRLKELIDELDDIARKI

SEQ ID NO: 4881 - protein, 55 aa, Artificial Sequence
  Synthetic sequence.
KELEKIKKELEDVIRETRERLKKVLDETREDIKDVDRRLRKLEEEIRRKVEEDER

SEQ ID NO: 4882 - protein, 60 aa, Artificial Sequence
  Synthetic sequence.
SELEEIIERIKRLIEEDRETVKEVLERLRRLSDEDRKEVKRVLREIKELIKELEDLRRRI

SEQ ID NO: 4883 - protein, 55 aa, Artificial Sequence
  Synthetic sequence.
EELERLKEEAKRVIKRTRDELEKILRENRELIDRSRKELRDLEKELRDVVRESER

SEQ ID NO: 4884 - protein, 60 aa, Artificial Sequence
  Synthetic sequence.
SVREELEKLVRELRRLLEKSKRDTDRLSEEMEELNRRAEELIRTIERRLRELLRKIRENV

SEQ ID NO: 4885 - protein, 59 aa, Artificial Sequence
  Synthetic sequence.
EKLVEELKRRAKKVIRELEELSRRATEEVKRVLKENEDLVREVEKDLEEILKRIKDRAD

SEQ ID NO: 4886 - protein, 60 aa, Artificial Sequence
  Synthetic sequence.
SLEEELKKLEEEVRRLLEKSKEDTDRLKKEIEDLNKKAEDDVREIRKELEKLLRDIARNV

SEQ ID NO: 4887 - protein, 59 aa, Artificial Sequence
  Synthetic sequence.
EELAKRLSDKFRRILEKLEEDSKRALDKAREILKRNEELLRELLEELRRILEEIERRAR

SEQ ID NO: 4888 - protein, 60 aa, Artificial Sequence
  Synthetic sequence.
KAKEELDRLRKEARDLLEDSKTKTKRLVEEMDKVNEDSKRESKKLLDELEKLLRDIEKRV

SEQ ID NO: 4889 - protein, 59 aa, Artificial Sequence
  Synthetic sequence.
DKLVEKLREEVERILERVKELSKKAIDEVKEVIKRNRDLSKRVIERAKEILRRIEEKAR

SEQ ID NO: 4890 - protein, 60 aa, Artificial Sequence
  Synthetic sequence.
SVEDELRRIEEEMKRLNEKVERDSRRVLKEVEDLNREIKKRSDDLEREIRRLLEEVKRRK

SEQ ID NO: 4891 - protein, 56 aa, Artificial Sequence
  Synthetic sequence.
IRELLKELRKILDDNRETARKVLEDSKRIIERNKREAEKLERRSRKILKDIEDEAR

SEQ ID NO: 4892 - protein, 60 aa, Artificial Sequence
  Synthetic sequence.
SVEEELRRLEKRIEELVREIERRLRELKKEVEELNERIKRASDEILDRIRRLLEEVRRRK

SEQ ID NO: 4893 - protein, 56 aa, Artificial Sequence
  Synthetic sequence.
VRDVLREVERIIRELEERARDLLRRIREIIRRNEEKLERLLRRSKEILKEIEERAK

SEQ ID NO: 4894 - protein, 59 aa, Artificial Sequence
  Synthetic sequence.
STERKLEELEKEAEKDLKEVEDRLKELNDHHDKRVKEVEDRLRRANKHHRDRLEDIRRR

SEQ ID NO: 4895 - protein, 56 aa, Artificial Sequence
  Synthetic sequence.
TDEVLKRLKDLIKELRDEVRKVLTEHREIDKRVEEEVKRVLDEHREIDKRLDEETK

SEQ ID NO: 4896 - protein, 59 aa, Artificial Sequence
  Synthetic sequence.
SSKEKIERLREKLEDLVRRVRKRLRELNEHHKELVKRIEDTLRELLRHHDELLKEAERR

SEQ ID NO: 4897 - protein, 56 aa, Artificial Sequence
  Synthetic sequence.
TEDVLRRIEELIERLKREVDRVEREHERIDEEVRKRAEDIERRARDIDREVKETTR

SEQ ID NO: 4898 - protein, 59 aa, Artificial Sequence
  Synthetic sequence.
SVRETLERMLRHHAELVERVRRELRKLNKHHRDEVKRVEERLDELRKHHEELLRRAEKD

SEQ ID NO: 4899 - protein, 56 aa, Artificial Sequence
  Synthetic sequence.
AKKVVEDLRRINERVKDEVRRALREHERIDKEVREIVEEIERRAEKIDEELKRTID

SEQ ID NO: 4900 - protein, 59 aa, Artificial Sequence
  Synthetic sequence.
SVEEALTEIKKRLDKKVEDIERELKKLLDHHKELVDDVRRKLEELNRHHDRLLDEIRKD

SEQ ID NO: 4901 - protein, 56 aa, Artificial Sequence
  Synthetic sequence.
KDEVLKRLEDLIRELDRRVKEIEKRAEEIDRELEDRVRKVLDEHRKIDERAARETD

SEQ ID NO: 4902 - protein, 59 aa, Artificial Sequence
  Synthetic sequence.
ETKERLDEILKHHEEEVKKVRKRLDELLRHHEELVKEVDKRLKEMNDHHRRLLDEADKD

SEQ ID NO: 4903 - protein, 56 aa, Artificial Sequence
  Synthetic sequence.
KDDVLRRLEDINRRLEERVRKAERRLEEIDEKAERITEKVKREHEDIDRRVEDIKR

SEQ ID NO: 4904 - protein, 59 aa, Artificial Sequence
  Synthetic sequence.
SVKERLDEVRRHHEDEVRRVDEKLKEILRHHEEEVRRVDKELKELLDHHKELLDDAERR

SEQ ID NO: 4905 - protein, 56 aa, Artificial Sequence
  Synthetic sequence.
AEEVKKRLDDINKRVEEIVREIEERLRRIDEKLKEIVRKAAEDIRRIDKEVEDEIR

SEQ ID NO: 4906 - protein, 60 aa, Artificial Sequence
  Synthetic sequence.
SLEELLKKIEERLRDLSRKVAEELKRILDELRELSERAKDLNRRVNETLRKLVEDITRRD

SEQ ID NO: 4907 - protein, 59 aa, Artificial Sequence
  Synthetic sequence.
EEDVKKVLDELEKLLKDNEELNRRVRKELKDLLETLRKLNERSKEELDKLIKELEDRAR

SEQ ID NO: 4908 - protein, 60 aa, Artificial Sequence
  Synthetic sequence.
REVEEILRKLKEITDRTRDLSRRNEEELRRIIRELEEMSKRNKREVEEIIKEAKELAKRT

SEQ ID NO: 4909 - protein, 59 aa, Artificial Sequence
  Synthetic sequence.
EKAREDLDRLRRENEELIERSERINKKIKEELERVIKRSEDLNKKLEEDLEKLIRDETR

SEQ ID NO: 4910 - protein, 60 aa, Artificial Sequence
  Synthetic sequence.
EEVERILTKAERVTRETERLSRENEKELKKITDETRRLSEKNIEDIERIIEEMERLARTT

SEQ ID NO: 4911 - protein, 59 aa, Artificial Sequence
  Synthetic sequence.
EDARRELKRLEEENRRLLEESEERNRRIEERNEELIEESERRNRELEKRLRDLIKETRD

SEQ ID NO: 4912 - protein, 60 aa, Artificial Sequence
  Synthetic sequence.
SAEDSIRRAEEEARRLIKRAEEEAEKSARRHKELNERARKRAKESAEEAEKLIREAARSG

SEQ ID NO: 4913 - protein, 56 aa, Artificial Sequence
  Synthetic sequence.
ARDLEEKAKKALEKAERIARKNAEDNERNLEKSKRIAERNAKKNEEALREIAKKAN

SEQ ID NO: 4914 - protein, 59 aa, Artificial Sequence
  Synthetic sequence.
SAREDIERLVKELKELVERAREAIKRSAEEHKKLNKELKDRIKEVVERLKKLIDDARRD

SEQ ID NO: 4915 - protein, 56 aa, Artificial Sequence
  Synthetic sequence.
AEELLKKAKRVIEKAEKILRENKEENERNLATSEKIARDIEDKLRKVLKRIADEIR

SEQ ID NO: 4916 - protein, 59 aa, Artificial Sequence
  Synthetic sequence.
SAEDKLREVEKHHEKLVRDIRRKLEKNLRDHAEKVDRVRKKLEEAERRLKELVDRVRKD

SEQ ID NO: 4917 - protein, 55 aa, Artificial Sequence
  Synthetic sequence.
ERVDRDLERLDREVEEIARRLTRLMEESNKRLEDIVRTIEERIKEILERLKRTAK

SEQ ID NO: 4918 - protein, 60 aa, Artificial Sequence
  Synthetic sequence.
SDVEKIIKDLEKVIDDNRRTNEKAIRDAEDIIRRSEEHSRKVIEKLKKIIKEVKEEAERL

SEQ ID NO: 4919 - protein, 56 aa, Artificial Sequence
  Synthetic sequence.
EEEVRRVEEEIKKLLEDSRRLLRRIEEESRRLDEEDERLMKEIDDEIRELLERIRR

SEQ ID NO: 4920 - protein, 60 aa, Artificial Sequence
  Synthetic sequence.
KEVEDIVDEARKRIDTVRKESKRVVEEVERRIEENKRRNEEVIKRVREDIDRVRKEADKL

SEQ ID NO: 4921 - protein, 56 aa, Artificial Sequence
  Synthetic sequence.
REELERLRREVEKLEEDDRRLLEELEKRARELLERSKKLLDEIRREMEELLKRIRT

SEQ ID NO: 4922 - protein, 61 aa, Artificial Sequence
  Synthetic sequence.
KEVEDIIREVEKRIRDSERHSKEVLDRAEEVIDDNRRKNEEVIKEAEEIIDRIRREADRLK

SEQ ID NO: 4923 - protein, 56 aa, Artificial Sequence
  Synthetic sequence.
KDLLKEVEERSRRVIEKDRELLKRLEDKVRKLVEDSRRMVKRIEEEIRKLLEDIRR

SEQ ID NO: 4924 - protein, 60 aa, Artificial Sequence
  Synthetic sequence.
SELEKIIEDIKRLIDELRKLVEDVERRNRKLSEDDKRLVEEVLKRLDELIRRLREIAKKI

SEQ ID NO: 4925 - protein, 55 aa, Artificial Sequence
  Synthetic sequence.
ERLDELRERLKRLEDEVRRRLEELERENRKIIEETEEALRRIEEKARKELEEVDR

SEQ ID NO: 4926 - protein, 60 aa, Artificial Sequence
  Synthetic sequence.
SELDDIIRKIEELIRDDERKVRKAVRENEDLSRRDEERVRKVIDEARKLLKRLEEIAREI

SEQ ID NO: 4927 - protein, 55 aa, Artificial Sequence
  Synthetic sequence.
EKLDELRKRLEDLIRETEKELRRLERENDEIEKRTEDLLRRLREELRRIVEEVER

SEQ ID NO: 4928 - protein, 60 aa, Artificial Sequence
  Synthetic sequence.
DDLERIIEEIERLIRTLEELVRDALRKSKRLLEENKKLNEEVLRRIKDLIRRLEEIARRI

SEQ ID NO: 4929 - protein, 55 aa, Artificial Sequence
  Synthetic sequence.
EELDKLREELKRLVDRVEEMLRKSEEDTERIIRKSEEDLERLERDLKRLVEEVRR

SEQ ID NO: 4930 - protein, 60 aa, Artificial Sequence
  Synthetic sequence.
KELEDIIREAEKLIEENSRKNKEMLDRSKELIERNERKNRDVIRRLEELIEDLRRIAEEI

SEQ ID NO: 4931 - protein, 55 aa, Artificial Sequence
  Synthetic sequence.
EELDRLRKKLEDNIRESEKELRRSEEETKKLIDDSERELERIERRARELLERVRR

SEQ ID NO: 4932 - protein, 60 aa, Artificial Sequence
  Synthetic sequence.
SDVEDLLRKIKKILREIAEESKRTVRENEELTDRVKKKIREIVERIRRIIKELEERLRRI

SEQ ID NO: 4933 - protein, 59 aa, Artificial Sequence
  Synthetic sequence.
KDVEDKLRELERELKKIEDDSRRLLKRLEEENRTLVKEVRERLKRLEDDVRKLKEDVTT

SEQ ID NO: 4934 - protein, 60 aa, Artificial Sequence
  Synthetic sequence.
DEVDKLVEEIKKIIEDVRRESDKTVRDNEELTKKLAEDSKRSLDEIKKLIEELRKEIERI

SEQ ID NO: 4935 - protein, 59 aa, Artificial Sequence
  Synthetic sequence.
EEVERKLKKLKEELERLVEESRRKLEELKKRNEELVRRSREELDKLRREVKETLERVKR

SEQ ID NO: 4936 - protein, 60 aa, Artificial Sequence
  Synthetic sequence.
SDAEEILKEIERLIREVEKTSRRTVEEDERVTEEVRKKSEKSVRDIEELLKEIKRELEEI

SEQ ID NO: 4937 - protein, 59 aa, Artificial Sequence
  Synthetic sequence.
ERVERKLEELKRRLEELEKESERELDRLRKENEDLVRRSEEELRRLRRELEEIVREARE

SEQ ID NO: 4938 - protein, 56 aa, Artificial Sequence
  Synthetic sequence.
SEAEKVLKEVEDIIREVEEENRRLIREIEEEIRRVKEEVERLLRKSEKDIKEVEES

SEQ ID NO: 4939 - protein, 56 aa, Artificial Sequence
  Synthetic sequence.
EKLLREIERRMRELEKTSRKLLKEIKKKAKELKEKAEEVLRRSRKRTEELVDRLRK

SEQ ID NO: 4940 - protein, 60 aa, Artificial Sequence
  Synthetic sequence.
DVEDLIRELRKRLDELRKESEELLRRSKRKHEKLLTDSRKLLRDIEREARKLLEDVKRKG

SEQ ID NO: 4941 - protein, 59 aa, Artificial Sequence
  Synthetic sequence.
REMIETLIRKAKEIIDRLREENRRAVRRSDETLRRLKEENDKVITDVKRKIKELRDEVK

SEQ ID NO: 4942 - protein, 60 aa, Artificial Sequence
  Synthetic sequence.
SIDEEITRLEEESRRDEEESKRLLEKSRDDHRRLLERSEKLLRELEKRARDLLEDVKRKG

SEQ ID NO: 4943 - protein, 59 aa, Artificial Sequence
  Synthetic sequence.
EEMVRRVIEKYERAVERSTEENRDAFRRSEETIRELAKENEDAIREVKEIIDKLREDVR

SEQ ID NO: 4944 - protein, 60 aa, Artificial Sequence
  Synthetic sequence.
DVEELIKELERRLRKLLEDSRRLLEESRREHKKLIDDSRRLLDELRRRLERLLEKVRRRG

SEQ ID NO: 4945 - protein, 59 aa, Artificial Sequence
  Synthetic sequence.
REVIEAVIRKAEDIIRRLRRKNEKAVEESRENIKEIKRENKRVIDEAREIIKRLEEELE

SEQ ID NO: 4946 - protein, 60 aa, Artificial Sequence
  Synthetic sequence.
SVEDLLRRLEEESRKDLDDSRRLLDESRKRHEDLLRKSEELLRELEERLRRLLEKVKKKG

SEQ ID NO: 4947 - protein, 59 aa, Artificial Sequence
  Synthetic sequence.
EDVIRKLIEDYERLVKESTDRNRRAVEKSRENLKRLDKENRDVIEKARRIIEELEKEVK

SEQ ID NO: 4948 - protein, 59 aa, Artificial Sequence
  Synthetic sequence.
SVDELIEELRRRLEKLLREAEELLKESRKRHEELKKRSKELLDELEREVERVLEELRRK

SEQ ID NO: 4949 - protein, 59 aa, Artificial Sequence
  Synthetic sequence.
EEVIERVIRKADEIIKRLKKELREVVERSKENIKKLEEENRRVIKKAREELRKIEEEIR

SEQ ID NO: 4950 - protein, 60 aa, Artificial Sequence
  Synthetic sequence.
SEVDEVLKTLKELIERLRERVKEVLKRLEKLLKELEDLSRETVRELRETNDDLRRKAEKT

SEQ ID NO: 4951 - protein, 56 aa, Artificial Sequence
  Synthetic sequence.
REAAEKVRRDVDRLRKEVEEMLERVKRKLDELRKDSDRLAREVEDSTRKIERDVEK

SEQ ID NO: 4952 - protein, 61 aa, Artificial Sequence
  Synthetic sequence.
SELEEMVKKVKEIIDRARERIRELIERHKELDRESRKRIEDIIREARELNKDVKRVIKEIK

SEQ ID NO: 4953 - protein, 56 aa, Artificial Sequence
  Synthetic sequence.
DEALEELKRRVKRLEEKLREDIKRLRENNERIREDVERLAEELDRHTRKLMEEVKK

SEQ ID NO: 4954 - protein, 60 aa, Artificial Sequence
  Synthetic sequence.
SELEDIVEKAKKIIEDVRRRIEKLIRDDKRLNDESKKTIEELIRKARKLNEEAERIIRKI

SEQ ID NO: 4955 - protein, 56 aa, Artificial Sequence
  Synthetic sequence.
RELLEKLRRDVEELEREVRELLERLKENSKRIEDEVRELMKELKRHTEELEREAER

SEQ ID NO: 4956 - protein, 60 aa, Artificial Sequence
  Synthetic sequence.
RELEEIVERAKEIIRRVAEKIKKLIEEAERLDRDSKRKIDELIEKVKKLNEDVRRTIEEI

SEQ ID NO: 4957 - protein, 56 aa, Artificial Sequence
  Synthetic sequence.
EEMLRRLTELLKELADEVKKLLDRLKENNEKIREDVERLLRELEEHTKKLEEDVTR

SEQ ID NO: 4958 - protein, 60 aa, Artificial Sequence
  Synthetic sequence.
SEEERVLKELEDVLREHKRKADESSRKLEEVHRRHRKRMEESKRELEEVHKEAKDRITKN

SEQ ID NO: 4959 - protein, 55 aa, Artificial Sequence
  Synthetic sequence.
EELEDVERKARELEERNKKLLKDSEEATEELRRENEEMLEESKRRTEKLEREVRT

SEQ ID NO: 4960 - protein, 57 aa, Artificial Sequence
  Synthetic sequence.
DKVREVLRESEKLLEDWDRELKEVLKDFKRTLDELEERLRDVLRKNKKSLEDLKRRG

SEQ ID NO: 4961 - protein, 55 aa, Artificial Sequence
  Synthetic sequence.
DRIMRELRELNRRLDESVKEIRDRLRRILDKLRKMIEKLKKELEDTDRELEERVR

SEQ ID NO: 4962 - protein, 57 aa, Artificial Sequence
  Synthetic sequence.
SKAEEVLKTSEKLLEEWRRRVKEVEDRNEETIKRLKEELDRALKENEESLRELEKRG

SEQ ID NO: 4963 - protein, 55 aa, Artificial Sequence
  Synthetic sequence.
DRISEELKKLNEELERELRKLSEELKEVDREAKEEIRRLVEELREIDKRLEEETK

SEQ ID NO: 4964 - protein, 57 aa, Artificial Sequence
  Synthetic sequence.
SEAEKVLTDFRDALEKDRERNERVLRENEETIRRDKEENERVLRENDKSLKELRKRG

SEQ ID NO: 4965 - protein, 55 aa, Artificial Sequence
  Synthetic sequence.
DRIKKTLERLLRESKKASEKLKDDLRKLDKRSKEESRRLTERLREIDEELRRRVD

SEQ ID NO: 4966 - protein, 57 aa, Artificial Sequence
  Synthetic sequence.
SEAEDVLRRFEEELRRDDEKNERVLRRNEETNRRDDETNRDVLRRNKESLDKLRKRG

SEQ ID NO: 4967 - protein, 55 aa, Artificial Sequence
  Synthetic sequence.
KRIKDELRKLLKRSEERSEELRRRLEDLDRRSKETSDKLREELERLDRDVERKVN

SEQ ID NO: 4968 - protein, 57 aa, Artificial Sequence
  Synthetic sequence.
SEAEKVEDDVRRVLETDEKKNRDVLDTNRRTIEEDRKRNEEVLRKARKMLEDLKRRG

SEQ ID NO: 4969 - protein, 55 aa, Artificial Sequence
  Synthetic sequence.
ERLRETLEELLRRSDERSRRIMEDLKRLDTDSKRVSEELKRRLEELLKDLERKVR

SEQ ID NO: 4970 - protein, 59 aa, Artificial Sequence
  Synthetic sequence.
SEVDEITKELEESLKDLDRVVRELREKIKKIDKELAETVDKLTEEAKEILKTLRDIIRR

SEQ ID NO: 4971 - protein, 62 aa, Artificial Sequence
  Synthetic sequence.
KKLKEKVDRVHKRHKDRLDEIKRKLKKVLEDNRETLERIKRKLRKVLEDLKRMLDELERELR

SEQ ID NO: 4972 - protein, 60 aa, Artificial Sequence
  Synthetic sequence.
KETEDLVRRLRKVLKELEERVRTLMRDNERVNKEIADKIRRLREKLREEDERVDEVVKRR

SEQ ID NO: 4973 - protein, 55 aa, Artificial Sequence
  Synthetic sequence.
REVLREMDERVKELEERLERVLRKSKTDADRWRRELKRVLEEHDKTVKEIREKTR

SEQ ID NO: 4974 - protein, 61 aa, Artificial Sequence
  Synthetic sequence.
KEKDEVVKRYEDRIKEIRERLKEVVTEHEDRLRKWRKDLEEVVERNRRSIKKIDEEVKRRG

SEQ ID NO: 4975 - protein, 55 aa, Artificial Sequence
  Synthetic sequence.
EDVVRKLDEDLKRNEDHLEEVRKELERLNEEIEKLIRDLLEILRRIDKELRDKLE

SEQ ID NO: 4976 - protein, 61 aa, Artificial Sequence
  Synthetic sequence.
DEEKDVTRRVREVIKRLEEELEEVVRRHRESLKRLKERLEEVVRRNRKSIREIEKEVKDAG

SEQ ID NO: 4977 - protein, 55 aa, Artificial Sequence
  Synthetic sequence.
EDVDRELARMLEELRDLLRRLAEELKRIDEELEKELRDVARELEKIDRDMREELR

SEQ ID NO: 4978 - protein, 61 aa, Artificial Sequence
  Synthetic sequence.
DERKEVEERYRREIERIKTKLKEVVKRHEDSLKKIEDDLEEVRRDNERSIKEIREEVRKKG

SEQ ID NO: 4979 - protein, 55 aa, Artificial Sequence
  Synthetic sequence.
EDVDRELKEDLERNERHLEEVTRRLRKIDKDLKEKLKRLEEELKKIDREARERLR

SEQ ID NO: 4980 - protein, 60 aa, Artificial Sequence
  Synthetic sequence.
KEIEDVKRRLEELDRRIKELVDRVRRKLEEVDTRAEKELRDVRRRLEELLERLEELIRRG

SEQ ID NO: 4981 - protein, 58 aa, Artificial Sequence
  Synthetic sequence.
KELRDVIKENEDTLRRLKEEVEKVTKENEETLRRIERELDKVERDVERRIRELEEERR

SEQ ID NO: 4982 - protein, 57 aa, Artificial Sequence
  Synthetic sequence.
SEVEKVLEDNKRSIDRLEEELRKVTRTSRELLKEWAKRLEDVLRDVKRAVDELETRG

SEQ ID NO: 4983 - protein, 59 aa, Artificial Sequence
  Synthetic sequence.
SDEIRKLKEELKRLDEEAARILETIMRRNKDLNDRLREIIETLKKRLKDLLKEVEDRAR

SEQ ID NO: 4984 - protein, 60 aa, Artificial Sequence
  Synthetic sequence.
DAEKLREDVERTLRRLRKELKDSIKRNREELERLERKLRKSIKETEDEVRKLEEKLERRL

SEQ ID NO: 4985 - protein, 55 aa, Artificial Sequence
  Synthetic sequence.
DDVRRLVEKIEREVRKLIEDHKKKSEDIVRTVEKLIEDHKRRVDRISEEVEEELR

SEQ ID NO: 4986 - protein, 61 aa, Artificial Sequence
  Synthetic sequence.
SKEDLKRKVKKILEDVERELRRSIEDTERLLREVEKRLEDSVRENRRKLREVEEKLRRRLK

SEQ ID NO: 4987 - protein, 55 aa, Artificial Sequence
  Synthetic sequence.
RRVDELVKEIEERARKLIKEHRDRVRELLRELEELIERHKELSERILKELEELLK

SEQ ID NO: 4988 - protein, 58 aa, Artificial Sequence
  Synthetic sequence.
SEKEEIARRLEKVHREHREELKRLEDRLREVLKRNRETIEDIRRKLEEVLRRLRERLV

SEQ ID NO: 4989 - protein, 56 aa, Artificial Sequence
  Synthetic sequence.
EEKLRRDVERIVKEAEDTLRELERVVRELEKEVRETDKRLDERVKELEEKVRRAAK

SEQ ID NO: 4990 - protein, 59 aa, Artificial Sequence
  Synthetic sequence.
SEEEDARRLLEEVERALREIKKRLKELLERHRRAVEELKKRAEDLLDEHRRAIERIADE

SEQ ID NO: 4991 - protein, 55 aa, Artificial Sequence
  Synthetic sequence.
EEIKRRLKELAKDLRRAIKEVKERLKESHDELKRAIEDVKRKLEELDEKLKRDED

SEQ ID NO: 4992 - protein, 57 aa, Artificial Sequence
  Synthetic sequence.
SERERVERSVEELIRRYREVLEESERRNRKLLKRYEDALKKSREDNKRLLDELRRAN

SEQ ID NO: 4993 - protein, 56 aa, Artificial Sequence
  Synthetic sequence.
REDAERLLERIERHLRRSEKTSEELNRRLEDHARRSIEESKKLNEELERKLRELER

SEQ ID NO: 4994 - protein, 57 aa, Artificial Sequence
  Synthetic sequence.
SSEETLRDINRKISKAIEEIEREAREIDRELRKAVEDLKREAEEIDERVREVIERIG

SEQ ID NO: 4995 - protein, 62 aa, Artificial Sequence
  Synthetic sequence.
TEVKKVLDKNEELLKRWEDRLREVLERNRKTLREIERELEEVLRKNRESIKKLKRELEEASR

SEQ ID NO: 4996 - protein, 57 aa, Artificial Sequence
  Synthetic sequence.
SSEEDLKRIDDELDKMVKDIERKIRRIDTELERVVKELKEDIERSLERLREVVERIG

SEQ ID NO: 4997 - protein, 62 aa, Artificial Sequence
  Synthetic sequence.
RDVRRVLDENRKTLEDLKRKLKEVLDRNRETLKRIEKELREVHEKHNRALDELRKELEDRRR

SEQ ID NO: 4998 - protein, 57 aa, Artificial Sequence
  Synthetic sequence.
SVEEEAEDILRRLDKTVRDLEREAEKIDEDLERVVRKLEEELRRSLEELRKVVEEIG

SEQ ID NO: 4999 - protein, 62 aa, Artificial Sequence
  Synthetic sequence.
RDVTRVLRKAERVLKEIEEKLRDVLRRNRETLKRIEDELERVHRDHNRKLKRLKEELDERRR

SEQ ID NO: 5000 - protein, 56 aa, Artificial Sequence
  Synthetic sequence.
DEDRDVEEKIKKIIKAAEDVNKESEERITELKKRLREIHERSERLIRRIEEEAKKK

SEQ ID NO: 5001 - protein, 56 aa, Artificial Sequence
  Synthetic sequence.
KKKLDEIIERLRKLLEDLEERNRRVIKELEDLIKENEELNRKVIRDLEKLVEDAER

SEQ ID NO: 5002 - protein, 55 aa, Artificial Sequence
  Synthetic sequence.
DEEDEVRKRVEESERESRKLLTDVKREADRLKEHDKRLLDEVKKLLDKIREDLKK

SEQ ID NO: 5003 - protein, 60 aa, Artificial Sequence
  Synthetic sequence.
REELKRELDRIIEELKELNKRLEERLRELIRDWERVSRELAERLKRIIDKARRLLEEVAR

SEQ ID NO: 5004 - protein, 57 aa, Artificial Sequence
  Synthetic sequence.
DEVEELLKELKDLSRESVRELRRLDEELKDLSRRSLKRLTDLDEELRREVEERRKEN

SEQ ID NO: 5005 - protein, 55 aa, Artificial Sequence
  Synthetic sequence.
ERLKKLADDSRKRLRDVERHHEKLVEDSERRLKTIKDHHKKAVEDIRRDLRETKR

SEQ ID NO: 5006 - protein, 56 aa, Artificial Sequence
  Synthetic sequence.
SEIDEVLKEIKRIIDELRERNRKHNEEVKDRIRRLEEELRKDLKDLKEIVERLAKS

SEQ ID NO: 5007 - protein, 58 aa, Artificial Sequence
  Synthetic sequence.
EAADRARELEKELKDISDTSRKSNEELRKRLEEIKDRVRKEIEKLLRELEEIVKEKRR

SEQ ID NO: 5008 - protein, 60 aa, Artificial Sequence
  Synthetic sequence.
DEEKETIKRHRESVREAERRLRDTLRRNRELVERLKRTLEDILRKHEKLVEELEEMAKRG

SEQ ID NO: 5009 - protein, 55 aa, Artificial Sequence
  Synthetic sequence.
EELKESHKDLKKIHEDAERRVRESHTDLRRIIEKVKEDLERSHRKLKRIADETRK

SEQ ID NO: 5010 - protein, 57 aa, Artificial Sequence
  Synthetic sequence.
SEMEEVLERDERKVRELEREIEKNLRDHKDEVRRLREDLERVLREDEKLVRELRKKN

SEQ ID NO: 5011 - protein, 59 aa, Artificial Sequence
  Synthetic sequence.
EELEDRMRRSSKRLEEVLRESEERLKRSDEDLRRVIDEIRRRLEESTRRLEETIKELKD

SEQ ID NO: 5012 - protein, 60 aa, Artificial Sequence
  Synthetic sequence.
SEREEVLKDIRRLLDEVRRRIEDLLEKLRRLNEEVKEKVKESEKRLRDLMRKAKELMKRG

SEQ ID NO: 5013 - protein, 55 aa, Artificial Sequence
  Synthetic sequence.
EDIKRLIEELEKLLKEAKEKAEDLTREHDDTLKKIRERHKEIIKDIEDKLDTDRQ

SEQ ID NO: 5014 - protein, 60 aa, Artificial Sequence
  Synthetic sequence.
DEEEELKKKLKAILEDLKREMREHEEKLRRSLERVARTAERHKETIKRIIDRLRKEAEDV

SEQ ID NO: 5015 - protein, 55 aa, Artificial Sequence
  Synthetic sequence.
EEVKRIAEDIKRVLEEIRKRSREILEEVKRLHKKIKDDSRKLLKDLEKLVREIRK

SEQ ID NO: 5016 - protein, 56 aa, Artificial Sequence
  Synthetic sequence.
SVEDEARRLEEKLRELTKRAREALEESNRRHRKSVEEVRRSLKKNHEKLEELARRV

SEQ ID NO: 5017 - protein, 55 aa, Artificial Sequence
  Synthetic sequence.
ERLLKELEDLIEEVERELRRVLTESKRLNEELRKRVKEIEERSEELIERLDREVR

SEQ ID NO: 5018 - protein, 56 aa, Artificial Sequence
  Synthetic sequence.
SMDESMETLTRELEDLLRKVEKKLRDSNEHHRELLEEVKRRVEENHKELDELLRRA

SEQ ID NO: 5019 - protein, 55 aa, Artificial Sequence
  Synthetic sequence.
EELLTKIRKLIRDVEETVREAERESRALDERLERTVRDVEEKSKRLIEELRRRAD

SEQ ID NO: 5020 - protein, 56 aa, Artificial Sequence
  Synthetic sequence.
DAEEEIRRIDKHHEENVRKAEEDIRRLIEHHKENVERVDRELRKIIREVEEVIRRV

SEQ ID NO: 5021 - protein, 59 aa, Artificial Sequence
  Synthetic sequence.
ERLVRELIRRLERTDEEHHKKVRRILEELKRIDEEHHRLVRRILKALKDIIKRLREEVK

SEQ ID NO: 5022 - protein, 56 aa, Artificial Sequence
  Synthetic sequence.
SLEEEIEKIERHHRKLVEEARRELKRLEDKLEKLNRDSRKRLKELAERLKKLIDEI

SEQ ID NO: 5023 - protein, 59 aa, Artificial Sequence
  Synthetic sequence.
ERVARRVLDELRRLNEKLRRMVEELVKEIERLIKKVKDDSEDVMRKLKELLKRLEDRAR

SEQ ID NO: 5024 - protein, 59 aa, Artificial Sequence
  Synthetic sequence.
REKEELLERLKKVLERTERVIRDLERRLREVLERSRKLAEDLVERLERSLKTLEKLARE

SEQ ID NO: 5025 - protein, 55 aa, Artificial Sequence
  Synthetic sequence.
EELREIYKRHEDLLRTAEERLRKVYDDHRDLLRKIDEDLKRLKERHEELLREIRR

SEQ ID NO: 5026 - protein, 60 aa, Artificial Sequence
  Synthetic sequence.
EEKDRLKKRLEELNREHEELVRRISERVRRLLEKAEREIRTLKKRLDELNKELEEIIRRD

SEQ ID NO: 5027 - protein, 59 aa, Artificial Sequence
  Synthetic sequence.
EKVKKELEDVERHSRDSSRRVKEELERLKEELDRRLRKVKEDLERVKRHSKKLVDDAKR

SEQ ID NO: 5028 - protein, 61 aa, Artificial Sequence
  Synthetic sequence.
SEREDLRRELEELLREHEEVVKEVKRRLEELLREHEEIVRELTERLKTINEDLKRVIKRDK

SEQ ID NO: 5029 - protein, 59 aa, Artificial Sequence
  Synthetic sequence.
EEAEKELRDVAKRLRESSREVRETVRDVADKLRESSKKLEEELRRVKKHSKKLLDEAKK

SEQ ID NO: 5030 - protein, 59 aa, Artificial Sequence
  Synthetic sequence.
SLEDLLRKVEEDAKRSIEKLEKDLKRVEDKHRELVERVKRRLDDVRRKLEEIIRDAERK

SEQ ID NO: 5031 - protein, 59 aa, Artificial Sequence
  Synthetic sequence.
ERVVREVLDELRKLLDDHNKKVKTVLDELKRSLDKLREEVKKVEDKLEEILKTLKETVR

SEQ ID NO: 5032 - protein, 55 aa, Artificial Sequence
  Synthetic sequence.
SLEELIREIEKELDDLLREHEDLLRKIKEEIERLIREARELIKRLEEENEELRRN

SEQ ID NO: 5033 - protein, 59 aa, Artificial Sequence
  Synthetic sequence.
EEEVKREIDRVRRVIEELRESVERLREEVRETLRRLKEHVKKDVEDHKETVKEVERRTR

SEQ ID NO: 5034 - protein, 56 aa, Artificial Sequence
  Synthetic sequence.
DTEDLIREIRRRLEESVRENKELLDRLRERLEESIKRNEDLLKRHRENSKRIADRV

SEQ ID NO: 5035 - protein, 58 aa, Artificial Sequence
  Synthetic sequence.
ELVKEMIDRLRDLLRRHKEESKRLVEEVKKLLDRHREESERLVRELDKMNKDLEDRAR

SEQ ID NO: 5036 - protein, 55 aa, Artificial Sequence
  Synthetic sequence.
DTKELLDELRKRLEDSARRVEELEKRVKDELERLKKRSEELLDEIRKRMKDVRDR

SEQ ID NO: 5037 - protein, 56 aa, Artificial Sequence
  Synthetic sequence.
KDELVRRLDETLKDHDRKLKELVDEAKELLRRYEEESKRLKRELDEILRRVREEAK

SEQ ID NO: 5038 - protein, 60 aa, Artificial Sequence
  Synthetic sequence.
REIEEVRKKVEKILRDYDKVVKDIVEKVRRILEEYRRKSEKLTREIEEILRRLREVIKRD

SEQ ID NO: 5039 - protein, 56 aa, Artificial Sequence
  Synthetic sequence.
EDSLREIRKEARRLHEKSKKLLDEIRKRAEDLERETKKLLDDIKRELEDVVRELEK

SEQ ID NO: 5040 - protein, 56 aa, Artificial Sequence
  Synthetic sequence.
RELEELLKRAEEVIKELKKSIDTMKEENDRLITELAKRVEDLKKRNDDVLERLKKD

SEQ ID NO: 5041 - protein, 56 aa, Artificial Sequence
  Synthetic sequence.
EEVLKEIDKRLKELEKEHEKVNRESEKRLEELLRRVEKVNRDSERELERLREERET

SEQ ID NO: 5042 - protein, 57 aa, Artificial Sequence
  Synthetic sequence.
SEIEEVLERAERLLRRVAEALRRTTKELEDLNREVADLLRRTTEKAERLIRRVKSKI

SEQ ID NO: 5043 - protein, 56 aa, Artificial Sequence
  Synthetic sequence.
VEELKRVADEVVKKADDLVDEDRKLAKDSVDELRRLVEKDEKLAKDVVEEVEKLAE

SEQ ID NO: 5044 - protein, 60 aa, Artificial Sequence
  Synthetic sequence.
SLEDAVRKARELIKRAEDILRRAVEEAKKLHKRSKEILEKAVEDAKRLYEEAKDAARKAG

SEQ ID NO: 5045 - protein, 56 aa, Artificial Sequence
  Synthetic sequence.
AKTILDKAREVAERVARLARKLLEDSRKVARESAELAKRLLEYAKKSAEDAKRKAK

SEQ ID NO: 5046 - protein, 60 aa, Artificial Sequence
  Synthetic sequence.
SIDEVLKELEDVARKSKEKNKRVHDDDERVVREVHKENRRVLRELEEMAERVRRELEKRG

SEQ ID NO: 5047 - protein, 60 aa, Artificial Sequence
  Synthetic sequence.
EEKVVRRVKDIARHNLELADRSVEESRKSVKENKDLVDRSVKKVEDLVRELKRLVDEIKR

SEQ ID NO: 5048 - protein, 60 aa, Artificial Sequence
  Synthetic sequence.
SIDEALTRLERAVEESHKRNEDVHRRDEEAVREVHKRNREVVKKLEDEVRKVIERLRRRG

SEQ ID NO: 5049 - protein, 60 aa, Artificial Sequence
  Synthetic sequence.
EEEVVRRIDELVEHNKDLVRRSVDESDKSVETNKDLVEKSVRRVDKLVKDLRRLVDEIER

SEQ ID NO: 5050 - protein, 60 aa, Artificial Sequence
  Synthetic sequence.
KIDEALKRLREVVKRSHEENEEVHKEDEKVVRELDKENKDVLKELDEAVKRVEKKLRDRG

SEQ ID NO: 5051 - protein, 60 aa, Artificial Sequence
  Synthetic sequence.
EDEVVKRIDELVTHNKRLVEESVERSKESVDRNRRLAEKSVEDVRRLVEELKKLVDDITR

SEQ ID NO: 5052 - protein, 59 aa, Artificial Sequence
  Synthetic sequence.
SLEEVLRRLEKVVRDSDKRLEEVLTRLAKVVRESNKRDEDVHKELRDVVRRVEELLERS

SEQ ID NO: 5053 - protein, 56 aa, Artificial Sequence
  Synthetic sequence.
EETVDKLVEDNERLVREIVKEVDELVKRNEDRARESVDESRKLVRRIEERVREETR

SEQ ID NO: 5054 - protein, 56 aa, Artificial Sequence
  Synthetic sequence.
SVEDVLREAKRVLDEVRERLREVNTETNKVIKDVKKESDDVNRETNELIERVAREV

SEQ ID NO: 5055 - protein, 55 aa, Artificial Sequence
  Synthetic sequence.
EEVERLVDEVRKLVKRLVEHVKKLAKEIKELLERNVRHVEEVAERIKRLIKETKD

SEQ ID NO: 5056 - protein, 60 aa, Artificial Sequence
  Synthetic sequence.
ELREDVERVVDEIRRLVEENVRRIDEVAKDIKRLADDNVRRVKELVRKIEEDIRRLKEEG

SEQ ID NO: 5057 - protein, 56 aa, Artificial Sequence
  Synthetic sequence.
ERVLKKLKEVIEDVERKSRDALRRLEEAIRRVRRESERVNRELDEVIKRVTEELKK

SEQ ID NO: 5058 - protein, 58 aa, Artificial Sequence
  Synthetic sequence.
SAREKVEKVVKEVEELVKRDVEEVERIVEEVKKLVTEDLKISEEIVERVDRLIRELKK

SEQ ID NO: 5059 - protein, 56 aa, Artificial Sequence
  Synthetic sequence.
ERVLKKLEDVVRRVEKESEDALRRLKEVIKKVKRESEEANRKLEEVIRRVVERVRR

SEQ ID NO: 5060 - protein, 59 aa, Artificial Sequence
  Synthetic sequence.
SRSEKLVDEARKMVERSKEIVDKSEREVEDVVRRARRNVEKVLKDAKKVVDEVDELTKR

SEQ ID NO: 5061 - protein, 55 aa, Artificial Sequence
  Synthetic sequence.
EDVLREVEELVRRVEEENDRVLKRAKELVEDVKRKHDRVLETVRKLVEDVTRRLK

SEQ ID NO: 5062 - protein, 57 aa, Artificial Sequence
  Synthetic sequence.
DEVDKVKEELERVIKEVDERNKRSSERLEEVNRKIRKEIKEVVERLKELIERVLRKV

SEQ ID NO: 5063 - protein, 56 aa, Artificial Sequence
  Synthetic sequence.
VDEIRRLVEEVLRRARKLVEEDKELIKKSLKDLKTIVDELRKLLEDVIREAERTAR

SEQ ID NO: 5064 - protein, 55 aa, Artificial Sequence
  Synthetic sequence.
EEVERILEDVRRMIEDHRRKVEEIVKRSEDMARRLIEEVKRIVEESKKLADELKK

SEQ ID NO: 5065 - protein, 55 aa, Artificial Sequence
  Synthetic sequence.
EDVRRELKRLVDEVKKRNDEVRERDKEVVDRVKEVLDRVRETDRRLVEEVRRRAN

SEQ ID NO: 5066 - protein, 55 aa, Artificial Sequence
  Synthetic sequence.
SRVEKILEDVKEEIKKHKEEVDRIVKRSREMAKRHIERVDEILERSRRMIEELKK

SEQ ID NO: 5067 - protein, 55 aa, Artificial Sequence
  Synthetic sequence.
EDVERELRRLVEEVEKRNEDVEREDRRLVEEVKKRNDEVRKEDRRLVEEVKERAR

SEQ ID NO: 5068 - protein, 61 aa, Artificial Sequence
  Synthetic sequence.
DELEKVEKDVRRLLEKVRKRIDEVRKEVERLSRESEEVTRRVLETVEKLLKDVERVIRETL

SEQ ID NO: 5069 - protein, 56 aa, Artificial Sequence
  Synthetic sequence.
VEEVLETVKRLIERIEEEIEKVVKDVERLVRESIKHSRDVLKEVDDLIKRIRERVK

SEQ ID NO: 5070 - protein, 56 aa, Artificial Sequence
  Synthetic sequence.
DDDKRIREILRRVHEKSEKVLRKVRKRLEEVRRESEEVVRRVKKDLDRVLEEVRRK

SEQ ID NO: 5071 - protein, 55 aa, Artificial Sequence
  Synthetic sequence.
EDVAREVEEIAKRTIDRVEAIVREVERIARESIDNVRRVVEEVKRAVTELIKRVE

SEQ ID NO: 5072 - protein, 56 aa, Artificial Sequence
  Synthetic sequence.
SEDETIRRIVRTVHEESRKSTEDVRREVERVLRESEEVVKKVKKKVDDVLKRVEET

SEQ ID NO: 5073 - protein, 55 aa, Artificial Sequence
  Synthetic sequence.
EEVAREVTKIARDTIRENEEIAKEVREIVERSIKNLEEVAEEVERVVRELIEARR

SEQ ID NO: 5074 - protein, 56 aa, Artificial Sequence
  Synthetic sequence.
SRDEKIRDILRRVLKEVRDSTKKVEEDLEDVHRRTEEELRKVKKRLDEVLKRVRDE

SEQ ID NO: 5075 - protein, 55 aa, Artificial Sequence
  Synthetic sequence.
EKVAEEVKRIADRLIDLNRRIAEEVDKIVRDSIKKVEEIVTEVEKIVEKLIRDVR

SEQ ID NO: 5076 - protein, 55 aa, Artificial Sequence
  Synthetic sequence.
DRLEKIVEEVRRLADELIRHVERNVREVEKAVRESIEHVRDVAEKVERAVRELEK

SEQ ID NO: 5077 - protein, 55 aa, Artificial Sequence
  Synthetic sequence.
EEVRKELKRVIREVEKVNKESNDVTRKVKEESEKVLKEVEKRLREVIRRVKEKIR

SEQ ID NO: 5078 - protein, 55 aa, Artificial Sequence
  Synthetic sequence.
SEVEDVVRKVEKLVRDLIKHVEENVRRVEEVVRKLIEEIKRIAEEITRIAEELAK

SEQ ID NO: 5079 - protein, 55 aa, Artificial Sequence
  Synthetic sequence.
EEVEKVLREVVKEVEKVNRESREVTRRVLEEAKEMLERVKKIVKEVIEKVRRVVK

SEQ ID NO: 5080 - protein, 60 aa, Artificial Sequence
  Synthetic sequence.
SADREVEERLREVIERVKEALKRSKDVTDEVTRRVEKLDKESNDTSREVIRRVEDMLSRV

SEQ ID NO: 5081 - protein, 59 aa, Artificial Sequence
  Synthetic sequence.
DELVKRIVEKVDKAVKDLEKLVRENVERVRRAVERSRKTVEDNVKRSRDVVRELRERVR

SEQ ID NO: 5082 - protein, 60 aa, Artificial Sequence
  Synthetic sequence.
SSIDEVREEIRRVIEEVRKLLEESKKDTDRVRREAEDMDRKANETVEEVERRVREVLRSV

SEQ ID NO: 5083 - protein, 59 aa, Artificial Sequence
  Synthetic sequence.
EEVVRRILKRIEEVLKKLRKAIKDNVDRVRDAVRRSRRTVEDIVRRVREVLERLEREIK

SEQ ID NO: 5084 - protein, 56 aa, Artificial Sequence
  Synthetic sequence.
SLAEEVERRLEESHKRARKLVKEVKEALEESHKESDRLVREVEKELKRVAEEVRKE

SEQ ID NO: 5085 - protein, 56 aa, Artificial Sequence
  Synthetic sequence.
VEKVRDLVRKTTEKVEEVVRRLRELVKENLDEAKRVVEDLKRKVKEIEEKVKEDSK

SEQ ID NO: 5086 - protein, 56 aa, Artificial Sequence
  Synthetic sequence.
SMAEKVDEVSKRSKEELKRVVKEVHEVSTRVEKVVKDVLREVEKVSKESTDVVDRV

SEQ ID NO: 5087 - protein, 59 aa, Artificial Sequence
  Synthetic sequence.
REVVDKVVRDLEKTVKDVKEVVDRAVTASKELVDRIRRLAEEVVRALERTVDKVRRDAK

SEQ ID NO: 5088 - protein, 56 aa, Artificial Sequence
  Synthetic sequence.
DAREEVDEVSRESKEELKRVLDEVDDVSEKSRKTVRDMLRKNKEVVDEVEKTLEDV

SEQ ID NO: 5089 - protein, 59 aa, Artificial Sequence
  Synthetic sequence.
KEVVKDVVRKLRETVKRVREVAEEVVRELEKTVDEVRKRADDSVKKHRDLVKEVKEAAD

SEQ ID NO: 5090 - protein, 56 aa, Artificial Sequence
  Synthetic sequence.
SAEEDVERVVREVEREVREALRRVREVSERSREDVRRVVDENRKVAEEVEKRVRDV

SEQ ID NO: 5091 - protein, 59 aa, Artificial Sequence
  Synthetic sequence.
EEVVREVVKKLREIVKDIRRLAEEVVRRLEDTVRKVREIAKRSVDAHRELVRRVEERAR

SEQ ID NO: 5092 - protein, 56 aa, Artificial Sequence
  Synthetic sequence.
SSAEEVERVLRRVEEEDRRLVAEVRRVLKESRRTLEELVRRVKEVLEEVRKEVERI

SEQ ID NO: 5093 - protein, 56 aa, Artificial Sequence
  Synthetic sequence.
AKELIKRVEEIVEESRKLIDEAIREVEENVDRSRKKIKELIDRVREILKRARDRAR

SEQ ID NO: 5094 - protein, 56 aa, Artificial Sequence
  Synthetic sequence.
DSEEEVKKVLDEVRRRDEKLVEEVRKVNEDSLDTLRKLAEEVKRKLDEVRERVERL

SEQ ID NO: 5095 - protein, 56 aa, Artificial Sequence
  Synthetic sequence.
AEELIREVERIVKKSEDMIREHIRKVEENVEESKKEIEELIRRVDDILREAKEAAD

SEQ ID NO: 5096 - protein, 56 aa, Artificial Sequence
  Synthetic sequence.
SGEEDLERVLDEVRRRDKKLVEEVRKRNEDSLRRLERLAEEVERVNEDVLKKVEEL

SEQ ID NO: 5097 - protein, 56 aa, Artificial Sequence
  Synthetic sequence.
ASEVRKLVEEIVTDSRRRITEHIRRVEENAKDSERVIREHKERVKEILEKVRRAAE

SEQ ID NO: 5098 - protein, 59 aa, Artificial Sequence
  Synthetic sequence.
SEVEKLVEDVKKAVKEVLEEAKENVRKVEDVVRRVLERAEDNVEEVKKVVATLVDLVRR

SEQ ID NO: 5099 - protein, 59 aa, Artificial Sequence
  Synthetic sequence.
EELMREVRRVIKEVRDRVRDVLDEVRRVNEEVNRRVRKVLEDVRRVNERTKEDLDRESK

SEQ ID NO: 5100 - protein, 59 aa, Artificial Sequence
  Synthetic sequence.
SEVDKLVREVDELVKKSKDNIDKLVKRVREMVEESKRKADRNVEEVERVVREIKDLARR

SEQ ID NO: 5101 - protein, 59 aa, Artificial Sequence
  Synthetic sequence.
DELVKKVRDRLEEVERRTRKALEDVKRVLEDVKRLTDTALREVERVNRKTEEEVDREIR

SEQ ID NO: 5102 - protein, 59 aa, Artificial Sequence
  Synthetic sequence.
DKVDRVVKEIEEAVKENLDRVREIVKEVRDLVRENLEEVRKSVEDVKRLVKEILELVRA

SEQ ID NO: 5103 - protein, 59 aa, Artificial Sequence
  Synthetic sequence.
EDAVRKVEEVLREVEKRSTEALKELRDVLREVRRESEEALDENRRVTEEVKKKVEDERK

SEQ ID NO: 5104 - protein, 59 aa, Artificial Sequence
  Synthetic sequence.
SEVEEIVREIRDLVRKNEERVKKIVEDVRRAVEEILELAERSVEKVKRLVDDLRRLAEN

SEQ ID NO: 5105 - protein, 59 aa, Artificial Sequence
  Synthetic sequence.
EEAVRKVDRVLEEVEKRSRDALKELEEVLKEVERLAREVLEKNERVTEAVEDLVTKAAK

SEQ ID NO: 5106 - protein, 59 aa, Artificial Sequence
  Synthetic sequence.
DEEERVREELERVNEEVKELKKEVETVNKRVHETLEKVIREVKKVNDDVHRTVEDLRRR

SEQ ID NO: 5107 - protein, 56 aa, Artificial Sequence
  Synthetic sequence.
VEEIVKKIKEVVDRTRKLAKELVKESRDLAEDVKRLIKRLVEDSRRLVEEIKERAR

SEQ ID NO: 5108 - protein, 60 aa, Artificial Sequence
  Synthetic sequence.
SEEERVEKRLREVNKDVKRLVKKVRDVNRKVHEDTKRLVEEVRRVNRDVHRRVKELREAG

SEQ ID NO: 5109 - protein, 56 aa, Artificial Sequence
  Synthetic sequence.
VDKIVEEIDKVVTETRELAERLVKESEDNVERSRDLARKLVEKSERLVKEIDDRAR

SEQ ID NO: 5110 - protein, 59 aa, Artificial Sequence
  Synthetic sequence.
SAAEKVREELERVNRRVEELLKKVKKVNEEVRDIVRKVVREVERVNKEVEEEVKRLVDQ

SEQ ID NO: 5111 - protein, 56 aa, Artificial Sequence
  Synthetic sequence.
VEEIVKKIKDVVKRTDELAERLVETSERLARTIKKVAEDLVRDSKRIVDEVRTRIT

SEQ ID NO: 5112 - protein, 59 aa, Artificial Sequence
  Synthetic sequence.
SDEDRVRRRLEEVNREVEELLRDVERVNEEVKRRVKKVIREVEEVNKRVEEEVKRLRDE

SEQ ID NO: 5113 - protein, 56 aa, Artificial Sequence
  Synthetic sequence.
VEDIVRKIDDVVRETRELAKELVKHVRDVVEDVRRLVKELVDLSEKLVKEIRDKVE

SEQ ID NO: 5114 - protein, 59 aa, Artificial Sequence
  Synthetic sequence.
SEVEKVVKEMEDLARENERLAREIVKDVERLVREIEDTVRRSVETTRRLVEEIRELAER

SEQ ID NO: 5115 - protein, 59 aa, Artificial Sequence
  Synthetic sequence.
ERVLELLERVLRELEKVVEDSKRRIKEVLDELRKAVDKVKKEDKKVHDELRKVVEEVRT

SEQ ID NO: 5116 - protein, 60 aa, Artificial Sequence
  Synthetic sequence.
RVEELLRKVITELDRVLEEVRRRNEASIEELDRVLKEVERLNKEVDEELKKVLEKVRKDV

SEQ ID NO: 5117 - protein, 59 aa, Artificial Sequence
  Synthetic sequence.
EEVVRRIVEEIKKVIDELREESRRTVREVEKLVKEILDRSRKTVEEVKRLAEEIERKAK

SEQ ID NO: 5118 - protein, 60 aa, Artificial Sequence
  Synthetic sequence.
RVKELVDEVKRKVEESMRESTERNRTATEKVEKSLRDSEKLNRDATRKLKKVVDDVRREG

SEQ ID NO: 5119 - protein, 55 aa, Artificial Sequence
  Synthetic sequence.
EEVVKKVEDVVERNKDLVRKSVEHIDKVVKENRELVKRSVEHIDRVVKEARERAR

SEQ ID NO: 5120 - protein, 60 aa, Artificial Sequence
  Synthetic sequence.
SAEELVKRVLDDVRRSAEESERLNREATEEVKRSLEKSRKDAERVLRDLERVVRKVKTEG

SEQ ID NO: 5121 - protein, 55 aa, Artificial Sequence
  Synthetic sequence.
ERVVRKVEAVVERNRKLVEDSVRHIREVVKRNEDLVRRLVEEVKRVVKKAEDKAR

SEQ ID NO: 5122 - protein, 60 aa, Artificial Sequence
  Synthetic sequence.
DVEELVKKVEDMVRKVIEEVKKRNTDVTRRVEESLRKSTELVREAEERLRRTLEELRRRG

SEQ ID NO: 5123 - protein, 55 aa, Artificial Sequence
  Synthetic sequence.
EEVVRKAEEVVKRAKELVARSVKHVDEVVRRNEELVTRLVRELDELVKEVRETAR

SEQ ID NO: 5124 - protein, 60 aa, Artificial Sequence
  Synthetic sequence.
RAERLVREVARRLEEVLKEVEKLNKDATDKVKKSLEDSRKKNEDVTREVRRVIEELRTRG

SEQ ID NO: 5125 - protein, 55 aa, Artificial Sequence
  Synthetic sequence.
EDVVRRAEELVERLRKIAEDSVRHLEEVVRKNERLVKESVDHVRTAVEELKETAR

SEQ ID NO: 5126 - protein, 59 aa, Artificial Sequence
  Synthetic sequence.
DAEEKVKEVEREVEKVIEEVKRDNTRVTEENKRVLDTVRERNKRVTDELRKVLEDVRRE

SEQ ID NO: 5127 - protein, 55 aa, Artificial Sequence
  Synthetic sequence.
EEVVKRIADVVKTVKRRVDESVKDIKRSVKETEDRVDRSVRHVEEVLKELRKASE

SEQ ID NO: 5128 - protein, 60 aa, Artificial Sequence
  Synthetic sequence.
SAEDKVRKVKKEVEKVIKDVKEENRRVTRENEEVLDRVKKDNERATRKLRKVVEDVRREG

SEQ ID NO: 5129 - protein, 55 aa, Artificial Sequence
  Synthetic sequence.
ERVVERIKRVVERVDELVRRSVKDVKDSVRETRKLVDDSVKDIDRVVKEARDRAK

SEQ ID NO: 5130 - protein, 59 aa, Artificial Sequence
  Synthetic sequence.
DAKDKVRKVLEEVKKVIEEVERRNRTVTRENERVLKEVKDRNTEVTKELKKVVEDVKRR

SEQ ID NO: 5131 - protein, 55 aa, Artificial Sequence
  Synthetic sequence.
EEVVDRVRRVVEEVTELVRRSVEEIKESVKTTRDLVRKSVKNIRDLVEEAKRRAD

SEQ ID NO: 5132 - protein, 59 aa, Artificial Sequence
  Synthetic sequence.
DEVETVVRDVKRLVRENERKVREIVKTVDKLVKENEDLVKRSVEELKKLAKEIKDLADE

SEQ ID NO: 5133 - protein, 55 aa, Artificial Sequence
  Synthetic sequence.
EDLRRVKKEAEDVVRDSERLIEEVKRRVKKVVDDSRRKDEEALRDVERVIEEVRR

SEQ ID NO: 5134 - protein, 60 aa, Artificial Sequence
  Synthetic sequence.
SEVDDVVRRVKKLVKEDRDLVRDSVRKLDELVRDDKRLVDEVVERLERIVKEIEDLMREG

SEQ ID NO: 5135 - protein, 55 aa, Artificial Sequence
  Synthetic sequence.
EKLEEVLKMLEKVSDEVKKENDRALKKVEDVSREVKELNKEVLKRARDVVERVRT

SEQ ID NO: 5136 - protein, 59 aa, Artificial Sequence
  Synthetic sequence.
SSKEKVKKVLDKVKEVLDRVRELVKRVDRESEKVVEDVRRKNKRASEKVKTVIRDVEEK

SEQ ID NO: 5137 - protein, 56 aa, Artificial Sequence
  Synthetic sequence.
VDDVLRKVEEIVRKVKDMVRKILEKAERNVEETERVVTESKENADRIVKEVEDRAR

SEQ ID NO: 5138 - protein, 60 aa, Artificial Sequence
  Synthetic sequence.
SAREAVTEVLRKVREVLKRVEDENRKVSKELRDLLEEVERRNRDLTEKVKRLIDELKERG

SEQ ID NO: 5139 - protein, 56 aa, Artificial Sequence
  Synthetic sequence.
VERILEEAERIVKELEEVLEESLRNVKEILKKLEDALRKSEEDVRRILERVEEEAR

SEQ ID NO: 5140 - protein, 59 aa, Artificial Sequence
  Synthetic sequence.
REVEEVLRRIKEMVKRIEELVRRSEDRAKKLVDTNRDLVRRSEERFRELVKEIEDVARE

SEQ ID NO: 5141 - protein, 55 aa, Artificial Sequence
  Synthetic sequence.
EELERVLREVEKVVRDVRRRNEKATRDVRRSVEESRRLDKRALDEVRKRIEEVRT

SEQ ID NO: 5142 - protein, 61 aa, Artificial Sequence
  Synthetic sequence.
RVEEVLKRVLDKLRESNKDSERLVREALKEHEEVNKEVEDRIREVLRRVEEVLKKVEKDKG

SEQ ID NO: 5143 - protein, 56 aa, Artificial Sequence
  Synthetic sequence.
AEDIKRLVDEIVDTDRKLVEEVKREAKESVKESEELVERVKRKADRIVEEVEKTVK

SEQ ID NO: 5144 - protein, 60 aa, Artificial Sequence
  Synthetic sequence.
DEVEEVRKTIERLVDRIEDVVRRVLELSRDTVRKNEDLVRRIEEELTKLVEDIKDVSRKR

SEQ ID NO: 5145 - protein, 55 aa, Artificial Sequence
  Synthetic sequence.
ELLEEVERLLEEVLRKAEKVIEDARKLDEDVNRKSNKVIEDVARRLEKVLKEVKD

SEQ ID NO: 5146 - protein, 60 aa, Artificial Sequence
  Synthetic sequence.
SVEDVIRRVKEKSEEVLKRLKEVIDEVKKRSEDVLKEVEDAIDEVRRRSEEALDRVRRAG

SEQ ID NO: 5147 - protein, 56 aa, Artificial Sequence
  Synthetic sequence.
SEEARDLADRDVEDVERVVTDIRRLVEKNVRDVRRVVREIEDAVRRNVKEIDRRVK

SEQ ID NO: 5148 - protein, 60 aa, Artificial Sequence
  Synthetic sequence.
SVEELIERVKRRSEKVLRDAEKTIRDLKKDSKRVNDELEKVIRDVMEKSKTALDEVRRRG

SEQ ID NO: 5149 - protein, 56 aa, Artificial Sequence
  Synthetic sequence.
SEEARRLVERDVEDVKRLVEEIKKLVTDNVRTVEDLVRRIKREAEENVKEIKEEVR

SEQ ID NO: 5150 - protein, 57 aa, Artificial Sequence
  Synthetic sequence.
SDVDRAVETNDKVVTEIVERVKEVVERNREIVERISTTVDEMVRRNRDIVRRVAERV

SEQ ID NO: 5151 - protein, 57 aa, Artificial Sequence
  Synthetic sequence.
VRDLVREVLERSDELVKRVEEEVKRLLERNKKLLDDVTEAAARLLKRNKEVVEELDK

SEQ ID NO: 5152 - protein, 57 aa, Artificial Sequence
  Synthetic sequence.
SEVDRVVEENDRVVRKVEEVVREAVERNETVAERVKDTVDRMVRENEKIVDKVRKDV

SEQ ID NO: 5153 - protein, 57 aa, Artificial Sequence
  Synthetic sequence.
VEKLVRDVLRESEKLVDDVRRAVKKLLEDSEELVREVKEAAEESLRRNKKIVEDLTR

SEQ ID NO: 5154 - protein, 57 aa, Artificial Sequence
  Synthetic sequence.
DELETVLREVERVVTEVKKLNERTVRDDKEVVERVLREIDKLLKEIREKVKEVKKKL

SEQ ID NO: 5155 - protein, 55 aa, Artificial Sequence
  Synthetic sequence.
EDVERTVRKLLEEIKDSVRKSKEDVRRSVEEIERLVRKVKEDVKRLLRDIRERAK

SEQ ID NO: 5156 - protein, 61 aa, Artificial Sequence
  Synthetic sequence.
SKVEKALKKIEDVLEDIKRLVEEVVERDERLLERLEEENKRADEKSKELVKRLTDLVRENK

SEQ ID NO: 5157 - protein, 59 aa, Artificial Sequence
  Synthetic sequence.
REALERIREILEEVRKAVEDLLRKIKETLKRIRERVKRLIENLEKSLEDARKEVDRLRK

SEQ ID NO: 5158 - protein, 61 aa, Artificial Sequence
  Synthetic sequence.
DVDERIEELLRRIERLVEESERDVRRLKREIDDLVTKSLKTVEESLKRIKELVDRVSEEAK

SEQ ID NO: 5159 - protein, 56 aa, Artificial Sequence
  Synthetic sequence.
KDDVERVVRRVLKEIDDSTKEIRRIVKRVLEEIERTTRDDKRVIDEVRELIKETSR

SEQ ID NO: 5160 - protein, 59 aa, Artificial Sequence
  Synthetic sequence.
DADELVTEVRKRVRETLEEIRTILDEVRKRVKKTVEDIRTEAERVKREVDKLVKEVRDN

SEQ ID NO: 5161 - protein, 56 aa, Artificial Sequence
  Synthetic sequence.
DREIEKLLDDNRRLIEEVLRRIDELVREDEELVKRVLDRIRTVLDRIREEVDEVRR

SEQ ID NO: 5162 - protein, 59 aa, Artificial Sequence
  Synthetic sequence.
DVRELLKKVEDEVRRTLKEIERILKEVKTESDKTLKEVAELLERLDRDVKRLVKEVRDN

SEQ ID NO: 5163 - protein, 56 aa, Artificial Sequence
  Synthetic sequence.
KEEIRKLVERNKELVRDVLRRIKELLKRDKEMLEEIRERIKEIEKRLKELLERAKR

SEQ ID NO: 5164 - protein, 61 aa, Artificial Sequence
  Synthetic sequence.
SEIEEVLKRVEEMIRRSKKLTDKVLREVEKMIRELDKKTDEVLERSERLARELKELVRRDV

SEQ ID NO: 5165 - protein, 59 aa, Artificial Sequence
  Synthetic sequence.
RERIEEILRRVTEAIKRSKEDSERIRETVTRLIRESEENSKRNLERVKKVIDELREEIR

SEQ ID NO: 5166 - protein, 61 aa, Artificial Sequence
  Synthetic sequence.
DKLEEVLKRVEEMLRELDKETDDVLKTVEDLLRRLDELTDEVLKESRRAAEELKRKVDRDI

SEQ ID NO: 5167 - protein, 59 aa, Artificial Sequence
  Synthetic sequence.
EEKIREIEKKARKLIKDSRKNIRDILETVKRLIEESDKNIKENEKRVRKVIDELDKEIK

SEQ ID NO: 5168 - protein, 61 aa, Artificial Sequence
  Synthetic sequence.
REKEEIIKKVKDVVKRVKEELKKIVEESERLVREVEEELKRSNEKSRDLVRRAEEELEKKS

SEQ ID NO: 5169 - protein, 56 aa, Artificial Sequence
  Synthetic sequence.
EEELDRLIKRVEDRARKVLEDSKRTIEEIEKVARDVLRRSEETVKEVEEKARRALK

SEQ ID NO: 5170 - protein, 61 aa, Artificial Sequence
  Synthetic sequence.
SAVEEIVKEVERIVREAEKALKKSVDDNRRIVEDAVRTLKRLVEEAARLVDEARKELTKKS

SEQ ID NO: 5171 - protein, 59 aa, Artificial Sequence
  Synthetic sequence.
EDVLRELKRLLKELERVVEEVLRRDRKWLEDTRREVKRVVEELKRLLDELREVVERARR

SEQ ID NO: 5172 - protein, 61 aa, Artificial Sequence
  Synthetic sequence.
KELEDLVREIEDTVDRIEREIRKLVEDDHRSVRKAEEDNRRLVKESEDLVRRIEEEIRKKE

SEQ ID NO: 5173 - protein, 56 aa, Artificial Sequence
  Synthetic sequence.
EEVMRRLKEDIERLMEEIRREVEKLNETTKEVVKESLETHKRIIERIREVAEETRR

SEQ ID NO: 5174 - protein, 57 aa, Artificial Sequence
  Synthetic sequence.
SSLEELLKEIRKRVERIKEELDRALKEDHDIVRKALRELDEMLKKNEETVRRAMERI

SEQ ID NO: 5175 - protein, 56 aa, Artificial Sequence
  Synthetic sequence.
EDVVRKVLEELEEEARRVLRELRESLKRTEELVRRALETLKRSDEETKKLVEDIER

SEQ ID NO: 5176 - protein, 57 aa, Artificial Sequence
  Synthetic sequence.
SSLEELIKEDHRVVREAEKRLEELLKEDHDRLREAKEELERVLKRDHETLKEVVERI

SEQ ID NO: 5177 - protein, 56 aa, Artificial Sequence
  Synthetic sequence.
EEVLKKIIERTRDLVRRALRTMEESIKRTEELVKKLLDELEASIRKTEEDADRIRK

SEQ ID NO: 5178 - protein, 58 aa, Artificial Sequence
  Synthetic sequence.
SSLERLIEEDHETVRRVKKTLDDMLKRDHEVVDEARRRLDELLKRDTDIVRDAVKRIR

SEQ ID NO: 5179 - protein, 56 aa, Artificial Sequence
  Synthetic sequence.
EEVLKKIIKETKELAKEAVERLEESIKETEDLVRRVLKEMEESLRRTEELVREIER

SEQ ID NO: 5180 - protein, 56 aa, Artificial Sequence
  Synthetic sequence.
SIEEVIERIREEAERLLKELEEVNRESTRLAEDLREELRRVLENSRALVKELKERI

SEQ ID NO: 5181 - protein, 59 aa, Artificial Sequence
  Synthetic sequence.
DKSLKELLRDVERKIREVRKRLKESLERVEREIRRVREEIKRLNDESRERIERVKRRVD

SEQ ID NO: 5182 - protein, 59 aa, Artificial Sequence
  Synthetic sequence.
DAEELLRRLDKSSKETLKRNEESLRRSEETSKRSLDTNRRSLEKIEKIATDLRRKLSER

SEQ ID NO: 5183 - protein, 55 aa, Artificial Sequence
  Synthetic sequence.
ERVVREAEKLDEDNTRHSRRNLEESKRLDEENIKRSEDLLRDVRRLIEEVLEEAR

SEQ ID NO: 5184 - protein, 60 aa, Artificial Sequence
  Synthetic sequence.
SKLDEILERAKKLIDDLRKESDDVLRRDRELIERIRRKSEEVLERVKRLIEELEDRVRKV

SEQ ID NO: 5185 - protein, 60 aa, Artificial Sequence
  Synthetic sequence.
EDEVRRVLRELERLVKELKDKNKESLDELKKTNDRLEEENRESLRRAREEARRILEEIRR

SEQ ID NO: 5186 - protein, 60 aa, Artificial Sequence
  Synthetic sequence.
DELEEILKRVEKLIRDSIEKIRRILEEDRELIKELIKESREVLERVRELIKTLEKKVKDV

SEQ ID NO: 5187 - protein, 60 aa, Artificial Sequence
  Synthetic sequence.
RRTVEEVLKRIEELVKRSLEESDRVAKEVRKTNEEVKKTNEDSLRKIKELVKRILEKIRK

SEQ ID NO: 5188 - protein, 60 aa, Artificial Sequence
  Synthetic sequence.
DELEDVLREVRKLIKELEKKSREVLKRDKELIDRIRKESEEVLKRVEDVLRKLEDEVRKV

SEQ ID NO: 5189 - protein, 60 aa, Artificial Sequence
  Synthetic sequence.
KRRVDEVLEEIERRVTELNKKNEESLRRAEKTNKELDEENKESLERIRKLIEDILRKIEK

SEQ ID NO: 5190 - protein, 59 aa, Artificial Sequence
  Synthetic sequence.
DELERILEEVKRRIERLIERLREVLERDKKLIEDIRRESEDVLRRVEEVIKKIREELER

SEQ ID NO: 5191 - protein, 60 aa, Artificial Sequence
  Synthetic sequence.
RETVKDVLRKLRKIADEVRRDIERVLDEARKTNKRLDEENKDSLKKLRDRAKELLDEVRR

SEQ ID NO: 5192 - protein, 61 aa, Artificial Sequence
  Synthetic sequence.
RELEEVLKEAEKLIREITEEVKEALRRDEKTVRDNIRDLRRVLEEVRKLIEEILDRVRRRG

SEQ ID NO: 5193 - protein, 56 aa, Artificial Sequence
  Synthetic sequence.
SKFLERLEELITRLKERIDKALRDLEKTNDELRKRSEEVLRRLERLLERLREEIRR

SEQ ID NO: 5194 - protein, 56 aa, Artificial Sequence
  Synthetic sequence.
SEVERVLEDSRRTNEEIIKRLRDALRESEKTNRDIEKRLREMLKKSKETNERIKRS

SEQ ID NO: 5195 - protein, 56 aa, Artificial Sequence
  Synthetic sequence.
KKVLDKARELVRRTEEIVKDVIRKSRELVKESKERVDRVITESRRVVKKTLDDIRK

SEQ ID NO: 5196 - protein, 56 aa, Artificial Sequence
  Synthetic sequence.
SEIEEALKRSKETNERIIRKLEEVLRRSRKTNEEIIRRVERVLEDSERTNREIEKS

SEQ ID NO: 5197 - protein, 56 aa, Artificial Sequence
  Synthetic sequence.
EEFLRTVKKLVDDTRKAVEEVITRSRRLVEESERRVREVIDRMRKLVEETKRKLDK

SEQ ID NO: 5198 - protein, 56 aa, Artificial Sequence
  Synthetic sequence.
SEIEKALKESEDTNRKIKDDLRKVAERVRKLIEDVIRTLERVLRDSERTNREITRS

SEQ ID NO: 5199 - protein, 56 aa, Artificial Sequence
  Synthetic sequence.
EDVLRKAKRLVDETLKEVERVIRELEKLVEDLEETVKEVIKRSRELVDETEKRIRD

SEQ ID NO: 5200 - protein, 56 aa, Artificial Sequence
  Synthetic sequence.
EEIERALKKSEETNRDIIRKLREVNERDKRAVERDEEELKKALDESRKTNEDIRKS

SEQ ID NO: 5201 - protein, 56 aa, Artificial Sequence
  Synthetic sequence.
KDVLETVRKLVEDTLREVERVITHSLKRVEDTLRKAKEIADRMRTLVRKTLEDIER

SEQ ID NO: 5202 - protein, 56 aa, Artificial Sequence
  Synthetic sequence.
DEVERVLEKSKRTNEDIIRRLEEVNKTDRKLVEDDIRRLEKALRDARKTNEEIRTS

SEQ ID NO: 5203 - protein, 56 aa, Artificial Sequence
  Synthetic sequence.
EDVLRKVRELVERTKERVERVIDHSRKVVETTLREVERVIREIEELSKDSERKIRK

SEQ ID NO: 5204 - protein, 56 aa, Artificial Sequence
  Synthetic sequence.
SDAERALKESEDTNREIIEKLERVNKRDKDIVDKIREDLKRVLERVRDTNRRIRES

SEQ ID NO: 5205 - protein, 56 aa, Artificial Sequence
  Synthetic sequence.
ERVLREVKRLIDETKRIVDEVIKHSKEEIDKLREEVERVIKELRELSDKSLDDIRK

SEQ ID NO: 5206 - protein, 56 aa, Artificial Sequence
  Synthetic sequence.
KEIEDVLKKSEDTNRRIIERLRKANDTDRRLIEDTIRKLREVLKEAEKTNKDIKDS

SEQ ID NO: 5207 - protein, 56 aa, Artificial Sequence
  Synthetic sequence.
EDVLRTVEELIERTEREVERVIAHSEDLIRRSNEDVKRVIKTIRELSEDSKRAADK

SEQ ID NO: 5208 - protein, 56 aa, Artificial Sequence
  Synthetic sequence.
DEERVLKELEDLLREILKDIERTVRESRKLVKTILDEIEEVARHNRKLIEEIRREV

SEQ ID NO: 5209 - protein, 56 aa, Artificial Sequence
  Synthetic sequence.
LKELLETVRRVIEEVKKVLKRSLEESKKVIDDVRRHLEKNNRDIKTVIDRVREKAK

SEQ ID NO: 5210 - protein, 55 aa, Artificial Sequence
  Synthetic sequence.
SVEEVVEEVKRLIEEVEKTNKKTVEDSKRLIDDIRRRIEEVMRHNRELIKKIERE

SEQ ID NO: 5211 - protein, 56 aa, Artificial Sequence
  Synthetic sequence.
LRELLERVRRLVEESKRNAEESLRRSEKVIKEATDHLRRNNETIKRVIDRVREEAK

SEQ ID NO: 5212 - protein, 55 aa, Artificial Sequence
  Synthetic sequence.
DTERVLKTLRDLIDTILKRNEEILRHNEKLSRDSKRRIEEVARHNRDLARRVEEE

SEQ ID NO: 5213 - protein, 56 aa, Artificial Sequence
  Synthetic sequence.
LRKLLEDVKEIIKTSKENVDRNNDRIRRVVERSEKHLEDNNRDVKRVVDEVREEAR

SEQ ID NO: 5214 - protein, 59 aa, Artificial Sequence
  Synthetic sequence.
KEEEDIKREIEKRITEIKKKNEEVLRRVEELIKRIHELNKRIEDTIDEEIRRIEDLVRR

SEQ ID NO: 5215 - protein, 56 aa, Artificial Sequence
  Synthetic sequence.
DDVLRKLKRLLDEIIKHSEDVLRKIKELLDEIKRDSDRVFKKLKELLDRIAREIEK

SEQ ID NO: 5216 - protein, 60 aa, Artificial Sequence
  Synthetic sequence.
RELEEIDRKIKKLIEDIHRENRDILRRIRELIERIKKKNEDILREVRKLIKEIEDLVREG

SEQ ID NO: 5217 - protein, 56 aa, Artificial Sequence
  Synthetic sequence.
DKVLKKLEDLLREIKKDSDRVLEEARKLLEEIKRHSDEVLEEIKKLLDDIKKRVET

SEQ ID NO: 5218 - protein, 59 aa, Artificial Sequence
  Synthetic sequence.
SELEKIDDEIRKLIEDIHRLNREIARRNEKTIREIRKKNEDVLRRNKRSADEIDRLVKE

SEQ ID NO: 5219 - protein, 56 aa, Artificial Sequence
  Synthetic sequence.
SEALRKLKRLLEEIERDSRRVLDELHKTDEDIERHSREVEDRAHKTDKTIKDRVET

SEQ ID NO: 5220 - protein, 60 aa, Artificial Sequence
  Synthetic sequence.
SEDEKILEEVRREIERIHEENRKVRERIERLIREIHKLNREVLERNKESIEEIRRLVEEG

SEQ ID NO: 5221 - protein, 56 aa, Artificial Sequence
  Synthetic sequence.
SKFLEDIERLLREIDKDSKRVLEELKRLLDEIRKDSDRVLKTAHDTDDKILKDIDK

SEQ ID NO: 5222 - protein, 59 aa, Artificial Sequence
  Synthetic sequence.
KEEDEVREEIKRRIEEIARLNKEIEDEIRELIKRIHELNREILKKVRKLIEEIEDLVRK

SEQ ID NO: 5223 - protein, 56 aa, Artificial Sequence
  Synthetic sequence.
SEVLRELDELLRRIKKNSEDVARKLKDLLRRIREDSERVAKEIRRLVEEIKKKVDK

SEQ ID NO: 5224 - protein, 61 aa, Artificial Sequence
  Synthetic sequence.
DEVKRIVDEVRRLVEKVHRVNEEVVKESEDLVREVHRKNKRVLDESERLVEEVERVLKRDV

SEQ ID NO: 5225 - protein, 55 aa, Artificial Sequence
  Synthetic sequence.
ERVLRTAEEVIRRLEKHSKDLLDTSRRLAEEILRKSDDLLRRSKEKIDDLKRKIK

SEQ ID NO: 5226 - protein, 61 aa, Artificial Sequence
  Synthetic sequence.
SEVDRIKEEVRKLLEEHHKRNEDIVREVTRLLEEHHKKNEEVVRESEKLVKKIREILRDRV

SEQ ID NO: 5227 - protein, 55 aa, Artificial Sequence
  Synthetic sequence.
ERVLEEARKVVRELNRRSEELLKRARELVERLDRKSEELLRKSERIIKKIEEDIR

SEQ ID NO: 5228 - protein, 61 aa, Artificial Sequence
  Synthetic sequence.
KEVEEIVRDVRRLVEEHHRENRKIVETVEDLVRKVHRENKRVVEESERLVDELTKILRDTL

SEQ ID NO: 5229 - protein, 55 aa, Artificial Sequence
  Synthetic sequence.
EEVLKRVREAIRRLNEDSKRLLKEARDVVERIKRNSDKALEESKRKLKEIEERIK

SEQ ID NO: 5230 - protein, 61 aa, Artificial Sequence
  Synthetic sequence.
SKMEEVRRRIKEEADRDEEDNRRVLEDIRRLIEENKRRNEEVLKRIEKKARDLLERIKKDG

SEQ ID NO: 5231 - protein, 55 aa, Artificial Sequence
  Synthetic sequence.
EEIIKEVSTLNEKLKRDTDEILKEVTRLNERLKEETDRILEEVKKLIDKVRKAVE

SEQ ID NO: 5232 - protein, 61 aa, Artificial Sequence
  Synthetic sequence.
KEADDVKRRLDDLIRRNEEKIRDVRRRVKELVDRNRKKIKEVLDKVKEIIDRLKDEIDKTG

SEQ ID NO: 5233 - protein, 55 aa, Artificial Sequence
  Synthetic sequence.
ERIIEEVTRENDRLRKESDRVLDEVSKLNDEARKETDDVLKTVDELVREVAEKAK

SEQ ID NO: 5234 - protein, 61 aa, Artificial Sequence
  Synthetic sequence.
SDAERLLETVRRIAKRLKELNEEVLREAKRIIDRVREENERSRETIREIMKKLKEDIDRIG

SEQ ID NO: 5235 - protein, 56 aa, Artificial Sequence
  Synthetic sequence.
VDEILRDVERLLEEVRRSVKESTRRIKRLLDEVRKSVKESTKEIKKLLKDVEDAAR

SEQ ID NO: 5236 - protein, 61 aa, Artificial Sequence
  Synthetic sequence.
KDIEDLRRRIEEIIEEAKRLDKTSLELIRRIIKRIKDENKKMLDEAEKIIRDALKTIDDVG

SEQ ID NO: 5237 - protein, 56 aa, Artificial Sequence
  Synthetic sequence.
VEDVTRRIEELLEEVRKSSEDSIRDIRRLLKEVRDSFKRSSDELKRLLDEVRKRAE

SEQ ID NO: 5238 - protein, 63 aa, Artificial Sequence
  Synthetic sequence.
RELEEVVKELRRLLEEVRKRVEDSIKRLDELLDEVRRSNKKSSEDTRKLLKELEDEARKVMER

SEQ ID NO: 5239 - protein, 56 aa, Artificial Sequence
  Synthetic sequence.
VREVREEIERIVTKARKVVKEDDDLVKRIVAEARRLSKESEEKVREIVKRAEEKVR

SEQ ID NO: 5240 - protein, 55 aa, Artificial Sequence
  Synthetic sequence.
DEVEELREELERLLKESEDRLREVKKRSDDSLKESRELIKKVRDTLERLLREVED

SEQ ID NO: 5241 - protein, 56 aa, Artificial Sequence
  Synthetic sequence.
VETVAREVRERVERSKRHIEKVLKEDEEMVRESKKNIEDLLRRVKEDIDRLKEEVD

SEQ ID NO: 5242 - protein, 55 aa, Artificial Sequence
  Synthetic sequence.
SKADRLREELDRLLKEVKELNERSKRESDRSLEEIKRLIEKVERESEKTLREVRA

SEQ ID NO: 5243 - protein, 56 aa, Artificial Sequence
  Synthetic sequence.
IDTVVEEVKKLIKEILDHIRELVEDDKRKIKEILEEIKKLAEDDRRKVEEVKRKVD

SEQ ID NO: 5244 - protein, 57 aa, Artificial Sequence
  Synthetic sequence.
SDVEDLKKKLDELLEEVERTSREVRKTSERSLEEVEKLLRRVKEESKRLLEEVERDI

SEQ ID NO: 5245 - protein, 56 aa, Artificial Sequence
  Synthetic sequence.
VKKVLDDVKKLVDDVKRKDKKLLDDDRRRVEEALEHIKRNLDRSRDLIRRIKEKAK

SEQ ID NO: 5246 - protein, 57 aa, Artificial Sequence
  Synthetic sequence.
DEVKKLKDDLDRLLDEIRRKIEKVRKDSEDSLKRVEELIRRVEEESRRLLEDVKREI

SEQ ID NO: 5247 - protein, 56 aa, Artificial Sequence
  Synthetic sequence.
IKKVLDDVRREIRRIDEEIKRVEEEDRRMVTELLKHIERNLERSKRLADEVKEKAR

SEQ ID NO: 5248 - protein, 55 aa, Artificial Sequence
  Synthetic sequence.
KEVDELRKALKELLDEVRETSKRVLDETRRLLEEVRRELERVKRESDETLKRIKD

SEQ ID NO: 5249 - protein, 56 aa, Artificial Sequence
  Synthetic sequence.
VDTVLEDVKRKIDELKEHDKRNLDESRRLITELLERIKKLAEDDRRVIEEIERRIQ

SEQ ID NO: 5250 - protein, 60 aa, Artificial Sequence
  Synthetic sequence.
KTMDEIKKEVTDLVRRIRELNERVERTVEDLVRKSRRLNERVLREVERLVKEVRDALRDK

SEQ ID NO: 5251 - protein, 59 aa, Artificial Sequence
  Synthetic sequence.
DETLEKVVDDVRKRIKRSKEHSDEVLEDAKKKIDENLEHSRRVLEEAKKLIDDLKDEIR

SEQ ID NO: 5252 - protein, 60 aa, Artificial Sequence
  Synthetic sequence.
EKAERIIEEVTDLVRRVRETTKTVKEEVRKLVERSKRRNEEIRREVKELVDEVEKKLREK

SEQ ID NO: 5253 - protein, 59 aa, Artificial Sequence
  Synthetic sequence.
KDALEKVRRDVERLIRELEKTDRDVLEEVKKLIEESERNSDRILEEVRRIIEELKKKIK

SEQ ID NO: 5254 - protein, 60 aa, Artificial Sequence
  Synthetic sequence.
SVVDEIRERVERLLREVEKTTEELRDTVRKLVEESEELTKRIEDEVRKLVEKVRRELRRK

SEQ ID NO: 5255 - protein, 59 aa, Artificial Sequence
  Synthetic sequence.
EDKLREVLEEVKERIDRLKELDKKILEDVKRLVKESKEELKDILRRARKLIRDLEEKIK

SEQ ID NO: 5256 - protein, 60 aa, Artificial Sequence
  Synthetic sequence.
SEVEKMLKELKELVERALERDKDALRKLRDLVRESLERDKRMVDKLDELVKEIEDRIRKR

SEQ ID NO: 5257 - protein, 59 aa, Artificial Sequence
  Synthetic sequence.
REKVDKIRRDVKRLLDESRESLERSEKDVEKLLEDSRDSLRKSKKRVEELVKRVEEALK

SEQ ID NO: 5258 - protein, 60 aa, Artificial Sequence
  Synthetic sequence.
REVEEALKESTDTIKKILDDDRKAMDELKKLVDKSLEDDKRAVDRLRELVKEIKKIIKKR

SEQ ID NO: 5259 - protein, 59 aa, Artificial Sequence
  Synthetic sequence.
KEDVDRIEEESRRLNEESRDSLRKSEDTVRKLLEESKESLDRSRREVEKLLKEVEDALR

SEQ ID NO: 5260 - protein, 61 aa, Artificial Sequence
  Synthetic sequence.
SELEELDREVEELVERSKRTNERVVEESKRLVDESRRDIDRLLEEVRKLVKDILERIKEEG

SEQ ID NO: 5261 - protein, 59 aa, Artificial Sequence
  Synthetic sequence.
SEDVRRLLEKIERLIEESNRSLERSREESERLSKESEDRLRELEKTVKELLKRVEEALR

SEQ ID NO: 5262 - protein, 61 aa, Artificial Sequence
  Synthetic sequence.
DEIRELLKKAEELVERSLRDNEKVVDELKKLVDESLRRIREMLKRAEDEVRKILEDIERKG

SEQ ID NO: 5263 - protein, 59 aa, Artificial Sequence
  Synthetic sequence.
SDEVDTLRRTVDKLVKDSNRSLEESKRTLEDLIRRSKEELDKLEKDVRRLLDEVRKALK

SEQ ID NO: 5264 - protein, 60 aa, Artificial Sequence
  Synthetic sequence.
DELEDAMRRVEEMAERSERNIRRSIRKVEELVTRSKKNIEDSLREVEKVAREAEELLRRN

SEQ ID NO: 5265 - protein, 55 aa, Artificial Sequence
  Synthetic sequence.
EEVKRRLDELLKRVTDLDRDSEKKLRELLEEVTKLDKESKDRLDELLEKVRRDRE

SEQ ID NO: 5266 - protein, 61 aa, Artificial Sequence
  Synthetic sequence.
SEVDKLLDRLTKLAKRSIDEARRLVERDREVLEKSIRDAEKLVERDEKVLEDIKRLIEREG

SEQ ID NO: 5267 - protein, 55 aa, Artificial Sequence
  Synthetic sequence.
ETVRRLVTELNKASKKVVDDVRRESEKSNRDSEDVVRKVKKASDKSLEDVERDIR

SEQ ID NO: 5268 - protein, 61 aa, Artificial Sequence
  Synthetic sequence.
EEVERIVERLKRLAEEDSREIKEVMDRNRESVRRILKRIKDIVEELRRLVEEIKKKIEKDG

SEQ ID NO: 5269 - protein, 59 aa, Artificial Sequence
  Synthetic sequence.
KEKVERLEKDIRRLEKESEDALRRLEDTSKRTDDEIERAIEELERTITDLVREIRERVR

SEQ ID NO: 5270 - protein, 60 aa, Artificial Sequence
  Synthetic sequence.
REVDEIRKELDDRVREIKKRIEEAVEDSRRTVEEIKRRVEEVDKTDRKLVEDIKREIDRR

SEQ ID NO: 5271 - protein, 59 aa, Artificial Sequence
  Synthetic sequence.
RKKAEELRDRVRKLVEEIERLLEELRRTLEKTRREIERVVEENRRSVEELIREIKERVD

SEQ ID NO: 5272 - protein, 60 aa, Artificial Sequence
  Synthetic sequence.
DDERRVKEEIKRILTEAKKVIDENKRRSEEVLDRVRKLVKENKDENDEVLKTVDELVRRG

SEQ ID NO: 5273 - protein, 55 aa, Artificial Sequence
  Synthetic sequence.
EEVRKELKRVLDEVRRLVKETEETDRTSNRTVAELAKDLEKKTDDIEREVRKKVT

SEQ ID NO: 5274 - protein, 61 aa, Artificial Sequence
  Synthetic sequence.
DRVERILKKIEDALRKVEELIRRNKKKIDDVLDEVRRLVEESKKRIDEILDEVRDRITKLK

SEQ ID NO: 5275 - protein, 58 aa, Artificial Sequence
  Synthetic sequence.
KEAKRLKDLLDTVRETVKRLNDELRKRSEEVLRRVDKLNKESKKRLDEVLRTVREELR

SEQ ID NO: 5276 - protein, 60 aa, Artificial Sequence
  Synthetic sequence.
REIEEVKKENDKSLKEIEKIIREVKEENKRSLDKIKRIIERALEEIKRMLEKAKKLADEG

SEQ ID NO: 5277 - protein, 59 aa, Artificial Sequence
  Synthetic sequence.
DKFLTEVKRSFEKSVEDIKRLLKEVSESVKRSTDEIRRLLDEVRRAVEEVLRRIRELLR

SEQ ID NO: 5278 - protein, 57 aa, Artificial Sequence
  Synthetic sequence.
SLVEELRRVVEEVRKTLEELVKRLEDSVRRSAEEIRKLIEDAERSVRESERAVKETG

SEQ ID NO: 5279 - protein, 58 aa, Artificial Sequence
  Synthetic sequence.
KEIKELLEEIKEMLRRLKKKAEDIDRTNRELEKEVRELVERLLRDNRRLLKEVVERAK

SEQ ID NO: 5280 - protein, 57 aa, Artificial Sequence
  Synthetic sequence.
DKIEEAKKNVDESKRRVEELIRELRESVERSKRDVERLVRELEESVERSLETVKRDG

SEQ ID NO: 5281 - protein, 58 aa, Artificial Sequence
  Synthetic sequence.
KEVKELLKRNSDLLRRVEELVKKLDKENRDLLRKVREDAKKLLKENEDLLEKVKRDAR

SEQ ID NO: 5282 - protein, 57 aa, Artificial Sequence
  Synthetic sequence.
DEIEKAEKNVRDSRREVERVVKKLKESVDKSREEVERLVRELERSVEESRRLVEERG

SEQ ID NO: 5283 - protein, 58 aa, Artificial Sequence
  Synthetic sequence.
KEVDRLLERNSRLLEEVEERAKELDERNKKLLEEVRRRAEEVDKRNKDLLRTVDRRAR

SEQ ID NO: 5284 - protein, 57 aa, Artificial Sequence
  Synthetic sequence.
SLIEEARENVKDSKKKVKELVDRLRKSVEESRERVREVVRRLRESVDTSADAVRKAG

SEQ ID NO: 5285 - protein, 58 aa, Artificial Sequence
  Synthetic sequence.
EAVKRLLEENSKLLADVADEARKLNEENERLLREVEKKAKKLDDENRKLLEEVIETVR

SEQ ID NO: 5286 - protein, 57 aa, Artificial Sequence
  Synthetic sequence.
DEIEELKKNVEDSRREIDRLIKELKESVEKSRKDVEKVVKELRESVKDSLDKLEKTG

SEQ ID NO: 5287 - protein, 58 aa, Artificial Sequence
  Synthetic sequence.
KEIKELLKENSDLLERVREEAETLDRKNKELLERVKRKADRLNEENRRLLKEVIEKAR

SEQ ID NO: 5288 - protein, 60 aa, Artificial Sequence
  Synthetic sequence.
SEVEKLLRDLERLLEEIVKEAEDLDRENKERLKEIARKARELNEENKDLLRRVKELVDRN

SEQ ID NO: 5289 - protein, 59 aa, Artificial Sequence
  Synthetic sequence.
ERLVREVERVIREVRKRVEEVVRKVEESIKESEERVKELVKRVTDSLERSKKEVEDAIR

SEQ ID NO: 5290 - protein, 58 aa, Artificial Sequence
  Synthetic sequence.
SEVEELLKRLEDILRENERRARELNRKNKEVLKDNRRRAEEVNRRNKRMLDEAERLAE

SEQ ID NO: 5291 - protein, 59 aa, Artificial Sequence
  Synthetic sequence.
EKLVREVETKIEEVRRRSEELVKEVEKSLKESEDDSRRLVREIEESIRESEERIKRRVE

SEQ ID NO: 5292 - protein, 56 aa, Artificial Sequence
  Synthetic sequence.
DEVEEILEKSRRTLEENKRRAKEAVRRSRETLRESEERVKRVVEELRDRLRRIEEE

SEQ ID NO: 5293 - protein, 59 aa, Artificial Sequence
  Synthetic sequence.
EDALRKIKKVLDETETESRRTLEELRKVLEETHRRNEKLIRDLREVLKEIEEAVRRREK

SEQ ID NO: 5294 - protein, 56 aa, Artificial Sequence
  Synthetic sequence.
DEVEEALRRLEDLLRRNVEEAKEVVKDSERTLREDAERVKRVVEKSKRTLEAIEKR

SEQ ID NO: 5295 - protein, 59 aa, Artificial Sequence
  Synthetic sequence.
EEAVRRIEEVLKKIREDSKRTIDELRRVLERTEEETRRLIKELEDVLRRTEEEVKRRLK

SEQ ID NO: 5296 - protein, 61 aa, Artificial Sequence
  Synthetic sequence.
SEVEKVLEEIKRLLDRIKERVDETDRRNKELLKKIKDEVRRAVEEIRRLLEEIKKSADEKG

SEQ ID NO: 5297 - protein, 59 aa, Artificial Sequence
  Synthetic sequence.
EKLVREVEEVVTRVRKTIEDLVKKDNDSVRKSEERIKEVVKRIEEEVKRVLEDVDRLAK

SEQ ID NO: 5298 - protein, 57 aa, Artificial Sequence
  Synthetic sequence.
DEVRELLERNRRLLEEIKKTVKDLIRRNEELLKRIEDDAKRLIDRNEELLDELEKRL

SEQ ID NO: 5299 - protein, 59 aa, Artificial Sequence
  Synthetic sequence.
GEELEELRRVVEESDETIKRLLEEAKESVDRSLDRIRKLLEDVRRSVERSKKRIDEKRK

SEQ ID NO: 5300 - protein, 57 aa, Artificial Sequence
  Synthetic sequence.
DEVRKILKDIEDILREIEERVKRVIERNKRILEKIREDVKRVDDRNKKLLEELERKL

SEQ ID NO: 5301 - protein, 58 aa, Artificial Sequence
  Synthetic sequence.
DDLRRVEEVAKRIKDRIRELLDEIRRSVERSKRDVKRLLDELRRSVEESKRRIDEREK

SEQ ID NO: 5302 - protein, 57 aa, Artificial Sequence
  Synthetic sequence.
SEVDKLLRENEKLLEDIERTVKRMLERIKKLNDDVHREIRRIDEENRRLLDEIEKKV

SEQ ID NO: 5303 - protein, 59 aa, Artificial Sequence
  Synthetic sequence.
GRDLDRLRRVVEKSKKRIEELEREARKVAKDVKKNLEELLEEVKESVRESEKRIKETEK

SEQ ID NO: 5304 - protein, 60 aa, Artificial Sequence
  Synthetic sequence.
SLKERIEEELKKVKDTSDRLNEEVRRSVEDTRKRSEDLNEEVRRSVEESRRRVESLLKRI

SEQ ID NO: 5305 - protein, 59 aa, Artificial Sequence
  Synthetic sequence.
EEEVKKIIERIEEILERSERRNREIIKRDEEALKRSEERNREIIERDKEMLERLEREVR

SEQ ID NO: 5306 - protein, 60 aa, Artificial Sequence
  Synthetic sequence.
SLIETIKEVVKRVAETSKRLNDRVREELRKVEREVEELNREVERVLREVETAVDDLVKKI

SEQ ID NO: 5307 - protein, 59 aa, Artificial Sequence
  Synthetic sequence.
REEAEDIIRKIEEVLKKSKELNDRIIERIKKMLEDLRRHNEEIIEKIRRALKRLEDEAR

SEQ ID NO: 5308 - protein, 60 aa, Artificial Sequence
  Synthetic sequence.
SLKETIRELLKRVEEESRKLNEDVARSVRETKRRSDRLNEEVERSVRRSEEEVRRLLKRI

SEQ ID NO: 5309 - protein, 59 aa, Artificial Sequence
  Synthetic sequence.
KEKAEEIIRRIKEMLRRDEEENRRIIERDERALDKSRRLNEKIIEEDKKAMRDLEEEVK

SEQ ID NO: 5310 - protein, 60 aa, Artificial Sequence
  Synthetic sequence.
SEVEEIIKENRRTLERDRREVEKVIEENKRSLEEIERKVREIIKDNDRSAKEITELAKAG

SEQ ID NO: 5311 - protein, 59 aa, Artificial Sequence
  Synthetic sequence.
EELVDRLRKSLRDVREESKKLIDELRRSLEESDRRVKELIDRLRKSLDDSRKLVDDLRR

SEQ ID NO: 5312 - protein, 60 aa, Artificial Sequence
  Synthetic sequence.
SEVEEIIKDNERTLEEIRKRVEDVIREIRRLLERIERRVREAIKRNEESLRRIKELVERG

SEQ ID NO: 5313 - protein, 59 aa, Artificial Sequence
  Synthetic sequence.
DELVRTLRESLRRVAEEVKRLLKEVEDVAREVEDRVKKLIEDLRRSLEKSREDVERDSK

SEQ ID NO: 5314 - protein, 61 aa, Artificial Sequence
  Synthetic sequence.
DRVREIIKRLRDLLREIRTVVRKIIEDNRKSLEEIEEHNRRVIRELRELLKEIKETVEREG

SEQ ID NO: 5315 - protein, 59 aa, Artificial Sequence
  Synthetic sequence.
EEMIRTVKKVITEIAEEVKRLADEVRDSVRRSEEAVRRLTKETKEVVDDIVRRVRELIE

SEQ ID NO: 5316 - protein, 61 aa, Artificial Sequence
  Synthetic sequence.
KKVEEIIEELKKLLREIEEHNKRVIEENERSLEEIKRHNEEVIEELRELLERIEEVVKRKG

SEQ ID NO: 5317 - protein, 59 aa, Artificial Sequence
  Synthetic sequence.
EDMIRTVEDVVRRIERRVRELSRESEESIRRSTETVKKLTKDTRDVVRRILKTVRDRIK

SEQ ID NO: 5318 - protein, 64 aa, Artificial Sequence
  Synthetic sequence.
SLEERLREVLKDIERRVRELNETNKRVLDKSKTTVDELLKRLREVLEEIREEVRKLIEELARRG

SEQ ID NO: 5319 - protein, 59 aa, Artificial Sequence
  Synthetic sequence.
REMIEKVLRDLEELAKRIEDKNRETIKESEKTLEEIRRRVDRLLEELRRLLKEIAKEVK

SEQ ID NO: 5320 - protein, 64 aa, Artificial Sequence
  Synthetic sequence.
SLEETLEKVLRDITERSERLIRENEKNLRDVKREVEKLNERNRDVLKKIREKVRELIEELRRKG

SEQ ID NO: 5321 - protein, 59 aa, Artificial Sequence
  Synthetic sequence.
EEAIRKVLEELKKLLEEDERRAKRVSEESKELLDRLAEDNERTIRKLERLLEELERRTK

SEQ ID NO: 5322 - protein, 60 aa, Artificial Sequence
  Synthetic sequence.
SEVDKVLEELKKLLDDDRREVERLLRELRRLLDRDRREVEKSIRTLEKLLKEIEDIVRER

SEQ ID NO: 5323 - protein, 59 aa, Artificial Sequence
  Synthetic sequence.
KRALERVREVLERAEDESRKLSERIKKVLEDIERESKRLSEEDREVLKRIKEEVERLEK

SEQ ID NO: 5324 - protein, 60 aa, Artificial Sequence
  Synthetic sequence.
SEVDKVLEELKELLKRLEEDVKRSSKESEDLLRKDEEDVRRSIRELERLLEEIEERVRRR

SEQ ID NO: 5325 - protein, 59 aa, Artificial Sequence
  Synthetic sequence.
ERALREVRKVLEDIKKSVDELLKEDKDNLRETARESERLSREDKKVLERIEERVKELED

SEQ ID NO: 5326 - protein, 60 aa, Artificial Sequence
  Synthetic sequence.
SEVEKVIEELKKLADDDRRRVEKSLRELRKLLEELEKRVRDSLEKLKKLLKEIEDRVRRR

SEQ ID NO: 5327 - protein, 59 aa, Artificial Sequence
  Synthetic sequence.
EKLLREVRKVLREARETSRELSRADEKVLRDIRREVKRALDADKKVLDDIRERVKELEK

SEQ ID NO: 5328 - protein, 60 aa, Artificial Sequence
  Synthetic sequence.
DEVEKILKEIDDAVKDLKRKSDKSLTDDRRMVEELKKKSEESLREVEEMVRRLEDEASRT

SEQ ID NO: 5329 - protein, 59 aa, Artificial Sequence
  Synthetic sequence.
EKVVRRVRDILDKLRKTVERLVEENEDSARRTEETIRKLVKDNEDILRELRRLIEERRT

SEQ ID NO: 5330 - protein, 60 aa, Artificial Sequence
  Synthetic sequence.
SEVEEMLERLKELLRRIEKVVRDSLRRLKELMRRDEEEVRRSLRRLEELLKEIERVARER

SEQ ID NO: 5331 - protein, 59 aa, Artificial Sequence
  Synthetic sequence.
KKVLDEVKELLERIEETVRRLIEENERVLEEAEELSRKLSEDNEKVLEDARREAERLTK

SEQ ID NO: 5332 - protein, 60 aa, Artificial Sequence
  Synthetic sequence.
DEVEEVLKELEKLAREDEDRVRKSEKKLRELADKDREDVERSLRRLERLLEELKRVVEER

SEQ ID NO: 5333 - protein, 59 aa, Artificial Sequence
  Synthetic sequence.
KDMLERVERLLREAEKLSEKLSRDNEDLLRRARDLSRELSKENERLLEDIRRRVEEAIK

SEQ ID NO: 5334 - protein, 60 aa, Artificial Sequence
  Synthetic sequence.
REVEEVLERLKRLLDTLEREVRKSLEELKRLLDELRKESKKSLDELRKLAEELERVVRRL

SEQ ID NO: 5335 - protein, 59 aa, Artificial Sequence
  Synthetic sequence.
EKMLREVKRVLEEAERRVRELIEENKRLLKEIKEEVKKLIEENEKVLEEARRLAEELKK

SEQ ID NO: 5336 - protein, 60 aa, Artificial Sequence
  Synthetic sequence.
DEVREVLKKLEKLADELREEVRKSLEDLKRLLREDEERSKESLKDLERLAREIEEVVKKK

SEQ ID NO: 5337 - protein, 59 aa, Artificial Sequence
  Synthetic sequence.
EKALRDVEELLRRIEERVRRLIKENEDLLREIEKTSEKLSRDNKELLKEIEERVRRLRQ

SEQ ID NO: 5338 - protein, 60 aa, Artificial Sequence
  Synthetic sequence.
DEVEEALKTLEELMRRDKEEVDKSLEKLRRLLKEDEDRSRESLERLKRLAEELEEVVKKE

SEQ ID NO: 5339 - protein, 59 aa, Artificial Sequence
  Synthetic sequence.
RRVLERVKKLLEDARRLSERLSEENERVLEEAKRRSEELSKRNEDLLREIEKKMKEDTR

SEQ ID NO: 5340 - protein, 60 aa, Artificial Sequence
  Synthetic sequence.
SEVEKVLEELKKLADDLRRTSKRSEEELEKLARELEKRVRESEKRLRDLLRELEDVVRKK

SEQ ID NO: 5341 - protein, 59 aa, Artificial Sequence
  Synthetic sequence.
KDALKRVKELLDRIREEVEKLIRRNEKLLRDIEEKVRTLLERNERVLEEIKKKVDDDIK

SEQ ID NO: 5342 - protein, 60 aa, Artificial Sequence
  Synthetic sequence.
DEVREVLEELRRLMKELRDVSEKSLRDLRKLAEEDKDRVRKSLEKLRELLRTLEDVVRKR

SEQ ID NO: 5343 - protein, 59 aa, Artificial Sequence
  Synthetic sequence.
EKMLREVEDLLRRAEKEVRRLIEENKKLLKEAEETSRKLSKENEDVLRDIRRAVEELKR

SEQ ID NO: 5344 - protein, 60 aa, Artificial Sequence
  Synthetic sequence.
SEVEKALEDLERLAKELEKVSRESLRRLEKLLEDDRRRSKRSLEELEELLDRLRDTVRRR

SEQ ID NO: 5345 - protein, 59 aa, Artificial Sequence
  Synthetic sequence.
EKALREVRDLLRRIEERVKKLIEDNRKLLEDARRESERLSEENKRVLEKIEREVKKLED

SEQ ID NO: 5346 - protein, 60 aa, Artificial Sequence
  Synthetic sequence.
SRVEEVLKKLEDLLRRLEEVSERSLRELRELVKRLEDVVRRSEKKLKELADRIEEVVRRR

SEQ ID NO: 5347 - protein, 59 aa, Artificial Sequence
  Synthetic sequence.
KKALDDVRRLLEEIEKRVTELIERNRRLLEEAEDRVRKLLRDNEELLKRIEKLVRDLER

SEQ ID NO: 5348 - protein, 60 aa, Artificial Sequence
  Synthetic sequence.
SRVEEVARKLEDLLRELKRVSDESLKTLEKLMTDDERRVRESLDKLRELAREIDEVVRRR

SEQ ID NO: 5349 - protein, 59 aa, Artificial Sequence
  Synthetic sequence.
EDALREVRRLLERAEELVRELIKRNEDVLREAKRTSDELSERNRRLLERIKETVDRKRK

SEQ ID NO: 5350 - protein, 57 aa, Artificial Sequence
  Synthetic sequence.
REVEEILKRIEELLRRIKKLSEETLREIAKLLEDIKRLSEETLKSNKDLLKRVRDEL

SEQ ID NO: 5351 - protein, 59 aa, Artificial Sequence
  Synthetic sequence.
SRMLREIERIIKELKELVDKLLEDNERLIERLDREVKRLLEENEKSVREASREIDERRR

SEQ ID NO: 5352 - protein, 57 aa, Artificial Sequence
  Synthetic sequence.
DEVEELLRRIERLVEEARRLVEELLETNKKLLKDIEKLSRDTLKSNEELLREVKDRV

SEQ ID NO: 5353 - protein, 59 aa, Artificial Sequence
  Synthetic sequence.
SEMLRRLETIIREAERDLRRLLKEARDSVKKVSDEIKRLLEENKRSVDRVSREIKRVEK

SEQ ID NO: 5354 - protein, 59 aa, Artificial Sequence
  Synthetic sequence.
DEVEELLKEIRELIEEARRRIEELLKEDRDIVRRVTELSRRTLEKIKDLIRKIKDIADR

SEQ ID NO: 5355 - protein, 59 aa, Artificial Sequence
  Synthetic sequence.
SEMLRRLEELIKEIEDLVRKLLEELKRSVRETEERVRKLKEDNDELIKRIDELVKEREK

SEQ ID NO: 5356 - protein, 60 aa, Artificial Sequence
  Synthetic sequence.
SSLDDLRRLAEELLRTNKKLMEDLRRTNEKLIKEIEDVLRRIRESSKRIKEEVDKLTRDV

SEQ ID NO: 5357 - protein, 59 aa, Artificial Sequence
  Synthetic sequence.
RKVLERVKEAVDEVRRSVEESLRDAKRMDEETRKTVEDVRREVTKSVEDVKRRIDESRK

SEQ ID NO: 5358 - protein, 60 aa, Artificial Sequence
  Synthetic sequence.
DEVDEVVREVERLLEELRKENDKSVEEDKRLVDKLREEVKRILEEVRKLLEDLARKAKED

SEQ ID NO: 5359 - protein, 59 aa, Artificial Sequence
  Synthetic sequence.
KDVLRKLREVIKEVERIAEEVVRKNKDSADKSRKIIEDVVRALKKVVDDVRKIAEDLSR

SEQ ID NO: 5360 - protein, 61 aa, Artificial Sequence
  Synthetic sequence.
DEVEKAVRESEETVKDIRRRNDETVRRLRELAKRLKERNEESVRRLRDLLRRLDEEVARRG

SEQ ID NO: 5361 - protein, 59 aa, Artificial Sequence
  Synthetic sequence.
ERVLRDIRRVMEDSERIVKEVLDRNRKVAEDVRRIVEEVLRVNEDVLRKIEKRVRELKK

SEQ ID NO: 5362 - protein, 59 aa, Artificial Sequence
  Synthetic sequence.
SELEEIKKRVDRALEENNKLLKEIEERVRKSNRDNERLLKEIEDRVREVTERIKKVEEE

SEQ ID NO: 5363 - protein, 59 aa, Artificial Sequence
  Synthetic sequence.
EDVLKKIRDLAREVEENVRESERKIKKLAEDDNRSVAESLREIKRLADEVKRRVDEARK

SEQ ID NO: 5364 - protein, 60 aa, Artificial Sequence
  Synthetic sequence.
SELEEVRKRVKDVNRKNKELLDEIERTVRELLEDDRRLVDEAKKELDTLLRDIERLRREG

SEQ ID NO: 5365 - protein, 59 aa, Artificial Sequence
  Synthetic sequence.
EDALREIRRLLEEVRKSIEDSKRLIEELLRRLKKVTDESRKKVEDLLREVEREVREAKK

SEQ ID NO: 5366 - protein, 60 aa, Artificial Sequence
  Synthetic sequence.
RELEEIEKELKRMLDENRRLLERIEEEVRRLNEDNRRLLEEIEKTVEDLLEKIRKLSKEG

SEQ ID NO: 5367 - protein, 59 aa, Artificial Sequence
  Synthetic sequence.
REALKRIEELLREIEEVVKRSKTEIERLLRELEESVRRSDERIERLLKRVKDVVDEEER

SEQ ID NO: 5368 - protein, 60 aa, Artificial Sequence
  Synthetic sequence.
EKEKEITKTLEDLIRKNRKLLEEIERRVKEVLKRDRELLEEIERRVADMLRRIRDVLRKG

SEQ ID NO: 5369 - protein, 59 aa, Artificial Sequence
  Synthetic sequence.
REVLERIKRLLEKVEKVSTESAKRIEELLEEVKRVTDDSKRRVTELLREVERVVDEVRR

SEQ ID NO: 5370 - protein, 60 aa, Artificial Sequence
  Synthetic sequence.
DTLRELAKKAKELDDRNRKLLETVEELVRRVNEKNKDLLRRVRELARELLDRLRKLAREG

SEQ ID NO: 5371 - protein, 59 aa, Artificial Sequence
  Synthetic sequence.
EEVRRELERLVRKLEESVRKSRKDVEDLITELKKSVKESLKEIEDLVRRLREVVKEIER

SEQ ID NO: 5372 - protein, 61 aa, Artificial Sequence
  Synthetic sequence.
EEVDRILKESEDTIREIRDRVRKMLETSKKTVEEIKRRVDRALERDKKLVEDLRERVERTG

SEQ ID NO: 5373 - protein, 59 aa, Artificial Sequence
  Synthetic sequence.
KEAVEKMRRIVRESREVVARIREDIKRVLDESDKVVKDLKRAADRSVEEVKKVVDDIKK

SEQ ID NO: 5374 - protein, 60 aa, Artificial Sequence
  Synthetic sequence.
SELERLKETSKDTIKKIKDLLRELKKTVDDVIERDKTLLDDLREKVERVIRRIEELLKRT

SEQ ID NO: 5375 - protein, 59 aa, Artificial Sequence
  Synthetic sequence.
EKVRDEIRKLIETNKRVADRVEEEVRKLIEDSERSLRKSEKDVKELIKKVEEVMEEVRR

SEQ ID NO: 5376 - protein, 60 aa, Artificial Sequence
  Synthetic sequence.
SIEETVKRLIEEIERVLRDARRESKRLSEEDKKVLDEIREEVRKLEEKIKTVLDKARKDI

SEQ ID NO: 5377 - protein, 59 aa, Artificial Sequence
  Synthetic sequence.
EKLLDEVRRRVEEVIKELEELLRRDKERVDRSIRELEKLLEEIKERVDRMIKELEDRLR

SEQ ID NO: 5378 - protein, 60 aa, Artificial Sequence
  Synthetic sequence.
REVEEADKTVKELIKRNKELLDRIKKEVDELIRRDKELLDKAERDVDRLIKELRDVAREG

SEQ ID NO: 5379 - protein, 59 aa, Artificial Sequence
  Synthetic sequence.
KEVVDEIRRLLRELEKVSEDTKREIRELLKRAEESVRRVTERIERLLKELRDVIREIEK

SEQ ID NO: 5380 - protein, 60 aa, Artificial Sequence
  Synthetic sequence.
DELEKIKKDVKKMIRDNEDLLRRVEERVRELNRRNEELLKEIEKRVEELIKRLEDVARRG

SEQ ID NO: 5381 - protein, 59 aa, Artificial Sequence
  Synthetic sequence.
REVLEAIRRLEKEARDVSRRSTRKIEELLETSETSSEKSKRRIEELLRRLERVVEEARK

SEQ ID NO: 5382 - protein, 60 aa, Artificial Sequence
  Synthetic sequence.
EELERAAERIEELLRSNRDLADKITKLSRETLEKIKDLLRKIEKEVRELLERIKDLERRL

SEQ ID NO: 5383 - protein, 59 aa, Artificial Sequence
  Synthetic sequence.
EEVLRELERLLRELKKSVDELSRLIEELLRENKRLIDEVKKRIDELLEELKKLIEKVKK

SEQ ID NO: 5384 - protein, 60 aa, Artificial Sequence
  Synthetic sequence.
EIEKVVEEVIRRVRKVLEEVERSVRDTIERIKDVLRRVEEVVRRTDKTIRDVLDRIRKEI

SEQ ID NO: 5385 - protein, 56 aa, Artificial Sequence
  Synthetic sequence.
DEDIRRVLEDIRRELKRIVDENRKLAEEIIRTLERMVEKNKELMKEVVKKLEEDSR

SEQ ID NO: 5386 - protein, 60 aa, Artificial Sequence
  Synthetic sequence.
RIKETVDKVIEEVRRVLEEVRTTVKRTDERIKEVLEEVEETVRRTLEEIRRVLEELERAI

SEQ ID NO: 5387 - protein, 56 aa, Artificial Sequence
  Synthetic sequence.
DEDIRDLVRKIKEELRRIVEKNRELMEKVERELRRIVEENERLARRIKEELDRDMK

SEQ ID NO: 5388 - protein, 60 aa, Artificial Sequence
  Synthetic sequence.
RIEEIVERLIREVEKVLRDVERTVDKTDRKIREVLEEVRRISDESIKEVREVLEDLERKI

SEQ ID NO: 5389 - protein, 56 aa, Artificial Sequence
  Synthetic sequence.
DEDIRRLAEEIKKKLKRMVERNKELMERIEREIREIVERDKELVERIKRKLRELAR

SEQ ID NO: 5390 - protein, 60 aa, Artificial Sequence
  Synthetic sequence.
SIEDVVREVIKRVEDVLRRVEEVSRETIERVRRVLREVEERVERTDERIRRILDKLAKSI

SEQ ID NO: 5391 - protein, 56 aa, Artificial Sequence
  Synthetic sequence.
DEDIRRLVKKIEEDLTRIVERDKELLEDIERELRRMVEENERLLEEIERRARDEER

SEQ ID NO: 5392 - protein, 59 aa, Artificial Sequence
  Synthetic sequence.
EELERLARDVDKRVEDLKDDIRKIREEVKRLLDDNRRRAEEILEESRKSLETLTDLMRR

SEQ ID NO: 5393 - protein, 56 aa, Artificial Sequence
  Synthetic sequence.
SEIVKRVLEKLDEVLKDLKRTIDELKKRLEDVLRESRDIARRALEENERVLDELRK

SEQ ID NO: 5394 - protein, 59 aa, Artificial Sequence
  Synthetic sequence.
SEEDRIAEESRESLEKLKDDIRKIEDRVRKLLEDNKRRAEEILREVEEDLKRIEELFKQ

SEQ ID NO: 5395 - protein, 56 aa, Artificial Sequence
  Synthetic sequence.
SEIVRRLLEENKRVLDELEKRIEELLRRLDKVLKESERIAREAERKIEEVLRKLEK

SEQ ID NO: 5396 - protein, 60 aa, Artificial Sequence
  Synthetic sequence.
SAEEIIDRVTKEAKKSIDRTRDRITKLRRELEESIRRSRDIITKLLEELRRVVEEVKRDK

SEQ ID NO: 5397 - protein, 59 aa, Artificial Sequence
  Synthetic sequence.
EKVVEDLERKVEEIVREDEDLVRRLAEEVKRVVEDDERTAKKLEDDVRRIIEAVKRELK

SEQ ID NO: 5398 - protein, 56 aa, Artificial Sequence
  Synthetic sequence.
SLEELLEEARKTVERLIRESERVLRESEERVRRLIEELERVVRETRKRVKEVIERV

SEQ ID NO: 5399 - protein, 56 aa, Artificial Sequence
  Synthetic sequence.
EEELEKLLREIEERVKEMLKRDEDTLREIERKVKEAVRDSERTLEEIEKRVTEEKT

SEQ ID NO: 5400 - protein, 59 aa, Artificial Sequence
  Synthetic sequence.
SITEEIKDIERKVEKLIRELDEENKRILETLEREAKDVLRRIEDINEKLHRRARDLKRK

SEQ ID NO: 5401 - protein, 59 aa, Artificial Sequence
  Synthetic sequence.
EELKRVLDRVLKKVEDLLRKLEKSVRDSERRLEELLRELREVVKRVRDNIEKVLEELER

SEQ ID NO: 5402 - protein, 60 aa, Artificial Sequence
  Synthetic sequence.
SIREEAREELKRLEEEAERLDRENREILKELTREFKELLKESRDINREIHERIRKLKKDG

SEQ ID NO: 5403 - protein, 59 aa, Artificial Sequence
  Synthetic sequence.
RKLDKVLKEIEERLRELLKRLEDSVRESEKRLRDLLRELAKVDEEAKRNVEKVLKELED

SEQ ID NO: 5404 - protein, 59 aa, Artificial Sequence
  Synthetic sequence.
SIKDEIRKLLEKVKREVEEIDDRNRRLLEKVKREAEELLEKNRRLLEEVRKRAEELKDS

SEQ ID NO: 5405 - protein, 57 aa, Artificial Sequence
  Synthetic sequence.
LERVVRDVERRIEELIRKLERSVDRSEEEVRRLIEELRKSVEDSKREVDRVVEELRR

SEQ ID NO: 5406 - protein, 59 aa, Artificial Sequence
  Synthetic sequence.
SILEDVRRLLDEVKKLVEELLRENRRLLEEVKKEVEKLDRKNRELLREVRELVKELKDS

SEQ ID NO: 5407 - protein, 59 aa, Artificial Sequence
  Synthetic sequence.
RKLEEAVREVEERVRDLIRKARESVDESRKRIEDLIRELKKSVEESLRDIERLIKELRD

SEQ ID NO: 5408 - protein, 59 aa, Artificial Sequence
  Synthetic sequence.
STREDARRLVERVRKEVKRLLKKNSDLLREVTERVKTLNERNRRLLEEVEREAKRLKDS

SEQ ID NO: 5409 - protein, 57 aa, Artificial Sequence
  Synthetic sequence.
LERVVREIEKEIRDLIRELEENVKTSEKLIEDLIRELEKSVDESRKRVEELVKELRT

SEQ ID NO: 5410 - protein, 60 aa, Artificial Sequence
  Synthetic sequence.
SAEDVVREIEKTVRELMRRVEESVRKVEEDVKRLIKEVKDSADESEKKVERLLEEVKREK

SEQ ID NO: 5411 - protein, 56 aa, Artificial Sequence
  Synthetic sequence.
EEELRRLLEEIKKEVDKVIRENEETLKRIKEVVERVIEDNKRTLREIEEEVRRIRK

SEQ ID NO: 5412 - protein, 60 aa, Artificial Sequence
  Synthetic sequence.
SVEEVVKRILETIKDLMRRIKKNSEDVLETIKRLADEIRESVKRSNERIRELIKDIRETR

SEQ ID NO: 5413 - protein, 56 aa, Artificial Sequence
  Synthetic sequence.
TDELEKLLREVEEIVKDVSRKSDTSLKKAEERVRDVKRKDEKTLRDAEEVVRREKK

SEQ ID NO: 5414 - protein, 59 aa, Artificial Sequence
  Synthetic sequence.
SVEDLVRDVRDKAKRTSDEIRKLIERSKEIFERSSREIRRLIEESRDTARRVVEKLKKN

SEQ ID NO: 5415 - protein, 59 aa, Artificial Sequence
  Synthetic sequence.
EEEIARLVEEVKRLVKESLELIEELHRRSEKLVRDSLREIKTLNDESRKIVTDVLREVT

SEQ ID NO: 5416 - protein, 59 aa, Artificial Sequence
  Synthetic sequence.
KVEELVREVTEIARKVREDLERLVRESERRMRESSEKIKRLIEESRRRMKEVVEELKRE

SEQ ID NO: 5417 - protein, 59 aa, Artificial Sequence
  Synthetic sequence.
EEEIKRLREKVKRLVDKVKREIERLNRKSRELVKKSEEDIEKINRESRELLRKVLEDAK

SEQ ID NO: 5418 - protein, 59 aa, Artificial Sequence
  Synthetic sequence.
DVEELIKEVKDKAKRTSDEIKKLIDESKRVLDEVVRRLEELVKRIKESADRVLEEIARE

SEQ ID NO: 5419 - protein, 59 aa, Artificial Sequence
  Synthetic sequence.
RKIAKKLVDDVERRLRKSLRLIEELNKESRDIVRELLRLIEELLKEVEELVERLLREVK

SEQ ID NO: 5420 - protein, 59 aa, Artificial Sequence
  Synthetic sequence.
SELEKVLDEVRKRAKESLRRSEELAKRVEEMDERNLRNSKELRERVEEVIKRLLEVARQ

SEQ ID NO: 5421 - protein, 56 aa, Artificial Sequence
  Synthetic sequence.
SRVLEEVERIVKRVLDEDKKVLDRLRRSVERSSRESEKVLDELKKRVDRVLDEVRR

SEQ ID NO: 5422 - protein, 59 aa, Artificial Sequence
  Synthetic sequence.
SELEKVFEDVKRRLDESLEKSKELLKRVRDTDRENLKNSKRLLERNKRLVDDLLRVVEA

SEQ ID NO: 5423 - protein, 56 aa, Artificial Sequence
  Synthetic sequence.
SRLLEELEKRAKKVLDDDKRVLDEARRSSKRVTDEDRKVLKTAEDINREVSKRIRD

SEQ ID NO: 5424 - protein, 59 aa, Artificial Sequence
  Synthetic sequence.
SELEKVVDDVRRRLDRLLETSEKLLEDATKRLKDSERKSDEIVKTNEELLERLKTVLER

SEQ ID NO: 5425 - protein, 56 aa, Artificial Sequence
  Synthetic sequence.
SELLKRVEERIKRVLDESKKILKEIADEVRRVLERDKELLKRLEDKNREVSERIRK

SEQ ID NO: 5426 - protein, 59 aa, Artificial Sequence
  Synthetic sequence.
SELEKVVKEVADLLRRNLEKSKRVLEEVRRRLEENLRESEKVHDDNRKTARRILELVRE

SEQ ID NO: 5427 - protein, 56 aa, Artificial Sequence
  Synthetic sequence.
SRLLEELEERVRESIERSRRFIEELEKIVEETLTESEKLARASSEITKTVLDEIRK

SEQ ID NO: 5428 - protein, 59 aa, Artificial Sequence
  Synthetic sequence.
RELEEVFKEVEKELRDNLRKVEEVLREVRERLKENLDRSKEVLKDVRRRIKELLDLARG

SEQ ID NO: 5429 - protein, 56 aa, Artificial Sequence
  Synthetic sequence.
SKLLERLERKVEETLRRSREVIEDAKRIVEETLRRSEDIIREAKEIIDDVLEKIRR

SEQ ID NO: 5430 - protein, 60 aa, Artificial Sequence
  Synthetic sequence.
STDDALRKIERRHKELTKEVRDMLRKVDEEVKRLIEENEDVLRKLREEVDRVIKDIRRAD

SEQ ID NO: 5431 - protein, 56 aa, Artificial Sequence
  Synthetic sequence.
LEDLRRDSERIIEEVKRRLDELRREVEKVIDDVRRLSEKNEKDARRIIEEVKRRLD

SEQ ID NO: 5432 - protein, 60 aa, Artificial Sequence
  Synthetic sequence.
STEEVLDEIRKLHKTLTEDIKRVLREIEELHRRTIEENKEVLDKIREDYKRVIDDVRTKD

SEQ ID NO: 5433 - protein, 56 aa, Artificial Sequence
  Synthetic sequence.
AEELLRESKEAIKEVKRVLEELRKESKRVVDETRKLSEENLEHSERVLRKVEEDLR

SEQ ID NO: 5434 - protein, 60 aa, Artificial Sequence
  Synthetic sequence.
DEDKVLRKVKKLVEDIRREIERILREAERLHKELTRRNEEVLERIRRLVDKVIKEIRKAD

SEQ ID NO: 5435 - protein, 56 aa, Artificial Sequence
  Synthetic sequence.
LRELLERVERVIREVRRDLKRLLDESRDVVRRVEERSRRNLEEVKRDIERVKRELD

SEQ ID NO: 5436 - protein, 60 aa, Artificial Sequence
  Synthetic sequence.
SKEEVLREIERLHKETIRRIEEVLREATELHKRLTETNKRVLEDLEREAREVIEDVRRAD

SEQ ID NO: 5437 - protein, 56 aa, Artificial Sequence
  Synthetic sequence.
ARELLEESRREVERSEKEVERLLRKSRKVVEEVRKLSEENDREVKKILEEVKRRLD

SEQ ID NO: 5438 - protein, 60 aa, Artificial Sequence
  Synthetic sequence.
SKEEVLDEMRRLHETTKRDIRRVLKEIEELHERTLRENKRVLEEIKELVRRVIEDIKRKK

SEQ ID NO: 5439 - protein, 56 aa, Artificial Sequence
  Synthetic sequence.
LKELLDESRRVVKESKEDLDRLLKESRDVVDDTRRKSEKNLRDAERVIREAEEAVR

SEQ ID NO: 5440 - protein, 60 aa, Artificial Sequence
  Synthetic sequence.
DRERVLREMERLVRELLRENREVLDEIRKLHERTVRRNRELAKRLEEEAKEVIDRIEKTK

SEQ ID NO: 5441 - protein, 56 aa, Artificial Sequence
  Synthetic sequence.
VKKLLEEARDVIRRAKEKSKRNLDESRRVVKETDDLSEKNREDVRKIIKEVEEELK

SEQ ID NO: 5442 - protein, 60 aa, Artificial Sequence
  Synthetic sequence.
DVEEVLREIEELHRRTIERIKKVAKKVREDVKRVLDENKKVLDELRRRVEEVIEKIKKAD

SEQ ID NO: 5443 - protein, 56 aa, Artificial Sequence
  Synthetic sequence.
MRELKKRSDDVVRESEKELRRLEDEIRKVIEDLKKLSEDNEREVEKVIRKVEEDLR

SEQ ID NO: 5444 - protein, 60 aa, Artificial Sequence
  Synthetic sequence.
DMERIVDTLRKLNTDSNRRSKEAIDRLRKTNKDSLDKVEEVLREAERLAEDVLRKVEEKV

SEQ ID NO: 5445 - protein, 59 aa, Artificial Sequence
  Synthetic sequence.
KEVLKKLLEEVKDSNRRSEEDVRRMEEEVKRSNDELLKELKEILDKVREAIKKLEEKVK

SEQ ID NO: 5446 - protein, 60 aa, Artificial Sequence
  Synthetic sequence.
SAEDIIRRLRDLNRRSNKKSRDVAEKLRRDNKRTLEKVERKARELKKLAEEVVKEVRDKV

SEQ ID NO: 5447 - protein, 59 aa, Artificial Sequence
  Synthetic sequence.
EEVLRRMLKEVEDSNRDSDRDVRRIEEEVRRLNEELDKKLEDLEREVRRMIEEIRRKVK

SEQ ID NO: 5448 - protein, 61 aa, Artificial Sequence
  Synthetic sequence.
SELEEVKERVERVLKRIRDLTRELEDRVDKILEKSKRTLDELEKRVREVIARIKELVKRLK

SEQ ID NO: 5449 - protein, 56 aa, Artificial Sequence
  Synthetic sequence.
SEVLKRLEELAREVIEEDKRALERLDRKIRRVLDESRDVLRKIRKLIEDVLREVEK

SEQ ID NO: 5450 - protein, 61 aa, Artificial Sequence
  Synthetic sequence.
SESETIEKEADEMLKRSKKTLEELRKTVKRILERIEKLTRDLEKTAEDIIRKIEDDLRRLK

SEQ ID NO: 5451 - protein, 56 aa, Artificial Sequence
  Synthetic sequence.
SEVAKRISEKIRRVLEDSRRVLEELEDLIRRVLERDKRALERIKEDIDRIIRRVRT

SEQ ID NO: 5452 - protein, 61 aa, Artificial Sequence
  Synthetic sequence.
SELEAVLDELRKLVKELEDRLRKVNEESRRLIKELLDRLREVDERSRKLIKDLAEKARRRG

SEQ ID NO: 5453 - protein, 56 aa, Artificial Sequence
  Synthetic sequence.
TDELRKRVRDLVRRVDELIKRSKRHAEELTREVEEKVRESEEHVRRLVKEVEDRIR

SEQ ID NO: 5454 - protein, 56 aa, Artificial Sequence
  Synthetic sequence.
DEVEEADKRVEDEVRRLKRLVEEHTKRVEDKVRTLKKLVKEHTDEVRRAVEELKRR

SEQ ID NO: 5455 - protein, 55 aa, Artificial Sequence
  Synthetic sequence.
EDVLRKVKELLEDVARLVEESHEEARKLLKEVEDRLRESVREVEELLRDVERRTR

SEQ ID NO: 5456 - protein, 59 aa, Artificial Sequence
  Synthetic sequence.
DEVEKVKEEIRRIVKELEDRVEEHKKEAKKIIDELRRLVKRHREEVEEIVKKLEELVRR

SEQ ID NO: 5457 - protein, 55 aa, Artificial Sequence
  Synthetic sequence.
EEVLKEAEKLLEDVERKLRKSHEDLERLLKEVEEAVRDSNEEVRERLDRVREKMR

SEQ ID NO: 5458 - protein, 59 aa, Artificial Sequence
  Synthetic sequence.
DEDRKVEEDIRRIVKRLREIVEKHNREAREIIKRLRDEVRKHRDKARKIVTRLDELIKR

SEQ ID NO: 5459 - protein, 55 aa, Artificial Sequence
  Synthetic sequence.
KDVLKEAEELLEKVKRDLDRSHEELEELLKRVREELEDSNRELEKLIEEVERKVR

SEQ ID NO: 5460 - protein, 59 aa, Artificial Sequence
  Synthetic sequence.
SEVEDVDDRIRKIIKKLEDLVRKHNEDARRIIDELRELVERHNRRAREIVRELEDLVRR

SEQ ID NO: 5461 - protein, 55 aa, Artificial Sequence
  Synthetic sequence.
EEVLKKVEKLLKEVLDLMKESNEELEKLLEEVKREMEESVKELKKLLDEVREKVK

SEQ ID NO: 5462 - protein, 61 aa, Artificial Sequence
  Synthetic sequence.
KEIEDVLEKVRKVVTDLKKKLEDVNRESEKLVREVVKELKRVDDESRKLVERVEKEADEKG

SEQ ID NO: 5463 - protein, 56 aa, Artificial Sequence
  Synthetic sequence.
EEELDRRIKELKDRADKLIKDSKDNVEELRKKAEELIRRSRKNVEDLVRKATEDVR

SEQ ID NO: 5464 - protein, 61 aa, Artificial Sequence
  Synthetic sequence.
RELEEVLKKVEDLHRDVMKKIDDVVREASELHKKVKEDIDEVVKRAEDVLRRVKRELDKRG

SEQ ID NO: 5465 - protein, 56 aa, Artificial Sequence
  Synthetic sequence.
KDELDEHIERSLRKVTELVKDLKEHIERSLEEAKELVRRLEELIEELLRRLAEEVR

SEQ ID NO: 5466 - protein, 60 aa, Artificial Sequence
  Synthetic sequence.
SEVEEVLREAEELLKEVRDRLRESVEKSKRLLDEVRRKIEESHRRHKELSDEIRRLAEER

SEQ ID NO: 5467 - protein, 56 aa, Artificial Sequence
  Synthetic sequence.
IEELRKEIKKKIDEMRRLVKEDTERLERVAEELRRRVEEDKERSKDVVRRLREDVK

SEQ ID NO: 5468 - protein, 60 aa, Artificial Sequence
  Synthetic sequence.
SEVEEVLKRAEELLDDVRRLLERSHRETERLLDEVRKRVEDSHREHRKLSDEVRRKAEER

SEQ ID NO: 5469 - protein, 56 aa, Artificial Sequence
  Synthetic sequence.
IEELRKDIERAVKELRERVEENTRRVEELVRRLRELVEEDRKRSKEVADEMDERVR

SEQ ID NO: 5470 - protein, 60 aa, Artificial Sequence
  Synthetic sequence.
KEVEEVLDTAKKLLDEVRRELERSHEEHKRLSDEIRERLERSHEETERLLKEVKEEVDDK

SEQ ID NO: 5471 - protein, 56 aa, Artificial Sequence
  Synthetic sequence.
IEELKRRIDDMVRRLRELVERDRRESKKVADDLRRLVKENTERAREKIEELRKDVE

SEQ ID NO: 5472 - protein, 60 aa, Artificial Sequence
  Synthetic sequence.
SEIEEVLKEAEKLLREVEKELRRSHEELKRLLKEVRDKVRRSMEESERLLEEIKKKADER

SEQ ID NO: 5473 - protein, 56 aa, Artificial Sequence
  Synthetic sequence.
IEELKRRIEDAARKLEKLVKDDRERIERKVRELERLVEEDKKRLRDRVRKMDEDVR

SEQ ID NO: 5474 - protein, 60 aa, Artificial Sequence
  Synthetic sequence.
REVEEIVKKVRKEVTRLLREVEEDMKRNRDTIRELLKYVKKDLEENKDIIRRLLELIRRD

SEQ ID NO: 5475 - protein, 55 aa, Artificial Sequence
  Synthetic sequence.
EEARKDIERLLEEVRTKLRENEEDLRRLVKEVDRELKRNRDELERLAKEVRDELK

SEQ ID NO: 5476 - protein, 61 aa, Artificial Sequence
  Synthetic sequence.
SEAEEIAKEVEKRIRELLDRVRRMVEESEKYARDSLRKIKRLLDEVRRRIEELLRKIRRDG

SEQ ID NO: 5477 - protein, 55 aa, Artificial Sequence
  Synthetic sequence.
SEVAKKVKELLDEVERILREWEKEDRRLLKESEDLLREVEKEVRKLLRRVEEELK

SEQ ID NO: 5478 - protein, 61 aa, Artificial Sequence
  Synthetic sequence.
SESEKILEEAKRRIRKLLEDVKEMVKRSRDYARESLKRIKDLVEESKREIDKLLEEIKRSG

SEQ ID NO: 5479 - protein, 55 aa, Artificial Sequence
  Synthetic sequence.
SEVEEDLKRLLEEVKRELKRWEEDDKRLLDDSERALKEWEDTDRRLLKRVEDELR

SEQ ID NO: 5480 - protein, 61 aa, Artificial Sequence
  Synthetic sequence.
SEVEEIVKDAERYIKESLDRIRKAVEESRRRITELLKEVERLLREVRKRIKELLDEIRRDG

SEQ ID NO: 5481 - protein, 54 aa, Artificial Sequence
  Synthetic sequence.
DAERKLEELLEESRELLKRWRDDDKRLVDDVRRKLKEVEEEVRKLLKEVEDELR

SEQ ID NO: 5482 - protein, 61 aa, Artificial Sequence
  Synthetic sequence.
SEVEEIVKEAKRRIDELLKKVDELLKESERYARKSLKDNKDMVRRSEERIRELLEKIKRDG

SEQ ID NO: 5483 - protein, 55 aa, Artificial Sequence
  Synthetic sequence.
SEAEKRLKDLLDRVKEKLDEVRRRDRELLEESKDLSRRWKERDDRLLEEVEKALK

SEQ ID NO: 5484 - protein, 57 aa, Artificial Sequence
  Synthetic sequence.
REIEKIREDLERLLEEVKRAAEEWRRRDEELVRKLEELIKRVLDEDRRLLRELRDKG

SEQ ID NO: 5485 - protein, 59 aa, Artificial Sequence
  Synthetic sequence.
REVIKKVLEEIRDKIRKILKTIEDLVRKSEDLIRRVLEEIERILDESRRDVEEVKRREE

SEQ ID NO: 5486 - protein, 56 aa, Artificial Sequence
  Synthetic sequence.
DEDRRVKTEIKKLLEELTRRSREVEEDDRRLLDELTRETERIEEDLRRLLEEVRRS

SEQ ID NO: 5487 - protein, 55 aa, Artificial Sequence
  Synthetic sequence.
DEIEREVRKVEEDYRRSLRRVLEESRKIAERYKKKLDEMREEVRRRAKKVKDEVR

SEQ ID NO: 5488 - protein, 56 aa, Artificial Sequence
  Synthetic sequence.
KSVEKIVEDIKRVADKILEDIKRSEDRVREIVDRHRREIDKVVKEIVKRVEDLKRN

SEQ ID NO: 5489 - protein, 59 aa, Artificial Sequence
  Synthetic sequence.
KDEMEDLKRRVDELKKEIERALKEHKDKVKKLLDDLRRLNEELRREVRRVLEEVRETTR

SEQ ID NO: 5490 - protein, 63 aa, Artificial Sequence
  Synthetic sequence.
DEIERVEEALKKVEKDLRRLIRELEKLNDKIERDIRRLHEETNKRLKEVREKVEDMIRRVSAR

SEQ ID NO: 5491 - protein, 59 aa, Artificial Sequence
  Synthetic sequence.
RRVVKKLLDEIEEILRRLKKLVDDHARESKRILRESERKVEALLEEIEEILKRLEEKVK

SEQ ID NO: 5492 - protein, 60 aa, Artificial Sequence
  Synthetic sequence.
DEIERVLREIDELRKKVEKVIEDSRRNAKRWLDRVKRTAEELNKLSDELLEEVTRLAEAG

SEQ ID NO: 5493 - protein, 59 aa, Artificial Sequence
  Synthetic sequence.
SRAMEEVRKTAEEVIKTVDKLLKELRKTYEDILRDIDRLLKEHHARNRRVLEEVERLTQ

SEQ ID NO: 5494 - protein, 56 aa, Artificial Sequence
  Synthetic sequence.
SEREEVKKRLDDVRREAKRLLDEVRKRLEESHRKHKKLLDEVRKRLKEVEEEAKRR

SEQ ID NO: 5495 - protein, 56 aa, Artificial Sequence
  Synthetic sequence.
KEKVTKIIEDLKRELEEMFRKLKRLVEEDDRRSKESLEEVRKLVEDARRKIEEDTR

SEQ ID NO: 5496 - protein, 60 aa, Artificial Sequence
  Synthetic sequence.
SSIEKLKKVVEDIKRRSEDLNRELEKVVRDVKKRSEELNEELRKVSEEIERRLRELLKRI

SEQ ID NO: 5497 - protein, 55 aa, Artificial Sequence
  Synthetic sequence.
ERFVEELRRALKKDEDDMRRVVEDIERLLEEDERRMKKAVEDHRRLLEELEERAK

SEQ ID NO: 5498 - protein, 56 aa, Artificial Sequence
  Synthetic sequence.
DESEELKKVLKEIEDEVRRLIREIERVLEEIERRDRELLKRDEETLKRIEEEVRKL

SEQ ID NO: 5499 - protein, 55 aa, Artificial Sequence
  Synthetic sequence.
EEIIEELRRILKEAEDVIRRIIEEVRDVLRESEKRVRESIDENRKILEELRRRAK

SEQ ID NO: 5500 - protein, 56 aa, Artificial Sequence
  Synthetic sequence.
DEEDRLRRELEKVRRDADRLLEEIRRVLEEVERRSKELLKRDEDSLREIVRTVTEE

SEQ ID NO: 5501 - protein, 55 aa, Artificial Sequence
  Synthetic sequence.
DEVLEEIRRILEELRKEAEDIIRRIRELLRELEKNVTDSIRRNEEMLKELRRKVK

SEQ ID NO: 5502 - protein, 59 aa, Artificial Sequence
  Synthetic sequence.
SEAEKILEDMKRYIEEHIERVKRSLEENKKKDRELIEKSRKSLEDARKKIRELLELVRQ

SEQ ID NO: 5503 - protein, 56 aa, Artificial Sequence
  Synthetic sequence.
EEILKRIRDLVKELEERDRRVIEEMKKSNKRTEDTDREVLERIRRLVERLADEARK

SEQ ID NO: 5504 - protein, 60 aa, Artificial Sequence
  Synthetic sequence.
SELERVIEEIKRLLERLKRENEEVKKRVKKLLDELRKINKDVEDTVRELLKRVKELVDRA

SEQ ID NO: 5505 - protein, 59 aa, Artificial Sequence
  Synthetic sequence.
KDEIEEALRRVEEHIKRHLKTVKELAEKAERHIREHLKEVKRMLEKAKRTIDELLKKIK

SEQ ID NO: 5506 - protein, 57 aa, Artificial Sequence
  Synthetic sequence.
SLREAAKEVLERVRREVEKLRKSNEEVLTRVREEVKKLLETNKDVLRRVAEILKTAN

SEQ ID NO: 5507 - protein, 55 aa, Artificial Sequence
  Synthetic sequence.
EEDIREIEDILRKIAETVETLNRRLEDILREIRKSSKKTIDELREKAKELEDRTR

SEQ ID NO: 5508 - protein, 61 aa, Artificial Sequence
  Synthetic sequence.
SEVDEDLKDIKRYLDEHRKRVEEVVKRLEDRSRETAREVEEDVKRIERKVEEAKKEADERG

SEQ ID NO: 5509 - protein, 59 aa, Artificial Sequence
  Synthetic sequence.
EDAKRRIEEVLERVRRELERSEEKLRRVLEKHREDNDRLEEELDRVLRELEKILDEVAT

SEQ ID NO: 5510 - protein, 60 aa, Artificial Sequence
  Synthetic sequence.
DEVRKILKELKELVKRIEDKLRKYLEDVRREVERIEEEVRRNLERIKRLAEEIERRVRRD

SEQ ID NO: 5511 - protein, 59 aa, Artificial Sequence
  Synthetic sequence.
EDVKRKIDKVLDEVRRLLEDIKRRVEKINTDTERLLKKLAEDSKRALEEVKETLERAER

SEQ ID NO: 5512 - protein, 60 aa, Artificial Sequence
  Synthetic sequence.
ELRERIKRALDEHRRVSEELERRVREANKRHNEVSKEVKDDLKRSHDELRESLERIKRRG

SEQ ID NO: 5513 - protein, 55 aa, Artificial Sequence
  Synthetic sequence.
EEDLKRIREETERLKEDVRRYLRELEKLSRDLRRKVEELLKDNKRKVKEIEDEAK

SEQ ID NO: 5514 - protein, 60 aa, Artificial Sequence
  Synthetic sequence.
DELETLEERIRRSVERVRRELKRYKEEMDKHSEDLKRLVDKNLEDVRRELEEIRKLATDG

SEQ ID NO: 5515 - protein, 59 aa, Artificial Sequence
  Synthetic sequence.
EDMEKKLRELLERHERENKKAREDVEEANRRNEEVLKDIERRSKKALDDVRRELERVRK

SEQ ID NO: 5516 - protein, 61 aa, Artificial Sequence
  Synthetic sequence.
SLKEVLDKIEEDHRRMSKRNEEVLEEVKRRAEKLLKDAEEVLRRVRERIEELIRRVEETKG

SEQ ID NO: 5517 - protein, 56 aa, Artificial Sequence
  Synthetic sequence.
VKELKKRADESRKTVERLSRELKKELRKVEEDVKREVEKIEEDLKRIARRVREESR

SEQ ID NO: 5518 - protein, 60 aa, Artificial Sequence
  Synthetic sequence.
SELERLLEEVERLLEKLERDNKRLLDDVRRLLERLRRDNERLLEKNKRLLDRLREEVSRV

SEQ ID NO: 5519 - protein, 56 aa, Artificial Sequence
  Synthetic sequence.
IEKLAREVKRHIERHKEELDRLRKEVEKNARKHEEDLRRLEERSKKHVEDIERETR

SEQ ID NO: 5520 - protein, 60 aa, Artificial Sequence
  Synthetic sequence.
SELEKLLEDVKRLLDELRERNEKVLEDARRLLEELRKRNEDLLRRNRELLERLEREVSKV

SEQ ID NO: 5521 - protein, 56 aa, Artificial Sequence
  Synthetic sequence.
IDRVRRRVERHIREHERDLREVKKRIEEDAKRHRDRLKKLEEDSREHVKRMEDRTR

SEQ ID NO: 5522 - protein, 60 aa, Artificial Sequence
  Synthetic sequence.
KLEELAKELRRLLEELRKRSKEVIDRLRRLNEELRKTSEEVIRRLRELNRRLTEKARRRL

SEQ ID NO: 5523 - protein, 55 aa, Artificial Sequence
  Synthetic sequence.
EEVLRKVREEVKEHERRLEDALRRSKKEIDDHKRELEELLKENAEEVRRVEERIR

SEQ ID NO: 5524 - protein, 60 aa, Artificial Sequence
  Synthetic sequence.
KAEELVRELKRLLDKLREESKKVIEELKRRLDEVAKKSEDVVEEMRRLLEELKEKIERRL

SEQ ID NO: 5525 - protein, 55 aa, Artificial Sequence
  Synthetic sequence.
EEVLRDVRRKVEDHRRKLDEIRKRVTDEARRHERELEKALEKIRRDIRRIEEELR

SEQ ID NO: 5526 - protein, 60 aa, Artificial Sequence
  Synthetic sequence.
KVEDLLREAKALLDELKRESERIIKELRKLNDDLTKKSEEVIRELEKLLRDLKKIVDERL

SEQ ID NO: 5527 - protein, 55 aa, Artificial Sequence
  Synthetic sequence.
EEALKKVRKEVEDHKRRLKEAVDRNRKKIKDHEEELERTLRDIRRKIDKERRELE

SEQ ID NO: 5528 - protein, 59 aa, Artificial Sequence
  Synthetic sequence.
EELERLLKRVRDESKKNRDKVREDLERSRRKSKRHEDELRRLLKEARDDIDRVRDLRRK

SEQ ID NO: 5529 - protein, 56 aa, Artificial Sequence
  Synthetic sequence.
EEVVKEAEKILDDNRKENERVSEEDKELLERNKKKAEDVLRELEELIRKLAEELKK

SEQ ID NO: 5530 - protein, 60 aa, Artificial Sequence
  Synthetic sequence.
SELEELLKRIRDKSKENEDEVRTDLKRVRDYARRHEERLRELLERVRDELRKAEELRRAG

SEQ ID NO: 5531 - protein, 56 aa, Artificial Sequence
  Synthetic sequence.
ERVLEEIERIMRENKRRNEEVIKEIKELIDRLRRKSERVIEEIKKRIDELRDKARR

SEQ ID NO: 5532 - protein, 61 aa, Artificial Sequence
  Synthetic sequence.
EEEREIEERLRKKIEEIRREDKRHHDEVRRKVKEIKEEDREHHERVKRKAEEVKKRIETTG

SEQ ID NO: 5533 - protein, 55 aa, Artificial Sequence
  Synthetic sequence.
KDVLRELKRLLDELRESARKNNEDLKRLLEELEESVKRNNDELKKLLDELKERAR

SEQ ID NO: 5534 - protein, 61 aa, Artificial Sequence
  Synthetic sequence.
RELEELAERVKRLLERDEELLRRLKDAVRRLSEKDRRLLERLAREVKRLLDELRDLVRKRL

SEQ ID NO: 5535 - protein, 59 aa, Artificial Sequence
  Synthetic sequence.
KELLERVITELERKARESEKKHEDSLRELERLARESEERHKRSLEEVERKIEEIKRDLD

SEQ ID NO: 5536 - protein, 60 aa, Artificial Sequence
  Synthetic sequence.
RELEKLEDEIRRELRRIEKELKDYERELEERADKDRRDIEDYRRRLEERVKEIEDRLRRD

SEQ ID NO: 5537 - protein, 55 aa, Artificial Sequence
  Synthetic sequence.
EELRKILEDALKRVREEVKRILDRNRELLRESEELVRRVLKRNRDLLREVDERVR

SEQ ID NO: 5538 - protein, 61 aa, Artificial Sequence
  Synthetic sequence.
DKVREALKRLKDKMETYERRSKKHIEDHKRKLKEYEERVRRNIKRLREELKKLEEDAKTRG

SEQ ID NO: 5539 - protein, 59 aa, Artificial Sequence
  Synthetic sequence.
EELLKRVDELARRIMKRIKELNRENERVVRESLKRVDELNKRSEKVHKEVLDRLEELRR

SEQ ID NO: 5540 - protein, 57 aa, Artificial Sequence
  Synthetic sequence.
SLKEELEKLVRDIIRDNRRLLEENEELVRRSEESNKRLLEENEETARRIKAELERAG

SEQ ID NO: 5541 - protein, 59 aa, Artificial Sequence
  Synthetic sequence.
EKLVEEVKRKLKRKLEEIRREHRRTKEEIKKTNEDIKRRHDETLRRLEKTLEDIKERTR

SEQ ID NO: 5542 - protein, 60 aa, Artificial Sequence
  Synthetic sequence.
SEVEKILEELKREVREHERRVEKLVRELEDYVRRHREKVKRIEERLRDKLREIEELVKEG

SEQ ID NO: 5543 - protein, 59 aa, Artificial Sequence
  Synthetic sequence.
EKAVREIETLADEIRERIERSLKRIRDLIREIKEDLRRSLERIREIIREIKKAIDDRRK

SEQ ID NO: 5544 - protein, 60 aa, Artificial Sequence
  Synthetic sequence.
SEVEKILKEIRDENERLKKEIEEILRELERKLREHRREVEEVLKRIREKIETLKDESRRE

SEQ ID NO: 5545 - protein, 59 aa, Artificial Sequence
  Synthetic sequence.
EEMLREMERISREDRETLKRLTDRIREMIRRLEEEIKRSEREAREIIKEAKKVLEDEAT

SEQ ID NO: 5546 - protein, 61 aa, Artificial Sequence
  Synthetic sequence.
SRVEELIKDLRRSTKELEDRVRKLLEELKDKTRRTEKRNREKLEKLKEELRKLEEDVKREG

SEQ ID NO: 5547 - protein, 55 aa, Artificial Sequence
  Synthetic sequence.
EKVRKVMEDDRRKLKKILDDVEDVLRKHKKVLEDLKRTNDDVLREARKLAEKIRR

SEQ ID NO: 5548 - protein, 60 aa, Artificial Sequence
  Synthetic sequence.
SAEERLKEALKRLDDVSKRSEEEIRRMIKRIERISRESLKRLKDLNRRIKELVERIERRL

SEQ ID NO: 5549 - protein, 55 aa, Artificial Sequence
  Synthetic sequence.
ERLLEEIKRYIDEHKRRLDELRKDIERYLEEHKERLRELEKRHEELLRTLDREAK

SEQ ID NO: 5550 - protein, 61 aa, Artificial Sequence
  Synthetic sequence.
SAEEDLDRMRKKVEDVIREDKERVRKLLERAKEVIRESEKKHEDLRRRIRKVIKEIRERTN

SEQ ID NO: 5551 - protein, 59 aa, Artificial Sequence
  Synthetic sequence.
DTDLERELRRIDKHLRDHKDEARKSEERVEDHLRRHRERVRRNEEDVEDKLKKLKDETK

SEQ ID NO: 5552 - protein, 59 aa, Artificial Sequence
  Synthetic sequence.
REEEELKRRNKDHNRRHREDTKRIAEDVDRKLREWKKKSDEAREEVKRLLERLKELADR

SEQ ID NO: 5553 - protein, 55 aa, Artificial Sequence
  Synthetic sequence.
EDLRRLMKENRETIRESAEILERLRERVEDLVRRDREILEKLLRDIEELAERIKR

SEQ ID NO: 5554 - protein, 60 aa, Artificial Sequence
  Synthetic sequence.
SVEDELRKLEERLKRIADELRRLVEKNIEDNKESLKEIEKLIRENIERNKEVLKRIAERG

SEQ ID NO: 5555 - protein, 59 aa, Artificial Sequence
  Synthetic sequence.
KDELKKALDDVDKKLEDLRREVEDRDRKNEEDNRRLRKELEERSRENKEFLDKLAREAD

SEQ ID NO: 5556 - protein, 61 aa, Artificial Sequence
  Synthetic sequence.
SEKDESARDIEEKLERHLRKSDESRRRNEKRIKEHRDRSDESRKKFETDLKRIEDEVRKRG

SEQ ID NO: 5557 - protein, 55 aa, Artificial Sequence
  Synthetic sequence.
EKLKDLERKVREVIDRDRDILRRLEEEHRKVITEDEEILKRLEEKAREAIERIRR

SEQ ID NO: 5558 - protein, 61 aa, Artificial Sequence
  Synthetic sequence.
SEKDERLEEIKRRLKEHKRRSEEAVKDNDRKLEKHKRDSDRSAEEVKKKLEEIEKRVRKDG

SEQ ID NO: 5559 - protein, 55 aa, Artificial Sequence
  Synthetic sequence.
KKLDDLEREIRKVIEESKRLLEELERRHRRVIEEDKRILDELRRLIEELIEDAKR

SEQ ID NO: 5560 - protein, 61 aa, Artificial Sequence
  Synthetic sequence.
SEKDEELKRIKEDLERHERESEDDVRRNEEKIRRHRRKTEEAVKEVEEELKRLEEDVRREG

SEQ ID NO: 5561 - protein, 55 aa, Artificial Sequence
  Synthetic sequence.
RDLERLRKEIREVIEKSKDLLRELRRRHEKVIEDSEDILRKLEKKIKDLVDKIRK

SEQ ID NO: 5562 - protein, 61 aa, Artificial Sequence
  Synthetic sequence.
SRKDEEVKRVKEKLKKHEERSRDMVRKVEDKSRRHREKIKEAEREVRRRIEELEEDVRRRG

SEQ ID NO: 5563 - protein, 55 aa, Artificial Sequence
  Synthetic sequence.
KKLEDLREEAERVIRRSEKLLEELREHVERNIDEVREILRELAELVKRVIDEIRR

SEQ ID NO: 5564 - protein, 60 aa, Artificial Sequence
  Synthetic sequence.
SVEDILRTLRRLLEELEEESERILKRLREIIETNVRRVKELLRRLKERLDELAERLKAKV

SEQ ID NO: 5565 - protein, 59 aa, Artificial Sequence
  Synthetic sequence.
SKELDDLLKKVEEHLRRHKRKLEKALKDVEDESREHEKELRRALKRIERLLRELERKAD

SEQ ID NO: 5566 - protein, 60 aa, Artificial Sequence
  Synthetic sequence.
DEEEVIREIEKRFRDLIRRAEDVLRRIAEKMKRLKDKTRRLLEELRESNRKLIKELRDRI

SEQ ID NO: 5567 - protein, 56 aa, Artificial Sequence
  Synthetic sequence.
SKEVRDRVEEELKRIEDRLRKLDTDVDRYLKEHEDRLRKLKEDNERDLKRVEERAR

SEQ ID NO: 5568 - protein, 56 aa, Artificial Sequence
  Synthetic sequence.
DIEELLKEVKKEVDRVEKKVKELIDRNKERVDRVREENERVADEVRKLIKELRDRI

SEQ ID NO: 5569 - protein, 59 aa, Artificial Sequence
  Synthetic sequence.
RELVEKVAREAREKLKKVEDLLRKISRRSEELLRRNREATKKILKELRELLRRVEEKRR

SEQ ID NO: 5570 - protein, 59 aa, Artificial Sequence
  Synthetic sequence.
SEAEEALKRHRKLNKEAEKRAKDATDDSKRLLDEIRKRAKEASEDSKRLLDEARRLREA

SEQ ID NO: 5571 - protein, 60 aa, Artificial Sequence
  Synthetic sequence.
KERVRRILEEAKKTARELRERIKKLLKENEDAAKKLRDEIDEAAKKNKKAADEAREEARR

SEQ ID NO: 5572 - protein, 59 aa, Artificial Sequence
  Synthetic sequence.
SELEKVLEEHRRLNDEIRKELEDVTRKSEETNKRIEEDLRRVTKEAKDLLERIKEKLEA

SEQ ID NO: 5573 - protein, 60 aa, Artificial Sequence
  Synthetic sequence.
RRRVEEILRDMKETVDKLKKEIEKLLEENKESAKELRERIKENLETNRDLVRKLEEDIKR

SEQ ID NO: 5574 - protein, 59 aa, Artificial Sequence
  Synthetic sequence.
DEAEKALEEVRDLIREIRERDRKVTEDVERLNREIREKLKEVTERVKRSNDDIRRLLEE

SEQ ID NO: 5575 - protein, 56 aa, Artificial Sequence
  Synthetic sequence.
KSILEELERLVRELRKESEKSLEDLERLNKKLEDEVRDILRKLNKLNEDLLRKVEE

SEQ ID NO: 5576 - protein, 59 aa, Artificial Sequence
  Synthetic sequence.
SEMDEARKEVKKLLDEVRKRDEDVTRKVEELNKRIEERAKRVAEEVEKLIREILKRLRD

SEQ ID NO: 5577 - protein, 56 aa, Artificial Sequence
  Synthetic sequence.
EKILEDLRRLVKKLKEESDRSLERLERLNERLERRIREILKRLEKLVRELRKEVER

SEQ ID NO: 5578 - protein, 59 aa, Artificial Sequence
  Synthetic sequence.
SEAEEALRKVEELIRRVKKRDDEAVKEVRELNKRIADILREVLETVRKLLEDVEKALRD

SEQ ID NO: 5579 - protein, 56 aa, Artificial Sequence
  Synthetic sequence.
EDILRTLRELVRDLERKSEESLKELNRLNEDLKREVKRVLDELEELVRRLKKKVDD

SEQ ID NO: 5580 - protein, 57 aa, Artificial Sequence
  Synthetic sequence.
QVEDVIRESKKLTEDSEKRVRDIIRRLKKTIKDSEDRVRRMVEELRERIKRLRERLE

SEQ ID NO: 5581 - protein, 60 aa, Artificial Sequence
  Synthetic sequence.
SDEVIETLLRKDRDLNRRVNEELRKLEEEVEELNRRVNETIKEILRRIAELIRRILEKTK

SEQ ID NO: 5582 - protein, 56 aa, Artificial Sequence
  Synthetic sequence.
KVEEILKELEELIKRSKETVDEVIKRSKDLVDESRRRIEDVIRELEKLIRELDKKL

SEQ ID NO: 5583 - protein, 60 aa, Artificial Sequence
  Synthetic sequence.
SEEVVRTLVKEIRDLNKRVNEEIKRLLDEDKKLNEEVNRLIKELKKEIEDLIREVLEDKR

SEQ ID NO: 5584 - protein, 57 aa, Artificial Sequence
  Synthetic sequence.
EVEDIIRESKKLIEDSKERVKEVIKESKRLIEELERTVREVIKELRERVDRLRKKLR

SEQ ID NO: 5585 - protein, 60 aa, Artificial Sequence
  Synthetic sequence.
SKEVLDTLLKEDRDLNEDVKRRITELLEEDRRLIEEVKKRIRELRERIKRVIEEVDRATT

SEQ ID NO: 5586 - protein, 57 aa, Artificial Sequence
  Synthetic sequence.
STAEEIVRRIRDVNRRINEAIERLLEEDEKVIRDVERRIEEVLERDRRVIEEVKRRV

SEQ ID NO: 5587 - protein, 56 aa, Artificial Sequence
  Synthetic sequence.
ERIIEEIKRILKESEDRLRRILETSRERLKELKKKLERVLEDSKKKLDELRRELRK

SEQ ID NO: 5588 - protein, 57 aa, Artificial Sequence
  Synthetic sequence.
REAEDLVRKVREVNKKANRDIKELLDRDEKVIREVARAAEAIVDEARRIVEEVERKI

SEQ ID NO: 5589 - protein, 56 aa, Artificial Sequence
  Synthetic sequence.
ERIIKEIKETLDESRKRAEEVLEKSRRLLEELRKRVEEIVKRIKELIDELERRVRK

SEQ ID NO: 5590 - protein, 59 aa, Artificial Sequence
  Synthetic sequence.
SAEEIIKTLEELVEKLKRDAEETLRKIEELVRRLEEEARKSSEKIRKLVEDLAKEARER

SEQ ID NO: 5591 - protein, 59 aa, Artificial Sequence
  Synthetic sequence.
DEVLTEVLKEITELVKRLKELSDRTLEEVRKLVERVKRESKRTLEEAEEVVRELKERLR

SEQ ID NO: 5592 - protein, 59 aa, Artificial Sequence
  Synthetic sequence.
DAERLLREVEELVRRLEEEMEKTDREIKELIKRLEERLRTTSREIKKLIEDLEREARER

SEQ ID NO: 5593 - protein, 59 aa, Artificial Sequence
  Synthetic sequence.
REVLKKVIDEIRKLVKRVKDESKRSLDEIRKLAEEVDRRSKKVLDEIRRLVDEVRERLR

SEQ ID NO: 5594 - protein, 59 aa, Artificial Sequence
  Synthetic sequence.
DAEDILREIKKLADDLKREADKSLKEIEELARRLEEEAERSLREIEELARRLKKRADEK

SEQ ID NO: 5595 - protein, 59 aa, Artificial Sequence
  Synthetic sequence.
REALKRAAERARELADRARKLSEDTLRKAKKLADDARKLSRETLEKARELAERAERRLT

SEQ ID NO: 5596 - protein, 59 aa, Artificial Sequence
  Synthetic sequence.
DEAEEVRERVKKLIEESKRLIEEVRRRVRTISERSAELIEEVERRVDKMARDVERLLKD

SEQ ID NO: 5597 - protein, 56 aa, Artificial Sequence
  Synthetic sequence.
DEVLRRLEKLVRDSNDEIRRVLKELKEVVKKNRDEIERVLKEARKKVEDLLREIER

SEQ ID NO: 5598 - protein, 59 aa, Artificial Sequence
  Synthetic sequence.
SEVERVRRENEETIRRIDEVIKKIEEDNKRTIDEIRDVIRRVKETVEKTNREIEKVRRD

SEQ ID NO: 5599 - protein, 56 aa, Artificial Sequence
  Synthetic sequence.
DEALRELRKSNEDLERRIRKVLEDLKRSNDELLEEIDRVLKRLHKSDEDVRKRVTD

SEQ ID NO: 5600 - protein, 59 aa, Artificial Sequence
  Synthetic sequence.
RELEEAEKTVEELIRRIKEIIDEVLKRDRDVSERSKELIDKVKREAEKIVEEIERLLKN

SEQ ID NO: 5601 - protein, 56 aa, Artificial Sequence
  Synthetic sequence.
SEVLRKLDKKVKDLKREIDDVVRESKELIKRNRRRVEEVAKELERLIKEVKDRIDT

SEQ ID NO: 5602 - protein, 59 aa, Artificial Sequence
  Synthetic sequence.
DELERVREEVRRLIKEIEEIIERVERRDEEVSRKSEDLIRRVLKRDEELAKEIEDLKRN

SEQ ID NO: 5603 - protein, 56 aa, Artificial Sequence
  Synthetic sequence.
SRVLEELKRLVEELEREIRRVFEKSKKLIDDNRKKADDVVKRSEDLLREVKKEIDR

SEQ ID NO: 5604 - protein, 60 aa, Artificial Sequence
  Synthetic sequence.
SESEEVERLVEDVSRRNTKAVRDIEEHSKDVSRRNKKLVREVEEHTREVIERAKELTKRR

SEQ ID NO: 5605 - protein, 56 aa, Artificial Sequence
  Synthetic sequence.
RDVVERIRRLLRENVEENKKVLKRSDDLLKKNERENREVVKKSEKDARDLVEEIKT

SEQ ID NO: 5606 - protein, 60 aa, Artificial Sequence
  Synthetic sequence.
SEEEDVRRKVEKVSRENKDMVRRILEHSRKVSEDNRRLVKEILDRARKAIEDVKELIERL

SEQ ID NO: 5607 - protein, 56 aa, Artificial Sequence
  Synthetic sequence.
RDVVREIKELLDRNREENRKVLEDSERLVDENEKDNKRVLDELRRLLKRAEEEARR

SEQ ID NO: 5608 - protein, 60 aa, Artificial Sequence
  Synthetic sequence.
SIDKALRDLKEILDRNRKHSEDLLREAEELVERSNDHSRRVLEEIRKLLRELEEEIRKRV

SEQ ID NO: 5609 - protein, 59 aa, Artificial Sequence
  Synthetic sequence.
EKLVREVEKTVEDLSRENKKLNEDVKRTVDELIKKSEKLNEDAKRTIDELLKRVKERIE

SEQ ID NO: 5610 - protein, 60 aa, Artificial Sequence
  Synthetic sequence.
SVEDLLRKLKTIVDENRERVKKSLEELRRILDENRRRVERSLRELRESNERLRKEIEDTV

SEQ ID NO: 5611 - protein, 59 aa, Artificial Sequence
  Synthetic sequence.
EEVLKKVEETVKRLSDENRELNKRIKEEVDEMSKRNKELNKRIKEENDKLIKEVKDEIR

SEQ ID NO: 5612 - protein, 60 aa, Artificial Sequence
  Synthetic sequence.
SVEDVLRELKELIDRNREEAKKTEKELRELIKRNDDEAEKVAKESKKLTEDLEKEAREKV

SEQ ID NO: 5613 - protein, 59 aa, Artificial Sequence
  Synthetic sequence.
EKVLREAKERAKEISKRNKDVNEEARKRIKEISDKDKRILDEVRRESKEIEKRLKEALK

SEQ ID NO: 5614 - protein, 60 aa, Artificial Sequence
  Synthetic sequence.
DDEERVREVVKRVKEDNERVDREIREIVKRLLEHDRELLEEIKKEVDRVAEELRKLKEDG

SEQ ID NO: 5615 - protein, 56 aa, Artificial Sequence
  Synthetic sequence.
SEVLERLRKTLEELEKRNEELLEEARRLLEESREEVRELLERAKKILEDLEREIRR

SEQ ID NO: 5616 - protein, 60 aa, Artificial Sequence
  Synthetic sequence.
SREERVREVVKRMLERDEELLRRIREEVERALRRNDEVLREIERVVEEMEERVERLKREG

SEQ ID NO: 5617 - protein, 56 aa, Artificial Sequence
  Synthetic sequence.
DEVLEDLRRLLEESVRRVEDLLKKLTDIVRESRKRVRDILRKAKRIVDKLREEIKK

SEQ ID NO: 5618 - protein, 60 aa, Artificial Sequence
  Synthetic sequence.
DVEREAKRLLEEVAEHVRRSIKELRKLLEDVARHVEKTLRELEKLTDDVRKRVEKLKRDV

SEQ ID NO: 5619 - protein, 56 aa, Artificial Sequence
  Synthetic sequence.
RKVVEDIREKVKDLKRKHDTVLEEIKKEVRRLEKEHKEVLDKSNEDARKLEEDLRR

SEQ ID NO: 5620 - protein, 59 aa, Artificial Sequence
  Synthetic sequence.
SEREEAKKLLRENEEDNRRVDREVEKLTEENERINRRVNEEVRKLTEDIKRKVESVKRL

SEQ ID NO: 5621 - protein, 56 aa, Artificial Sequence
  Synthetic sequence.
RDIVEDIRRKADRLRERNEETLKRDEDKLKKLEESNRKVLKEDEDELRRLADKLRK

SEQ ID NO: 5622 - protein, 60 aa, Artificial Sequence
  Synthetic sequence.
SEAEEAAKRSRDTAKRAEEIAREAAERLKKNAEDAERIAREAKKTSKKTAKEAEDAARSN

SEQ ID NO: 5623 - protein, 55 aa, Artificial Sequence
  Synthetic sequence.
DELRELAKRTEDKARKLADELRKLADETEKKARKLAEEVKKLADDTRRKAEEARR

SEQ ID NO: 5624 - protein, 59 aa, Artificial Sequence
  Synthetic sequence.
DEVEKAKEESRRTLKKIEDRVRKVAEDLKKNLEDIERRVREVLEELRRLLEEIEEVVRR

SEQ ID NO: 5625 - protein, 55 aa, Artificial Sequence
  Synthetic sequence.
EELERLVEKTEDKIRKLLEEIKELLKETEKKIRKLLKRIEELMKEIEDKIDEDKK

SEQ ID NO: 5626 - protein, 59 aa, Artificial Sequence
  Synthetic sequence.
DEVERVKEELKRNLKEIREDVERVKEESRDTVRKATEIVKRVLEELKKSLEEIKKLVDD

SEQ ID NO: 5627 - protein, 55 aa, Artificial Sequence
  Synthetic sequence.
EELRDTLRKSAEDIERLLREIEDLVRKTTEDAKRLADEVRRLVKESERTIKERAD

SEQ ID NO: 5628 - protein, 59 aa, Artificial Sequence
  Synthetic sequence.
SEVEKVDRELKDNLRRIEEEVRKVDEELRRLLEEIRRTVEEFKERSKRTVEEIEKVARE

SEQ ID NO: 5629 - protein, 55 aa, Artificial Sequence
  Synthetic sequence.
EELRRTLEESERRIRKLLEDLKRLLEEIEKDIRRLEEEVDKLVRDTEKRIDDLRR

SEQ ID NO: 5630 - protein, 60 aa, Artificial Sequence
  Synthetic sequence.
SLEDELRRRITEAEKRIRDLLRRVRELVERSKKTIKDLLRKLEETARETKDEIRKLEEEV

SEQ ID NO: 5631 - protein, 59 aa, Artificial Sequence
  Synthetic sequence.
EEKVRRVEREIKEILKKIEEDVTRLLEENKKILKEVEDLVRELEKEDRDVLKKVRDDVK

SEQ ID NO: 5632 - protein, 60 aa, Artificial Sequence
  Synthetic sequence.
DLRERLEEEIERARRDIEDLLRKAEELAKRSKDDIKRLMDEVRRLVEKTRRDIEKLLREV

SEQ ID NO: 5633 - protein, 59 aa, Artificial Sequence
  Synthetic sequence.
EEKVRKVEEEIRRVLEKIRRDARKLLEENKRITDEVRKRVKELLEENRKVLKRIKDEVD

SEQ ID NO: 5634 - protein, 60 aa, Artificial Sequence
  Synthetic sequence.
KLREELEKLAEEAKKRIEDLAREAREAAKRASESNKDLARRLRELAKRTEDEIKRLLDDA

SEQ ID NO: 5635 - protein, 59 aa, Artificial Sequence
  Synthetic sequence.
EEAARKAAEEIKKILEEAERLAREALKELERSNEESERLARRAAEEDKRVADEARERAR

SEQ ID NO: 5636 - protein, 60 aa, Artificial Sequence
  Synthetic sequence.
SLREELRKKIEEAKKRIEKLMDDVRKEAEKAKRSNEELLRRLRKLAKETKRRIEELLERV

SEQ ID NO: 5637 - protein, 59 aa, Artificial Sequence
  Synthetic sequence.
EEKVRRLLKEIEEILRRIEDKVRKLLKELRDSNRDSKRLVDELMRRDKEVLRRIEEEVK

SEQ ID NO: 5638 - protein, 60 aa, Artificial Sequence
  Synthetic sequence.
DLERELEELIKKAEKKIRDLRKEVEDVVRDASRSNKELLREAEKLAEETRKRIDDLRKEV

SEQ ID NO: 5639 - protein, 59 aa, Artificial Sequence
  Synthetic sequence.
EEKVRELEKRIRDVLRRIEEEVRRLLKRLKDSNDDSRRRLEELLRRDKKVLEDIERETK

SEQ ID NO: 5640 - protein, 60 aa, Artificial Sequence
  Synthetic sequence.
SLREELERLIKEAEEKIRRLLKEVKDLVRELSRTNKKLLKEVRDLAKRTKERIKRLLDEL

SEQ ID NO: 5641 - protein, 59 aa, Artificial Sequence
  Synthetic sequence.
EDKVRKLLEDIERLLREIERLVRELLEELKDSNRRSEELVRRLLKEDKDVLEKAERDVR

SEQ ID NO: 5642 - protein, 57 aa, Artificial Sequence
  Synthetic sequence.
DEEEELRRLVRRLMEEVKRLLEENKKLADELRKTVKKLLEDNEDLARRLREEVERKV

SEQ ID NO: 5643 - protein, 56 aa, Artificial Sequence
  Synthetic sequence.
VEEVKKELEELLREVEELSRRSLKELKELLERVKKRSEESLKELEDLLREAERKSR

SEQ ID NO: 5644 - protein, 57 aa, Artificial Sequence
  Synthetic sequence.
SEKEELKKEVDRLAEEVERLLRENEKRARDLERKIRKLLEENRRAADEVRKEVDRTV

SEQ ID NO: 5645 - protein, 56 aa, Artificial Sequence
  Synthetic sequence.
VEEVKKRLEDLLEEVKELSKRSEDTLRKLAEDVKRLAEDSNKKLEDLLEEAKERAR

SEQ ID NO: 5646 - protein, 57 aa, Artificial Sequence
  Synthetic sequence.
SEKEELRDLVRRAKEDVDRLRRENEELNRRIEEDIERLLKENEDRNREVKDDIDKRV

SEQ ID NO: 5647 - protein, 56 aa, Artificial Sequence
  Synthetic sequence.
VEEVKKELEELLRRVRKLSEDSLKHLRELLKEVRELSERSLRHLDELLRRVREKAR

SEQ ID NO: 5648 - protein, 57 aa, Artificial Sequence
  Synthetic sequence.
KDEEDAERRARESDKSIEELRERNEREAKRLKEEVEKLLEENEKKVDELRKRVEKTV

SEQ ID NO: 5649 - protein, 56 aa, Artificial Sequence
  Synthetic sequence.
MEEVKEELDRLNKEAEELSRRSLRKLEELLREARRLSRESKERLKKLLEDARRKSN

SEQ ID NO: 5650 - protein, 57 aa, Artificial Sequence
  Synthetic sequence.
SDEERAREEARRSKESIERLLEENRRLAKELKKEIRRLLKENEDLVRKLKEDVDREV

SEQ ID NO: 5651 - protein, 56 aa, Artificial Sequence
  Synthetic sequence.
IEEVLEELDRLNKEVEELSRRSLKRLEELLEEVRKLSEDSLRKLKELLDRVREKSR

SEQ ID NO: 5652 - protein, 60 aa, Artificial Sequence
  Synthetic sequence.
DERERLRKALEEVRRTVEKLVRENEELLKKVEERVRRLNDEDRRLVEEIKRRADELRKRG

SEQ ID NO: 5653 - protein, 59 aa, Artificial Sequence
  Synthetic sequence.
DEVIRRVEDELRKVLEDIKRLSDKNKRDLEEALRDIERLVKENNKRLKEALDDLERAAT

SEQ ID NO: 5654 - protein, 59 aa, Artificial Sequence
  Synthetic sequence.
SEREDLKRELDEVRKDVARLNEEDRRLLEDARRDLEKLVRDNEELVERVKKTLKELEDR

SEQ ID NO: 5655 - protein, 59 aa, Artificial Sequence
  Synthetic sequence.
DEVIRRVRDRLRRVDEELKELVKRNNERLREVLERIRKLSRDNSERLKAALEKIKEEVR

SEQ ID NO: 5656 - protein, 60 aa, Artificial Sequence
  Synthetic sequence.
SLKEKIEKLLEESRKDIEELNERDKKRVKESEDTVRRLNEEDEELVKRVREELEKLRKEG

SEQ ID NO: 5657 - protein, 59 aa, Artificial Sequence
  Synthetic sequence.
EEVIKEVEKRLRDVTKTSREKVRENNRRLEEMTEDTKRLVEENNKDLDKALKDIRKKAE

SEQ ID NO: 5658 - protein, 60 aa, Artificial Sequence
  Synthetic sequence.
KEREELEKLLEEVERDVARLNKEDKDLVDEIRRRVDELVKRDKELLDRVRDRLRELSERG

SEQ ID NO: 5659 - protein, 59 aa, Artificial Sequence
  Synthetic sequence.
SRVIEKVKRDLRRVLEELRRLAEENNRRLDKALKELEDLVRKNNKKVEDALRKIEEEVR

SEQ ID NO: 5660 - protein, 60 aa, Artificial Sequence
  Synthetic sequence.
ELAEDLRRLLKEVEDRSRDLLRKNRKLLEEVRERTERLIKELEDLLEEITRRVKDLIRKI

SEQ ID NO: 5661 - protein, 59 aa, Artificial Sequence
  Synthetic sequence.
EELVRRVKEEIKRLMEEDKKLNKKSVEEIRELLKRDRDLIEEVKKEAERLLKEIEDEVR

SEQ ID NO: 5662 - protein, 60 aa, Artificial Sequence
  Synthetic sequence.
DLERELEKLLDEVRRRVEELNKRNEDLARKVAEDTKELLKELRELLEEVKRRVRDLIRKI

SEQ ID NO: 5663 - protein, 59 aa, Artificial Sequence
  Synthetic sequence.
REVAERVKEEIRRLLKEIEELNKRSEERIKKLLEDDRRLIERVKERIEDLLRRIEERTR

SEQ ID NO: 5664 - protein, 57 aa, Artificial Sequence
  Synthetic sequence.
DEVDELLKRLEDSSRKAEEDVKRMLERLEDSTRDAARRVKEMIKRNEEVSDEAEKRI

SEQ ID NO: 5665 - protein, 59 aa, Artificial Sequence
  Synthetic sequence.
DKVVKEIDDLLRESERRNRELLREIEELLKESERINRELLKEVDKVLRDSEERVERRRE

SEQ ID NO: 5666 - protein, 60 aa, Artificial Sequence
  Synthetic sequence.
DLERRLDKILRDIEEAARDNIRRNEELLKRSEENVRRNLEENKKKLEEIKREVEELERRV

SEQ ID NO: 5667 - protein, 59 aa, Artificial Sequence
  Synthetic sequence.
EELAKRAEERLRELLKELHEISKKMLREIKRVNDEINKVSKESLDELDELVKEIKERTR

SEQ ID NO: 5668 - protein, 60 aa, Artificial Sequence
  Synthetic sequence.
SLEEELRKMLEKVERDVRRNIERNKRLLDRSRENVKENIKKNRELLKEIEKDVRKLETDV

SEQ ID NO: 5669 - protein, 59 aa, Artificial Sequence
  Synthetic sequence.
EKLAEDAKRRLEELVREIHKISEDALEEIKRVNKEINDVSKEMLDRLRELLKEIKERTR

SEQ ID NO: 5670 - protein, 60 aa, Artificial Sequence
  Synthetic sequence.
SLEEELEKLLDEVRKEVKKNIDENKRLLDKSREEVRKNIKTNEDLLRRIEEKVRRLLEEV

SEQ ID NO: 5671 - protein, 59 aa, Artificial Sequence
  Synthetic sequence.
EELAERAKRELKKLEEEIHRISREALERSKKTVEELHEISKRMLDELKRVDKRLEDETR

SEQ ID NO: 5672 - protein, 60 aa, Artificial Sequence
  Synthetic sequence.
DQREDLDRRLREIEERVEENLRTNEELLKEVEKNAKENIDRNRKTLEDIKRRVDDLRRRV

SEQ ID NO: 5673 - protein, 59 aa, Artificial Sequence
  Synthetic sequence.
DELVERVKDELRKLVKEIHDVSKKALEDLERLLRELNEISERALRTLEKLLRKLEEDTR

SEQ ID NO: 5674 - protein, 60 aa, Artificial Sequence
  Synthetic sequence.
SLEETLKRILDKVREEAKRNIKENEDLMRESRRNVEENIRRNEKTLEDIEEEVRRLREEV

SEQ ID NO: 5675 - protein, 59 aa, Artificial Sequence
  Synthetic sequence.
EELAKRVKEELDKIVRRVHEISRRALEESRKTVEELNRESEKVLRELERLLRRLEEEVR

SEQ ID NO: 5676 - protein, 60 aa, Artificial Sequence
  Synthetic sequence.
SDEDDLRRILEEIRRNVERNIRENERLLDEIKKRVDENIKTNKKTLEDIREEVRKLEEEV

SEQ ID NO: 5677 - protein, 59 aa, Artificial Sequence
  Synthetic sequence.
RELVKRVEDTLRDLLRKLNEISKRALEELKRAVERIHRISRDALRELDRLRKELEERTR

SEQ ID NO: 5678 - protein, 60 aa, Artificial Sequence
  Synthetic sequence.
DDEERLDKILRDIEENARRNIERNRTLLERSRENVKRNIDENRRKLEEIRRDVEDLKRKV

SEQ ID NO: 5679 - protein, 59 aa, Artificial Sequence
  Synthetic sequence.
KELVKRAEDELRRLLKELNEISERMLRRSEETVRRLNEVSERALRELDRLRKKIERRTR

SEQ ID NO: 5680 - protein, 60 aa, Artificial Sequence
  Synthetic sequence.
SLEETIRRILEESERNVKRNIDENRKLLKEIRDNAKRNIDENRRLLEEIERTVRDLERRV

SEQ ID NO: 5681 - protein, 59 aa, Artificial Sequence
  Synthetic sequence.
EKLAEDVLRELDKANKDINEISKKMLEDLKKAVEDVNRVSKEMLERLKRLREEIEKRTR

SEQ ID NO: 5682 - protein, 60 aa, Artificial Sequence
  Synthetic sequence.
KDEERLDEILDRSRRNAETNIKRNKDLLDESRENVKENIKKNEDLARRIRERVEDLERKV

SEQ ID NO: 5683 - protein, 59 aa, Artificial Sequence
  Synthetic sequence.
EELVKRVEDELRRLNEEVNKISEEMLKRSKDTVRELNKVSEDALRKLDELRERIERRTT

SEQ ID NO: 5684 - protein, 60 aa, Artificial Sequence
  Synthetic sequence.
SLEEDLRRILKEIRDNVRENIRTNEELLKRSRENVKENIERNKKLLREIEEEVRRLEREV

SEQ ID NO: 5685 - protein, 59 aa, Artificial Sequence
  Synthetic sequence.
EKLAKEVKDRLRDLLRKLNKISEDALRELKRLNDEINRISEEALERLKKLLEDLERRVR

SEQ ID NO: 5686 - protein, 60 aa, Artificial Sequence
  Synthetic sequence.
SLEEKLRKILEESRENVERNIRRNEDILRKSRRNVEENIKTLEKILEDIKRTVDKLKKDV

SEQ ID NO: 5687 - protein, 59 aa, Artificial Sequence
  Synthetic sequence.
EELARKVERELREMNKELNRISEEALKRIEEVNRDINRVSKEVIEELERLVEKIREDVR

SEQ ID NO: 5688 - protein, 60 aa, Artificial Sequence
  Synthetic sequence.
DLERELRKAAKESRENAEKNKEDNKEAAKRSKENAEKNIRDNEETARKIEEDARKLEKDA

SEQ ID NO: 5689 - protein, 59 aa, Artificial Sequence
  Synthetic sequence.
EDLARKALRDLREANKRANEISKKALDEIRKANEDANRASKKANDDLRRLAEKAKRDAE

SEQ ID NO: 5690 - protein, 60 aa, Artificial Sequence
  Synthetic sequence.
DLERELRELLERVRKDVRDNLETNKKLLEESRKNAEDNLRENDRLLKELEKRVKDLLDEL

SEQ ID NO: 5691 - protein, 59 aa, Artificial Sequence
  Synthetic sequence.
EEVVKRVLDDIKRIVDEINRISKEMLDKLKRINDEANKISKRMLDELRRIAEEIEREVR

SEQ ID NO: 5692 - protein, 60 aa, Artificial Sequence
  Synthetic sequence.
DLEERIKKLLEESRKNVEDNEKKNKDSLRRSREEVKRLSDENEKLLKRIRERAEKLKTDL

SEQ ID NO: 5693 - protein, 59 aa, Artificial Sequence
  Synthetic sequence.
KRVVETVLRELERINEEINDISRKMLKENEKILRDIKKINEDMLKRLKEALERVDREVN

SEQ ID NO: 5694 - protein, 60 aa, Artificial Sequence
  Synthetic sequence.
SLEEEIRDILRRAEERVKELTKENERSLRESKKRVEDLSRENEKTLEEIKRDVDRLLKEL

SEQ ID NO: 5695 - protein, 59 aa, Artificial Sequence
  Synthetic sequence.
EDVVREMLKDLERIVREISEDNARTLEENERILREIEEENKKTLERLREILKRIREEVT

SEQ ID NO: 5696 - protein, 60 aa, Artificial Sequence
  Synthetic sequence.
SLEEEIRKILKRIREEVKRLTEENDKTLKDSERNVRENLTEIERILREAADDVRRLEEEL

SEQ ID NO: 5697 - protein, 59 aa, Artificial Sequence
  Synthetic sequence.
EEVVERVLRELERLLEEIRDRNKKTLDDLRRINEEVNRISKDALEELRRLLRELRELVK

SEQ ID NO: 5698 - protein, 60 aa, Artificial Sequence
  Synthetic sequence.
SLEDEIRKILDELRKNVRENLEDNKRVLREAEEEAKKLSEDNRRLLKELKERVKELKDRL

SEQ ID NO: 5699 - protein, 59 aa, Artificial Sequence
  Synthetic sequence.
EEVVRRALEEIERINRDINRRSKEVLDELREIVREAKEDNERTLRKLKKILEEIEEKVR

SEQ ID NO: 5700 - protein, 60 aa, Artificial Sequence
  Synthetic sequence.
RLKEELERILREAEKNVRENLRRNRESLKESKETVDRLSEENKKTLEEVRTTVEELLKEL

SEQ ID NO: 5701 - protein, 59 aa, Artificial Sequence
  Synthetic sequence.
EEVVRDALRKLEEINRRINEISERMLKENKRLLEEIKRINKETLDRLKELLEEIKEDVR

SEQ ID NO: 5702 - protein, 59 aa, Artificial Sequence
  Synthetic sequence.
SDVERVEKELKKTNDELRKIVDEARKLLEKTNKEIRDINRTMMEELRRTNEDLKRVVER

SEQ ID NO: 5703 - protein, 59 aa, Artificial Sequence
  Synthetic sequence.
RRVIERIREIARKNEEDVKKLLKELKDLLEKNKRDVEKASEENKKLLEDNERDVRREST

SEQ ID NO: 5704 - protein, 59 aa, Artificial Sequence
  Synthetic sequence.
KEAEEAAKLLEDTNRRLKEIAEEAEELLRRTNEKAKKINDESREKIKDAARRAEDAARR

SEQ ID NO: 5705 - protein, 59 aa, Artificial Sequence
  Synthetic sequence.
EKAIREIKELAKKNKEDAERALERIKRLADKNREDAKRADEDNERAAEEARRKAEELKR

SEQ ID NO: 5706 - protein, 59 aa, Artificial Sequence
  Synthetic sequence.
DEAEDVERKLEATNKELNEINERSRKELETSNRELNRINTESEEEIRRIEERIDRVKKR

SEQ ID NO: 5707 - protein, 59 aa, Artificial Sequence
  Synthetic sequence.
KELIERIKRLLDKNREDVKRMNEDNKRLLKENRDDVKRMDEKNKKILDEVDEKAKEKEK

SEQ ID NO: 5708 - protein, 60 aa, Artificial Sequence
  Synthetic sequence.
SEEEELKKLLDRVRERVERSLDEIRRLAREVEEHVKKVNDDIRRLLDEIRREVEDIERRV

SEQ ID NO: 5709 - protein, 55 aa, Artificial Sequence
  Synthetic sequence.
DEVRELVRTLEERIDDSTREVKKLIEDLKRENKRILDTVRDLVRRLREKIKRIAD

SEQ ID NO: 5710 - protein, 60 aa, Artificial Sequence
  Synthetic sequence.
DEEERLAELLERVKRDVDRSLKRIRDLLKELEKHAKEVNDDIRRLLEEVERRVREMEKRV

SEQ ID NO: 5711 - protein, 55 aa, Artificial Sequence
  Synthetic sequence.
REVEELIRRMLKRIRDSTKKVEDELRRILEENRRILEEVRREIDELKKAIDEISR

SEQ ID NO: 5712 - protein, 60 aa, Artificial Sequence
  Synthetic sequence.
SEEERLEELLRRIEKHSRELIRELEKSLEDSEREVRKSLKRIEELLRRAERKVREIRKRV

SEQ ID NO: 5713 - protein, 55 aa, Artificial Sequence
  Synthetic sequence.
REVKKVLDDLLKRDRDAIDEARKLNEEMLKRIEDSSREVEKLLADMEKTIEDIEK

SEQ ID NO: 5714 - protein, 60 aa, Artificial Sequence
  Synthetic sequence.
SIDDKARKDLKRILDENRDIVRRVEELIRRSDELLKRILDDVKRRIDELRKKLEDIARKV

SEQ ID NO: 5715 - protein, 59 aa, Artificial Sequence
  Synthetic sequence.
EDVLRDIDRLLKEIKKHAEDSLRKIEKLLRESEEKVKDILRKIKKLLDEARKEVEDRRR

SEQ ID NO: 5716 - protein, 60 aa, Artificial Sequence
  Synthetic sequence.
SIAEEVEELIRRLETKNRKIVKDVEDAIRASDDKNRRVLDKVRKDVERLKRELDRIAKEV

SEQ ID NO: 5717 - protein, 59 aa, Artificial Sequence
  Synthetic sequence.
KEVLDRIKELLKKLEKHVKDSLDKIDDLLRKSEKHVRESLETIKRLLEELEREVERLAR

SEQ ID NO: 5718 - protein, 60 aa, Artificial Sequence
  Synthetic sequence.
DEKREVERLIRELIEENRDIVRRVEKLVRESNKKLDEILEEIRERLERLREKLKDIKRRV

SEQ ID NO: 5719 - protein, 59 aa, Artificial Sequence
  Synthetic sequence.
EEVLRRIRELLERVEKHVRDSLRRIDELLKRSEERVRRIIREVRERLKRLEEEVREAKR

SEQ ID NO: 5720 - protein, 60 aa, Artificial Sequence
  Synthetic sequence.
SISEDAERLVRELLRKNKEIRDRVEELVRRSNDKNRRVLEEVEKRLRDIIRKLEDIERRV

SEQ ID NO: 5721 - protein, 59 aa, Artificial Sequence
  Synthetic sequence.
EEVLRRIRDLLRRVTEHVEKSKRDIEKLLRESRDHVRRSKEKIKRLLDEARERVERSKK

SEQ ID NO: 5722 - protein, 60 aa, Artificial Sequence
  Synthetic sequence.
DEEDKLRKLLEEAREAVKRALERVDKLLRDSEREVRRILEEVKKLLDESRKAVEDIRRKA

SEQ ID NO: 5723 - protein, 56 aa, Artificial Sequence
  Synthetic sequence.
SEEAEELIRRVIRKAEKLLREVEELLRRSNDKLRKLTEKVRTDLERSKKRLEDEAR

SEQ ID NO: 5724 - protein, 60 aa, Artificial Sequence
  Synthetic sequence.
SILEKVRELLERIRDTVRKILREIEKSLEDNKRHSDEVLKEIEDLLRDLERRVKEIEERI

SEQ ID NO: 5725 - protein, 59 aa, Artificial Sequence
  Synthetic sequence.
EEILEEIERLIREVRRRLKKILDDVRELSRRANEKDRKSLEEVRKLVEDVRRELERVAT

SEQ ID NO: 5726 - protein, 60 aa, Artificial Sequence
  Synthetic sequence.
DVEEEVKKLLEDLERHSRKVLEEIKKLLKELEDHNRKTVEDIEELLRELEKEVRKLEEDV

SEQ ID NO: 5727 - protein, 59 aa, Artificial Sequence
  Synthetic sequence.
EEILEEIRRLAEELEKEDRKTLKEARDLAREVKKRNEEIKRRVEELIKKVDRELKEVAR

SEQ ID NO: 5728 - protein, 60 aa, Artificial Sequence
  Synthetic sequence.
DEDEDVRRLLRRLREKVRRVKKKIDDSLRENRKKVRKTNEEVKKLLEDNRRRIEDVKRKR

SEQ ID NO: 5729 - protein, 56 aa, Artificial Sequence
  Synthetic sequence.
SEEARKLMRELEKELKEIEDEVDKMSEEINRKNDEILRRARELIKRNNELLEEIRR

SEQ ID NO: 5730 - protein, 60 aa, Artificial Sequence
  Synthetic sequence.
SEEEEVRKLLERLERTVEKTNRDVERSLRENEKRVRETNDEVRRLLEENRRRIEDVERKL

SEQ ID NO: 5731 - protein, 56 aa, Artificial Sequence
  Synthetic sequence.
SEEAKRLIEELEKRNREVKKEVEEMSRRINKKNEEILREARKLIEENNKLLKDIER

SEQ ID NO: 5732 - protein, 60 aa, Artificial Sequence
  Synthetic sequence.
SELDEIAKAIRRLLEEVRRKNERIDEDIRRLLDELREHSEKVLREIEELLRRLEDAVRKR

SEQ ID NO: 5733 - protein, 59 aa, Artificial Sequence
  Synthetic sequence.
KDARKRAKDVLRDLEKKVEDLKRRNDKTLTDAKRELDDSRRRVKRVLDELEKVLRDLKR

SEQ ID NO: 5734 - protein, 60 aa, Artificial Sequence
  Synthetic sequence.
DEAERILEEVKKLLEEVERLNKKIDDEARRLLREVERENEEIDRDIKRLLDEVRKDVERN

SEQ ID NO: 5735 - protein, 59 aa, Artificial Sequence
  Synthetic sequence.
EEVRRRAEEVLRELEKVVEDSRRRNEKTLRDMERRIKELEDRNRDTLRKLREVVKELER

SEQ ID NO: 5736 - protein, 55 aa, Artificial Sequence
  Synthetic sequence.
SEEERVRELIERMREMLERLEESNKKVLEEIERVLEKSERDVERVIREIERTLEE

SEQ ID NO: 5737 - protein, 56 aa, Artificial Sequence
  Synthetic sequence.
TDRVIREAERVLEEVRRRNEKVNKEARDLLKEVEKHSRDVLEDIKRLLEEIRERAR

SEQ ID NO: 5738 - protein, 56 aa, Artificial Sequence
  Synthetic sequence.
SEKERIEDVIRRIEKVLKESRDEADRVKKEIEKRLRELEKRHKEVTTEVKRVAEEV

SEQ ID NO: 5739 - protein, 56 aa, Artificial Sequence
  Synthetic sequence.
SETVLREAEELLRRVKKHSKEVLDRVRELLKRVEEKSERVLRELERVLREIREKAR

SEQ ID NO: 5740 - protein, 55 aa, Artificial Sequence
  Synthetic sequence.
KDEERIEELLRRNEENLRRLEDSNRKVLRENEEILKELKRRHEKITEDLKRELEK

SEQ ID NO: 5741 - protein, 56 aa, Artificial Sequence
  Synthetic sequence.
TDTVLREATELSKEVHKENRRVNEEAKDLSRRVAEESDRILRELKKLLDEIRKRAK

SEQ ID NO: 5742 - protein, 55 aa, Artificial Sequence
  Synthetic sequence.
SDEERIRRVIEDIERKLRELEKRHKEVTRENKENAKELKERHDRVTKDIKKTLDD

SEQ ID NO: 5743 - protein, 56 aa, Artificial Sequence
  Synthetic sequence.
TDRVLEEIKKLLREVEERSDRALREAKKLSKRVHERSKEVIDRLRELLREIKREAD

SEQ ID NO: 5744 - protein, 59 aa, Artificial Sequence
  Synthetic sequence.
DSAREMERRIRELLKRVEDKSEKALRDSKKLTKEVEEESERALRRTEKLLREVAELARR

SEQ ID NO: 5745 - protein, 56 aa, Artificial Sequence
  Synthetic sequence.
EKRVRDVLREIEEVLRRLEERHERLTRDDERVLRELEDRHRKLSERVKKLLEELKK

SEQ ID NO: 5746 - protein, 59 aa, Artificial Sequence
  Synthetic sequence.
DRAEKAEREIRRLLERVKEDSERVLRESEELTRRVEEESRKILEETKKLTRTLEELSRT

SEQ ID NO: 5747 - protein, 56 aa, Artificial Sequence
  Synthetic sequence.
EERVKRVLEEIERLLRELEERHKRLTERDKEVVKRLADRHREVSEEDRRVLEELKR

SEQ ID NO: 5748 - protein, 59 aa, Artificial Sequence
  Synthetic sequence.
DEMEEVIRRIETLLKRVVDESDKVLEDIKRLLDRVVEESEKALETTRKLLEEVAELART

SEQ ID NO: 5749 - protein, 56 aa, Artificial Sequence
  Synthetic sequence.
EDEVRRVLERVKKVLDELAERHKELSKEIKRELRRLEKEHEDLSEEVKRLLRELER

SEQ ID NO: 5750 - protein, 59 aa, Artificial Sequence
  Synthetic sequence.
DEMREAEEEIKRLLDTVKTESDRVLEEARKLTRRVEEESERVLRETKKLTDELRKLSRK

SEQ ID NO: 5751 - protein, 56 aa, Artificial Sequence
  Synthetic sequence.
EERVRRVLKEIREVLDRLEKRHKKVSKDDKEVLERLEKEHKRLSREDEEVLRELER

SEQ ID NO: 5752 - protein, 59 aa, Artificial Sequence
  Synthetic sequence.
SRMEKVEREIRTLLKEVEERSRKVLDESRKLTEDVERISRDALKKIKELLEEVRDLART

SEQ ID NO: 5753 - protein, 56 aa, Artificial Sequence
  Synthetic sequence.
EKDVRRVLREIEELLKDLERKHKELTRRDEEVLKKLEDDHRRVSEEIEEVLRRLEK

SEQ ID NO: 5754 - protein, 59 aa, Artificial Sequence
  Synthetic sequence.
SRAERVKEEIKKLLEEVRKESKRVLKEVKDLTKEVDDKSKKVMRDIRELLKEVEELART

SEQ ID NO: 5755 - protein, 56 aa, Artificial Sequence
  Synthetic sequence.
AEEVKKVLREIEETLRKLEEEHRRLSDRDREKLDELAKRHKKVSRDIEEKLKELER

SEQ ID NO: 5756 - protein, 57 aa, Artificial Sequence
  Synthetic sequence.
KEVEDVLDKVKKALEEIRERNKRVNDEIRRLLDEVRRRNEDADREIEEILKRVADEV

SEQ ID NO: 5757 - protein, 59 aa, Artificial Sequence
  Synthetic sequence.
EELRERIKAVVEEVERVMDELRRSNEKVVREVEDVMRRLEERNRRTLERIEEVLERLKR

SEQ ID NO: 5758 - protein, 61 aa, Artificial Sequence
  Synthetic sequence.
EEVERLLTKVRELVRRIEEENKKANDDSRKSLKEIKDRVEKALDDSRKSLEEIEKIVRRDN

SEQ ID NO: 5759 - protein, 59 aa, Artificial Sequence
  Synthetic sequence.
EELKRRIETVIKEVRETIEELKKSNEESVRDSERTIRELEEEIKRTVRESEKEIKRLED

SEQ ID NO: 5760 - protein, 59 aa, Artificial Sequence
  Synthetic sequence.
EEVERMADEVRRLNEEVRRRNEESIEEVKRLNDEIRKTNEKSIEDVKELLKRVKEVRER

SEQ ID NO: 5761 - protein, 58 aa, Artificial Sequence
  Synthetic sequence.
DAREKMKRLVEENTKSVEELKKRNEETSRRNTKSVREVTRRNEKTSDDVRRLVREEEQ

SEQ ID NO: 5762 - protein, 59 aa, Artificial Sequence
  Synthetic sequence.
DEVEEAKEKVRRLNKELRRVVKEVEDEVRRLNEEVRREVEKVRDDVRKLRETIREVKAR

SEQ ID NO: 5763 - protein, 58 aa, Artificial Sequence
  Synthetic sequence.
SLEREIEKISRENTKSLRDLLDRLRRLVEENTKSVEELVRRLEELLERVEEEMRRLET

SEQ ID NO: 5764 - protein, 60 aa, Artificial Sequence
  Synthetic sequence.
SRVETMVKDIRRLLEEVKERVERALRDNERVLEDIRRRVDELLKTNEKINRDIERRVRRG

SEQ ID NO: 5765 - protein, 55 aa, Artificial Sequence
  Synthetic sequence.
EEIKEVLRRVEEEAERLKREIEESLKRSEDLVRKLKERIKRSLEESRKRIKKLED

SEQ ID NO: 5766 - protein, 59 aa, Artificial Sequence
  Synthetic sequence.
SEVEEAVKRIRKIVKEIEERVRRLLEENRRVIEEVERINKEMLKRNKEINKEVEELVRR

SEQ ID NO: 5767 - protein, 55 aa, Artificial Sequence
  Synthetic sequence.
KEIEDILRRAEETVEDLKRRIRRSLEDSRRVVEELAEENRKSLRESKKKVDELKK

SEQ ID NO: 5768 - protein, 59 aa, Artificial Sequence
  Synthetic sequence.
SRVEDFVRRIRDLLRKIEEIARKALKENKDVLREIKRINDEMLRRNEEILKRAEDLVRE

SEQ ID NO: 5769 - protein, 55 aa, Artificial Sequence
  Synthetic sequence.
EEIKRILEEAKKTIDELRKEIEKSLREVEKAIRELEERNRRSLERSEDLVRELKR

SEQ ID NO: 5770 - protein, 59 aa, Artificial Sequence
  Synthetic sequence.
RRVEEAVKRIKEILERVTRRVEKVLRDNKRVLDDIRRINEEMLKRNKEINRKVEELVRE

SEQ ID NO: 5771 - protein, 55 aa, Artificial Sequence
  Synthetic sequence.
EKIKEILEEVRRTIEELKERIRKSLEEVKELIKRMDEENRKSLEESDERARRAEK

SEQ ID NO: 5772 - protein, 59 aa, Artificial Sequence
  Synthetic sequence.
SELEEIRERVKRVEEELRKNLKDAERRVREAKRRSEESLKDIEKKVKEVRDELKELARR

SEQ ID NO: 5773 - protein, 58 aa, Artificial Sequence
  Synthetic sequence.
SAREDIKRLLKELEELLKRSEDEARRLLKEVRDLVDTTKKRIDKLLKEIEDLLREIER

SEQ ID NO: 5774 - protein, 60 aa, Artificial Sequence
  Synthetic sequence.
KIEEKVEKLVRELLKELETVDREVNERVKRSNEKLEKIDRDVNKLVEDSNRKLKEISDRV

SEQ ID NO: 5775 - protein, 55 aa, Artificial Sequence
  Synthetic sequence.
EKIKRLLEEVKKLVEDSERNIRELLKESRKKVEDSKRNLDRLLKESDDRVDRERR

SEQ ID NO: 5776 - protein, 60 aa, Artificial Sequence
  Synthetic sequence.
ETEKEVEELVKRVLDKDKRISDESEERIRRLMEKNKKILEDVKRLVDEVREKLEDIRRRV

SEQ ID NO: 5777 - protein, 55 aa, Artificial Sequence
  Synthetic sequence.
EKIKKLLEDVRRLIKRSKEKNDELLEELKRLSEETRETLDRLLKDLEDKIREAKK

SEQ ID NO: 5778 - protein, 59 aa, Artificial Sequence
  Synthetic sequence.
DEKEDVDRLLRELEELVERSERSIRKLLEDNRKLAEDLKRTVEKLLEDNRRKVEEVRRT

SEQ ID NO: 5779 - protein, 56 aa, Artificial Sequence
  Synthetic sequence.
SEELRKLIKRVLKKLRDLNRRVKELSRRSAEELKRLLDEVRKLSEDSLRELDKLRK

SEQ ID NO: 5780 - protein, 59 aa, Artificial Sequence
  Synthetic sequence.
DEEKRVRDLLEEVREEVERSDKSIEELLRELEKAVKDSERTIRKLLEDNERMVREVRRK

SEQ ID NO: 5781 - protein, 56 aa, Artificial Sequence
  Synthetic sequence.
SKEAEDLIREILEELKRLNEDVKRLIREVLETLKELNERVKKLVKESNDELRELAR

SEQ ID NO: 5782 - protein, 59 aa, Artificial Sequence
  Synthetic sequence.
REEEKLDKLRKDLEKRVEESKRSIDKLLEDNRRRVEESKKTIEKLLEDNKRRVDEIKKR

SEQ ID NO: 5783 - protein, 56 aa, Artificial Sequence
  Synthetic sequence.
SDEAEKLIRDVKKELDRLNEEVKKLSEDSLKELDDLNREVKELMERSNRKLDEDAK

SEQ ID NO: 5784 - protein, 59 aa, Artificial Sequence
  Synthetic sequence.
KEVEDVLREIKKLIKEIHEKSKRALDETRELLERIHRTTRRVLEEIRRLLKEVEELAKA

SEQ ID NO: 5785 - protein, 56 aa, Artificial Sequence
  Synthetic sequence.
KDRVEDLVRELERVVKEDKDRSKESEERIKKLVEDDTREAEKLIRELEKILEDTEK

SEQ ID NO: 5786 - protein, 59 aa, Artificial Sequence
  Synthetic sequence.
SEVEEVLRDIDRLAKEIHKRSRDVLRDIDRLLKEIHERSRRMLERIKRLLDEVRRLVEA

SEQ ID NO: 5787 - protein, 56 aa, Artificial Sequence
  Synthetic sequence.
RDRLRELVERLERLLETDKREIEKLIKKLEEMLEEDERRARELLEDIRRILEEIKK

SEQ ID NO: 5788 - protein, 59 aa, Artificial Sequence
  Synthetic sequence.
SEVEEVTKEIKRLVEEIHKRSREALEETRRLVETIHRDSKRVLDEIERLLEEVRKLAED

SEQ ID NO: 5789 - protein, 56 aa, Artificial Sequence
  Synthetic sequence.
EKRVRDLLEKLREDAKRDEDASRKSEEDIRKVVEEDKREAEKLLKRIEDELRKTEK

SEQ ID NO: 5790 - protein, 59 aa, Artificial Sequence
  Synthetic sequence.
SEVEKVLKDIRDLVKKIHDESKRVLDEIEELVRRINKRSRDALREIRELLRTVTELAKA

SEQ ID NO: 5791 - protein, 56 aa, Artificial Sequence
  Synthetic sequence.
KDRVRKLVEDLERMLRRDEAEAEKLIKKLRELLEKDRDDIRRLLEDIKRILDEIRK

SEQ ID NO: 5792 - protein, 59 aa, Artificial Sequence
  Synthetic sequence.
EEVERALDRARRLLERIHETSRDVLRRTEELLRRINEESRRVLKEAKELLDRVEKLVRD

SEQ ID NO: 5793 - protein, 56 aa, Artificial Sequence
  Synthetic sequence.
KDRVEKLERELEKVVREDEEESKKSIRRAEEMLRKDREDIRRLLEEIKKILEDIDK

SEQ ID NO: 5794 - protein, 59 aa, Artificial Sequence
  Synthetic sequence.
SEVEDVLRKAEELAKRIHDRSRKALKETEELLERINRDSERVLRESEKLLEDVRRLAEA

SEQ ID NO: 5795 - protein, 56 aa, Artificial Sequence
  Synthetic sequence.
EKTVRRLVDKLRRLVEEDTDESRKSEERIKKMVEDDKRESEKSLKRIKDIMKEITD

SEQ ID NO: 5796 - protein, 57 aa, Artificial Sequence
  Synthetic sequence.
SEVERVLEENERTLKRIEETAKKVLEEIEKLSKEVEDRAREVLDRVRRISEEVRRDV

SEQ ID NO: 5797 - protein, 59 aa, Artificial Sequence
  Synthetic sequence.
EEMRDRVRKLIKRNDEVLDRVRREIEKLHRRNKKILDDLRREIERLNRENKRLLDELRK

SEQ ID NO: 5798 - protein, 57 aa, Artificial Sequence
  Synthetic sequence.
SEVEEVLKRNEKTLKEIEERAREVEETVRELSERIRKRNEEVNRELEERSKRIRRDV

SEQ ID NO: 5799 - protein, 59 aa, Artificial Sequence
  Synthetic sequence.
KEARDRADELLKRNREVLERLRKRIEDLHRDNKRVLDELRRSNEETNRRNRKLLEELRK

SEQ ID NO: 5800 - protein, 57 aa, Artificial Sequence
  Synthetic sequence.
REVEEVLKENEKTLREIERRMEEVLKRVEDLSDEVRRRVDEVLRRVEETSKEIAKRV

SEQ ID NO: 5801 - protein, 59 aa, Artificial Sequence
  Synthetic sequence.
EEARKRAKDVLDRNRDVLRRLKDAIDKLNKRNKEILDRLRRKIEDLNRRNEELLRRLEK

SEQ ID NO: 5802 - protein, 57 aa, Artificial Sequence
  Synthetic sequence.
REVEEVLDKNRKTLREIRKRAKEVLDRVEELSRRVREENERVNRELRKISEEIARKV

SEQ ID NO: 5803 - protein, 59 aa, Artificial Sequence
  Synthetic sequence.
EEMKKEADKLLKENRDVLRELERRIEELNERNRRVLKELEESNRRTNEENKRLLDELRR

SEQ ID NO: 5804 - protein, 57 aa, Artificial Sequence
  Synthetic sequence.
DEVETVLDENRRTLKRIRERVDKVLKDVEKLSREVEDEIRRVLEEVEKELKDIERDV

SEQ ID NO: 5805 - protein, 59 aa, Artificial Sequence
  Synthetic sequence.
EDAREKAKRLLEENKRVLKELEERVKRLNDKNRRILERIKKRIEDLRRRVKELLKKLRK

SEQ ID NO: 5806 - protein, 57 aa, Artificial Sequence
  Synthetic sequence.
DEVERVLEENERTLRRVREIIREVLEEVRRLSEEVKRRIDEVLKENEDTLKKIKDEV

SEQ ID NO: 5807 - protein, 59 aa, Artificial Sequence
  Synthetic sequence.
KKARDRVREVEKRNRDVLEEVKDEIRKVNKDNRDILRRIKKDVEELLKRNEKVLRETEK

SEQ ID NO: 5808 - protein, 57 aa, Artificial Sequence
  Synthetic sequence.
RELEELLKRNERTLRELAKRVKRLLEENKETVRRIEERLRRVLTEVEKISRDIRDRV

SEQ ID NO: 5809 - protein, 59 aa, Artificial Sequence
  Synthetic sequence.
EEVRERVKKVEDENRKLLERAEREIKKVAEENRRLMEKMKDDVRKANKRNKELLERRTK

SEQ ID NO: 5810 - protein, 57 aa, Artificial Sequence
  Synthetic sequence.
SEVEKVLRENEKTLREIEREIDRVLRDNERTLKEVRERNEEVNRRVEEDSKRVKDEV

SEQ ID NO: 5811 - protein, 59 aa, Artificial Sequence
  Synthetic sequence.
EKARERIKRILDENRKVLREIERKIREVLERNKKVLEEVRKSNEETNDRNRKLLEELRR

SEQ ID NO: 5812 - protein, 60 aa, Artificial Sequence
  Synthetic sequence.
SVDERVEDLRRDVERVLRELRKSNEESIRRSEEIVTRLEEELKRNSKEVEEVLKRLEDEL

SEQ ID NO: 5813 - protein, 59 aa, Artificial Sequence
  Synthetic sequence.
SKDLEKALRDVEKLIREIRERNKEMLRRSEEILKEIEKRARDMSRESKRLIEDIERRTK

SEQ ID NO: 5814 - protein, 60 aa, Artificial Sequence
  Synthetic sequence.
SVEEKVDRLKRRVEEVLKELKKSNEDNTREVREALKRLKKAIEESIDRSRKILEDLRRKL

SEQ ID NO: 5815 - protein, 59 aa, Artificial Sequence
  Synthetic sequence.
DEDLERALKEVEELIRRIREENKEMSERSKKIIRKIEKDVKKALDDSERVLREIAERTK

SEQ ID NO: 5816 - protein, 60 aa, Artificial Sequence
  Synthetic sequence.
DVEKKVKELLDEVRDALRRLRKSNKDNTDEVDRALRELEETNKKSIEDSRRIVEDLKRKL

SEQ ID NO: 5817 - protein, 59 aa, Artificial Sequence
  Synthetic sequence.
DREADKVLKRVKEEIERIERENRRMSEKSERLIREIRKRNKEMLDRSKKLLEDIKRRVT

SEQ ID NO: 5818 - protein, 60 aa, Artificial Sequence
  Synthetic sequence.
KEVEEILTESEDMNRKIDKLVKEILDESEEMNRRIRELVKRIVEELRELLREIRRLAEER

SEQ ID NO: 5819 - protein, 59 aa, Artificial Sequence
  Synthetic sequence.
EEVRDRLRRSHEKNKEVLDRIRKRVKESHEKNEKSLREIEETVKKLERDVERLLREIKR

SEQ ID NO: 5820 - protein, 60 aa, Artificial Sequence
  Synthetic sequence.
EEVERILKESRDANERIKKLVEDILRRSKELNERIRDEVRKILAKSEEVNRRIRRLAKER

SEQ ID NO: 5821 - protein, 59 aa, Artificial Sequence
  Synthetic sequence.
EEVKEKAKESHKENKKVLDRIKRELEKSHEENKKSLDEIRDRVRRSHEKNRKVLEEIRK

SEQ ID NO: 5822 - protein, 60 aa, Artificial Sequence
  Synthetic sequence.
EEVERILKESEDMNRRIRDLVRRIAEESDKVNREIRKLVDEIRRKLDRVLREIEDLIRKR

SEQ ID NO: 5823 - protein, 59 aa, Artificial Sequence
  Synthetic sequence.
EEVKKRAEKSHRENEKSLREIRKELEELHRKNKKSLEEIRKTLRKLEEKVRKLLEDLRR

SEQ ID NO: 5824 - protein, 60 aa, Artificial Sequence
  Synthetic sequence.
SRVEEILRESKRMNDEIREKVKKILKTSRDMNKRIEDRVREILKKSEDLNRKIRKLIDDR

SEQ ID NO: 5825 - protein, 59 aa, Artificial Sequence
  Synthetic sequence.
EEAKRELEKSHKTNEKVLRDIERRVEDSNRENEDSLRKIERAVTESHRRNEEVLERLER

SEQ ID NO: 5826 - protein, 60 aa, Artificial Sequence
  Synthetic sequence.
EEVERILEESKRLNDEIRRKVDEILRKSEEINERVRRLVEKIRTDLERVLEEIRDLADKR

SEQ ID NO: 5827 - protein, 59 aa, Artificial Sequence
  Synthetic sequence.
EEVKRRLEESHKDNDRVLKEIERRVRESLRRNRESLRRIDEKVKELERRVEKLLREIKK

SEQ ID NO: 5828 - protein, 60 aa, Artificial Sequence
  Synthetic sequence.
EEVERILDESKKMNDDIRRKVKEILDESEKLNEDIRRLVKEILEKSKRVNDRIRKLAKDR

SEQ ID NO: 5829 - protein, 59 aa, Artificial Sequence
  Synthetic sequence.
DEVRRRAEKSVRENDKSLKEIEDEVRRSVEKNEESLKRIEDEVRKSHEKNKKVLDEIKK

SEQ ID NO: 5830 - protein, 61 aa, Artificial Sequence
  Synthetic sequence.
SKAEEVLKEIRERIERIRKRAEDVLRHDEESLKRAEEVNRKMEKESRRINEEIRDRVRKEG

SEQ ID NO: 5831 - protein, 56 aa, Artificial Sequence
  Synthetic sequence.
EKDVRKVEDDIRRVIKKLKEELDRSADKSRDVVRRLRDSNKKLNDKNRRDIEEIKK

SEQ ID NO: 5832 - protein, 61 aa, Artificial Sequence
  Synthetic sequence.
DSEEEVRERIRKIIEDVKRIIEEVLRRDDKILKEIEKRNRDMLKRSKEINKEARDRVREAG

SEQ ID NO: 5833 - protein, 56 aa, Artificial Sequence
  Synthetic sequence.
DRSVRELERRIKEVIDELRELVERSKRKVDKLLKDLTRSNEKVNRENREDLERLEK

SEQ ID NO: 5834 - protein, 59 aa, Artificial Sequence
  Synthetic sequence.
DDERRAKKAAEDAAKRLKEIAEKAHRISEKALEELKRINDDANKISEDALRRLEKLKKE

SEQ ID NO: 5835 - protein, 56 aa, Artificial Sequence
  Synthetic sequence.
SEEAKELAKKIKEIADEARKRAEDNARTNKEAAERSKENADRNAEENKKAAEKAKR

SEQ ID NO: 5836 - protein, 59 aa, Artificial Sequence
  Synthetic sequence.
KDEDEVRRRVEELLKRNKELVEEIHKLSEDALRDLERINEEVNRISDEMRRRLDKLKKD

SEQ ID NO: 5837 - protein, 56 aa, Artificial Sequence
  Synthetic sequence.
SEEAKKLKERVDRSLKESEKEVRENLERNRKLLDESRRNAEENLRENKRVLDELRR

SEQ ID NO: 5838 - protein, 59 aa, Artificial Sequence
  Synthetic sequence.
SEEDEVRERVKRVLDELRKINEDLNRISREMLERNKDILRRIHEISKRALDKLKKLKED

SEQ ID NO: 5839 - protein, 56 aa, Artificial Sequence
  Synthetic sequence.
SEEVRKLLEEVKDSLRKSEENARRNLDENRRSLKKSEDEVRRNLEENEDTLRKLEK

SEQ ID NO: 5840 - protein, 59 aa, Artificial Sequence
  Synthetic sequence.
DEMDEVRRTIKKLDKDSRDKVRTVEEKIRRLDEESRRENEEIVRKIEELLEEIERRVRS

SEQ ID NO: 5841 - protein, 56 aa, Artificial Sequence
  Synthetic sequence.
EKEVKKIKEESDESLKEIEKLLREIEEESKRSLREMEKTLEDIERRVRRVLEEIKR

SEQ ID NO: 5842 - protein, 60 aa, Artificial Sequence
  Synthetic sequence.
SIEELAKRNEEENEKAAEDVERLAEEVKERAERVARESEKLAREAEKEAERVAREIRRDR

SEQ ID NO: 5843 - protein, 59 aa, Artificial Sequence
  Synthetic sequence.
EEAAKRASEENRKAVRDAREKARRAAEEAKKLLDEARKHSEEAAKRAKELLEEAKKRAD

SEQ ID NO: 5844 - protein, 60 aa, Artificial Sequence
  Synthetic sequence.
KIEELMKRNEKENREVLERVKELADRNRRENEEVVKKSKKELDDLKRKIEEVLERIKRER

SEQ ID NO: 5845 - protein, 59 aa, Artificial Sequence
  Synthetic sequence.
EEVVEKVSRENKKLVADIEDEVRRASTRNKKLVKDIEKHSEDVVRELEKLLKDIKDKVD

SEQ ID NO: 5846 - protein, 60 aa, Artificial Sequence
  Synthetic sequence.
SIEDEARRNEKRNREVLKRSKDLLDEIARKIEEVEKRIRDLVKRVKEEIDEVLRRIKRER

SEQ ID NO: 5847 - protein, 59 aa, Artificial Sequence
  Synthetic sequence.
DELLRRVSKENEDLVREIEDHTRRVLETIERKLRRVEEKVETVVREIKRRLEDIERRVK

SEQ ID NO: 5848 - protein, 59 aa, Artificial Sequence
  Synthetic sequence.
EEVDRVIERIKRLLEEVERKIRRASEKNRRLIEKSRKELEKVSKENKDLIDRVRELRDA

SEQ ID NO: 5849 - protein, 55 aa, Artificial Sequence
  Synthetic sequence.
EKVKTVEKEIREVIERADEIIERNERENKKSVEEIEEILERNKRRNEEALREVDK

SEQ ID NO: 5850 - protein, 57 aa, Artificial Sequence
  Synthetic sequence.
DELDRAIEEVKRLLDEIRRRLEKVVREVRKLNEEIREDLRRVVEEVRRTNKEIRDRV

SEQ ID NO: 5851 - protein, 56 aa, Artificial Sequence
  Synthetic sequence.
SDKVRRLEREVEELLKTVEELIRRLEEHTRRVLKEVDEEIKRLKEHTEKVLRDVEK

SEQ ID NO: 5852 - protein, 59 aa, Artificial Sequence
  Synthetic sequence.
SAEELVKELERRIEELLKELEEIVRRNRKHSEDVLRKIKELVRDVLRRVKEALKDLTKK

SEQ ID NO: 5853 - protein, 59 aa, Artificial Sequence
  Synthetic sequence.
EDVVRKLIKEIDDRLKEVKKEVEKLSDENRRLNEDVERRIKELLDDIERLLKEIRDTVT

SEQ ID NO: 5854 - protein, 59 aa, Artificial Sequence
  Synthetic sequence.
DVEDIVRRIRERVKEALERLRKTNDDNRKHSEEVLRKLAESDKRTMERIERVLEELRRR

SEQ ID NO: 5855 - protein, 59 aa, Artificial Sequence
  Synthetic sequence.
KEVVREMKRKIEELLKRIEDENKRLSDENRELNKRVEEDNRRLNKEIEDELRKVEEDVK

SEQ ID NO: 5856 - protein, 59 aa, Artificial Sequence
  Synthetic sequence.
DLEELVKELEKRIEDVLRTLRKTNKDNEKAVEESLRKLEDELRKLKEKIDRLLDKLTKE

SEQ ID NO: 5857 - protein, 59 aa, Artificial Sequence
  Synthetic sequence.
EEVVRRIIEDIRRLLEEVKKVNEDLSEENERLNRDAERRVREAIKEVEDLLDEIEKTVR

SEQ ID NO: 5858 - protein, 59 aa, Artificial Sequence
  Synthetic sequence.
SVEDELRKLEEKIRRLLEELRRTNDENRRHSEKVLEELRRELEKLKRRIEELLRKLREE

SEQ ID NO: 5859 - protein, 59 aa, Artificial Sequence
  Synthetic sequence.
EEVVERLIRDVERKLREVKKENDRASKENEDLNREVKRRAEKLLRDVERLLREVEKTVK

SEQ ID NO: 5860 - protein, 59 aa, Artificial Sequence
  Synthetic sequence.
SAEDRLRELEERIRRALKELEDTNRRNEEHSKKLLEELARSDRETEEEIKEALKRLTER

SEQ ID NO: 5861 - protein, 59 aa, Artificial Sequence
  Synthetic sequence.
EEVVDRLIREVEERLRDVRRLNEELSKRNKELNDRVREVNEELNRRIKKRLEEIKRRVE

SEQ ID NO: 5862 - protein, 59 aa, Artificial Sequence
  Synthetic sequence.
SLEDLVRTIREEIERLMKEAEDTNRRNKEESEESLRRLKKLVEDIDREVKEVLDRAEKN

SEQ ID NO: 5863 - protein, 59 aa, Artificial Sequence
  Synthetic sequence.
EKVVEELIRRIKDELKKIRERNKELSDRDKKLNEDVEREVRKLIDEIRKKLEDVERTVK

SEQ ID NO: 5864 - protein, 60 aa, Artificial Sequence
  Synthetic sequence.
REVDKVREDVKRLIKEIEDRVRKVLKEDEDLIRELRERVKKVSKENKEVVKTLRELVRDL

SEQ ID NO: 5865 - protein, 55 aa, Artificial Sequence
  Synthetic sequence.
ELVKELEKRIREVLERLRRLIERSKEEIDRVLREVEEDVRRNKEENKRLLEEAER

SEQ ID NO: 5866 - protein, 59 aa, Artificial Sequence
  Synthetic sequence.
DEKDKVRKTVEDILREIEKIVEDLVRRNERVDREIRERVRELLRRDDEILKRMEEVKRR

SEQ ID NO: 5867 - protein, 56 aa, Artificial Sequence
  Synthetic sequence.
EREVTKLKEDIDRLLEKLERDLDELRKRNDELLKELEDRVRKSKEKVEKILRDVRR

SEQ ID NO: 5868 - protein, 60 aa, Artificial Sequence
  Synthetic sequence.
SIEDKLRELKERHKELSKRIKEELERLTEEHRRVSEKIRKSLEEDKRRADKVLERIRRER

SEQ ID NO: 5869 - protein, 59 aa, Artificial Sequence
  Synthetic sequence.
EDVLRKVEEDSREVLKDSKRLLDEVATRSEEMLRRSEELLKRIHETSKKVLDEIKTKLK

SEQ ID NO: 5870 - protein, 60 aa, Artificial Sequence
  Synthetic sequence.
SIEDLARDLERRHKELSEDDKRKLDELRKRHKDVSDEARRSLERDERRVEKVEREITKRR

SEQ ID NO: 5871 - protein, 59 aa, Artificial Sequence
  Synthetic sequence.
EKVLDDVRRRSDKMLEDSRRLTREVEETSKEMLERSRRLLEEIHKESDRVLREARERDR

SEQ ID NO: 5872 - protein, 56 aa, Artificial Sequence
  Synthetic sequence.
RIEDILRRLEEHHRRLDKENKEILERLKKHHEEVLRKIKEILERLEREARDIERKI

SEQ ID NO: 5873 - protein, 59 aa, Artificial Sequence
  Synthetic sequence.
DEVVEKVVREVEDTNEKIRRRSDEVRKEVEDTNRRIDKRLKEVEEEVRRLLDEVRKESE

SEQ ID NO: 5874 - protein, 60 aa, Artificial Sequence
  Synthetic sequence.
SELEDVAKKAEDLLTKSAEILKEVVDRHRRLNERSEDEARRVEEEHRRTNKKLLDLARRG

SEQ ID NO: 5875 - protein, 56 aa, Artificial Sequence
  Synthetic sequence.
SEELRKLKKRIEDISREHERILRELREHVERVSDKHRKILKELEEDVERILREVTK

SEQ ID NO: 5876 - protein, 60 aa, Artificial Sequence
  Synthetic sequence.
SEIEKVVEDIKRLLEESKDRLRKAEEEVRDLSRRSREKLRRAEEDIKRLLDEIERMLRAG

SEQ ID NO: 5877 - protein, 56 aa, Artificial Sequence
  Synthetic sequence.
SDELRKLAEEIERVSEEHKRILDELRDHLRKNTKDVRDILRELEKEAERLLRELRR

SEQ ID NO: 5878 - protein, 60 aa, Artificial Sequence
  Synthetic sequence.
KDVEDVLKRVKDVNREVEKRLEKVIRDDEKINEEINRRLDEMAERVKRVNETVEDIARKE

SEQ ID NO: 5879 - protein, 56 aa, Artificial Sequence
  Synthetic sequence.
EKLVEELRRESDTSKKRVEKLIRELKEKNKRSEERARRIIEKLKKESKDSLKRVKD

SEQ ID NO: 5880 - protein, 56 aa, Artificial Sequence
  Synthetic sequence.
EEKEILDELEKEVRDLNRKNKEILRRLEETARDLHRRNEEILDRIRKRVEELKRRV

SEQ ID NO: 5881 - protein, 56 aa, Artificial Sequence
  Synthetic sequence.
KDTVAKEAKRLIRDLERLSREIEERVRRLIEEVKEESERIRERVTRLIKEVEDRRK

SEQ ID NO: 5882 - protein, 56 aa, Artificial Sequence
  Synthetic sequence.
DDEEILKELEERVKKLHEKNKRILEKLKREVERLNDENRRILKEVKEDVDRLLKEV

SEQ ID NO: 5883 - protein, 56 aa, Artificial Sequence
  Synthetic sequence.
SETVARRVEEMIKEVEELSKEIEERAKRLIDRLRELSKRILEELKRLLEEVREKRR

SEQ ID NO: 5884 - protein, 59 aa, Artificial Sequence
  Synthetic sequence.
REEDEVLEDARRLSEESRKKLREVERRAKELSDRSRKRLRDVKRRVDDALRKIEDLRRR

SEQ ID NO: 5885 - protein, 56 aa, Artificial Sequence
  Synthetic sequence.
SEKLRELEEEIRRNSKDVKEVMKELDKHIKRNSEEVDKVLKELEERLKRLLDRVRK

SEQ ID NO: 5886 - protein, 59 aa, Artificial Sequence
  Synthetic sequence.
SDEDRVKDKAEELSRRSREELERVKEEAKRLSDESKKRLEEVTRRIEKVLREIRELRER

SEQ ID NO: 5887 - protein, 56 aa, Artificial Sequence
  Synthetic sequence.
SEKLRRLREEIKKNSDEVKKVLRRLEENLRDNTRRVREVLERLEDEARKLLKDVKK

SEQ ID NO: 5888 - protein, 59 aa, Artificial Sequence
  Synthetic sequence.
SEVDDVLRRLKELSERSEKTLEDIRDEAEKLSKESEDLLREVLRRSEKVNEDIRRLREK

SEQ ID NO: 5889 - protein, 56 aa, Artificial Sequence
  Synthetic sequence.
SRRLEKLRREIEDNSRRVREVLKRLKENIKRNTDRVREALKRLEREHEEVLREVET

SEQ ID NO: 5890 - protein, 60 aa, Artificial Sequence
  Synthetic sequence.
SIEEAITRLRKEVEDSNKRSEDVIRELHERDKESLEEVREIIKRLKDKVRTLLEEVDKRV

SEQ ID NO: 5891 - protein, 59 aa, Artificial Sequence
  Synthetic sequence.
EEILKEVLKRLRKLLEDNERVLDEARRRVEKTNEEIKEVLKRVAEEVDRLIKEVREEVE

SEQ ID NO: 5892 - protein, 59 aa, Artificial Sequence
  Synthetic sequence.
SIDEIIEELRRRIEELRKEAEKIIRDSKKHLEDNKRDADRVIKESKEEVDKLLKEIEEA

SEQ ID NO: 5893 - protein, 59 aa, Artificial Sequence
  Synthetic sequence.
EELLEEVRKRIEDLLRELRDILRKLLERDKRLSKESERLVREMLREDRRLLDELRKEVK

SEQ ID NO: 5894 - protein, 59 aa, Artificial Sequence
  Synthetic sequence.
SIEEIIRDLRRHIKENAEEAEKVIKESEDHLRENKKRAEDVIRRLEEELRKLAERVRRA

SEQ ID NO: 5895 - protein, 59 aa, Artificial Sequence
  Synthetic sequence.
EELLKRAVDAVRKLSEDSKRLVEEALRRDEELSKRSRDLVEEVRRRAEELLRRIEETVK

SEQ ID NO: 5896 - protein, 59 aa, Artificial Sequence
  Synthetic sequence.
SSKDDVRRRMKEINERDKRLLDEVLRRLEKLIEELKRHTEEVERDADRIIEEIERMLRN

SEQ ID NO: 5897 - protein, 55 aa, Artificial Sequence
  Synthetic sequence.
ERIIKEIRDLIRENEERNKEIVRRIEELLRELEKRSRDVIKRIREKLDRLRKRVE

SEQ ID NO: 5898 - protein, 57 aa, Artificial Sequence
  Synthetic sequence.
SKVEEIERRIREEVTRSEKEDRDNVREIRKLVEELRRESKRILDESRRLVKRLIDEA

SEQ ID NO: 5899 - protein, 59 aa, Artificial Sequence
  Synthetic sequence.
DEILKRIEEEVRKILEDSRRSTEESHEKVRRIITKIRKLLEDDERRNRKVVREAEEAMR

SEQ ID NO: 5900 - protein, 57 aa, Artificial Sequence
  Synthetic sequence.
SKLEELLRRAREVARRLKEELERILKEVEDRVRKSEKEDEDNVKRITDEMRKLKERV

SEQ ID NO: 5901 - protein, 59 aa, Artificial Sequence
  Synthetic sequence.
DRVIKRIEEDVRRVIEEIKRLLRELEEEIRRILDESRESTERSHRTARKIVEEVERAAK

SEQ ID NO: 5902 - protein, 59 aa, Artificial Sequence
  Synthetic sequence.
SKMETIERRVEEAIRESEELNERDEERVKKVIDELKKLIDDIRRRLEEALRELKKVTDD

SEQ ID NO: 5903 - protein, 55 aa, Artificial Sequence
  Synthetic sequence.
EEILKKVRELIEETKRRTDDLHKKVKERVDDIKRRLDELLEEAKRALDEIRERVK

SEQ ID NO: 5904 - protein, 60 aa, Artificial Sequence
  Synthetic sequence.
SAVEEIKRRLEEIIRDLERLIDDDRKRVEEMVKRIEDLIKKDEEDVREALKKLEEVVTRG

SEQ ID NO: 5905 - protein, 55 aa, Artificial Sequence
  Synthetic sequence.
EEILERADRLVKEIKEKLDRLVKTSEELIRRLEEELRRLHEKVKELMKRAEEKVR

SEQ ID NO: 5906 - protein, 60 aa, Artificial Sequence
  Synthetic sequence.
SREDVLREIRRLVEETKKENEKILERLRRLVRTVERRNDEVVKKVRTLVKRLEEEIDKTV

SEQ ID NO: 5907 - protein, 56 aa, Artificial Sequence
  Synthetic sequence.
LDELLRKLKEDLDRSKEELKEIEKRVRELLERNKRKTEEVEKEVKRDLDDIRRKLK

SEQ ID NO: 5908 - protein, 60 aa, Artificial Sequence
  Synthetic sequence.
SEKEALDEVRKRVEDVRRDNKRILEESERLNRESRKRNRDILERLRKEAEDLKREIDETV

SEQ ID NO: 5909 - protein, 56 aa, Artificial Sequence
  Synthetic sequence.
LDKLLEDLERLLKENLDRLRKILEEDRRLNKENNDKLKEIEKRVRELLKDIKDKLK

SEQ ID NO: 5910 - protein, 60 aa, Artificial Sequence
  Synthetic sequence.
KEVEDVLRKIRDLVRKNLEDAERVVEEAKRLIDENRERLREVLREDEELNREILKRLREL

SEQ ID NO: 5911 - protein, 56 aa, Artificial Sequence
  Synthetic sequence.
EEALKEVRRLIDELRKANKRILEEIRDLVRRLREENEEILRRLKRKNERTADEIRK

SEQ ID NO: 5912 - protein, 60 aa, Artificial Sequence
  Synthetic sequence.
SEVEDVLRRIRELLEEIKRRLEDVRRRIKELLDRNRRESEDVLRRDKELNDEVRDKLRKR

SEQ ID NO: 5913 - protein, 56 aa, Artificial Sequence
  Synthetic sequence.
ERMLKTVEDLVREVSKEVRRILEELRDEVRKSEEENRRILDKLEKENRKTAEDVKR

SEQ ID NO: 5914 - protein, 60 aa, Artificial Sequence
  Synthetic sequence.
SEVEEVLRRIKELLDRNREELKKVRERIKRLLDRNREKSEEVRERDKRLNDEIKKRLDED

SEQ ID NO: 5915 - protein, 56 aa, Artificial Sequence
  Synthetic sequence.
KRVLEEARRLVKKSEEDNRRILKELRELVKESERENEEILRELKKLNEDTKKRIED

SEQ ID NO: 5916 - protein, 58 aa, Artificial Sequence
  Synthetic sequence.
DEVEEVLRKIEELIRENIKRAREVLEEDKRLNERNKRESEKVLEEDERLNREIEKELR

SEQ ID NO: 5917 - protein, 56 aa, Artificial Sequence
  Synthetic sequence.
EEVLRRIKKLIEESMEDNERILRDAERLNRESKERNERILKRLKKRNDETRKEVEK

SEQ ID NO: 5918 - protein, 59 aa, Artificial Sequence
  Synthetic sequence.
SSAEEVKERSKRINEEIEKTLEKMLRESRRTNEEIKKTLKRLAEEAEKLLRDVERLVRA

SEQ ID NO: 5919 - protein, 56 aa, Artificial Sequence
  Synthetic sequence.
EDIIREIRELNKRTRDKIEEIIERIRKLNKETRDRIRKIMREIEKKIRDLAEEIRR

SEQ ID NO: 5920 - protein, 59 aa, Artificial Sequence
  Synthetic sequence.
KSMEEARKKSKEINDRILDRLKKVLEESRKINKDIKDTVERLRERSEDINRRIKELVDS

SEQ ID NO: 5921 - protein, 56 aa, Artificial Sequence
  Synthetic sequence.
EEIIKEIRKLNEETRKEIERIAREAEELNKRTADKIETIIREIEKLNKKLKDDIEK

SEQ ID NO: 5922 - protein, 60 aa, Artificial Sequence
  Synthetic sequence.
DEVRELVKEIEELIERIERTLRKMTKDSRDLNRKINEKLKKVLEDSRRLNEEIKRTIDSN

SEQ ID NO: 5923 - protein, 56 aa, Artificial Sequence
  Synthetic sequence.
ESILRRLEKLLEELRKRVEDIIRELEKLNKESREEIDKIIREAERLTEETERRARK

SEQ ID NO: 5924 - protein, 60 aa, Artificial Sequence
  Synthetic sequence.
DEMEELLERIRRLIREIDERLKEMLKRSRELNRELNERNKDVLRRIKELIDRIRRLIERD

SEQ ID NO: 5925 - protein, 56 aa, Artificial Sequence
  Synthetic sequence.
ERILRELKKLVDDLRRRIKKILDESKELLERSEKKADESNKELRKLVEELRKEADD

SEQ ID NO: 5926 - protein, 60 aa, Artificial Sequence
  Synthetic sequence.
SRVEEIERRIRELIKRIEDRNRKMLETSRRLNEDINRRLRELLERIRKLIEEIEELIKRD

SEQ ID NO: 5927 - protein, 56 aa, Artificial Sequence
  Synthetic sequence.
EKILRDLEELLKELARRLERSNEESRRLLEDSRRKMEKIIRELEKLLDDLRRKIEK

SEQ ID NO: 5928 - protein, 60 aa, Artificial Sequence
  Synthetic sequence.
DEKEIDEEIERLVRDSKRRSRKVLRDIEELAKRVKEENDRVLEKLRKLIEDLKRKIDETI

SEQ ID NO: 5929 - protein, 55 aa, Artificial Sequence
  Synthetic sequence.
ERLKEEVDRVIADSRRLNKEILDEVKRELDKLRKHLEDVLRRAEKMIRDIDEELR

SEQ ID NO: 5930 - protein, 59 aa, Artificial Sequence
  Synthetic sequence.
SEVDKVREDVERLSARSEEKVREVLERVKRLLDKSKRDNEDVKRRVRELAERLRDLRRK

SEQ ID NO: 5931 - protein, 56 aa, Artificial Sequence
  Synthetic sequence.
KEVLDRIRRRIEENSKKIDDMVKKVRTLVKRSEEESERVLKELRDLMRDVERRIRE

SEQ ID NO: 5932 - protein, 60 aa, Artificial Sequence
  Synthetic sequence.
SEVERVEKEIRDLSRKSNEDLKRILDEARELSKKSNEDTKRVLKETRDLLKEIADRLREV

SEQ ID NO: 5933 - protein, 55 aa, Artificial Sequence
  Synthetic sequence.
EEVKKRVEESLRENEKLLRTIAKEIEDLVRENRKVNEDVNREVEKLVRELEERIK

SEQ ID NO: 5934 - protein, 61 aa, Artificial Sequence
  Synthetic sequence.
REVEELLKRIRELVKRNNEKTKRLLDESRRLNEEANRRLDKVLKELRDLAKRIKEELDEKG

SEQ ID NO: 5935 - protein, 55 aa, Artificial Sequence
  Synthetic sequence.
EDLEREVKKLLDENRESSERVIRESEKSLRDHAERTRKVREEIRKLLEELKRAVE

SEQ ID NO: 5936 - protein, 56 aa, Artificial Sequence
  Synthetic sequence.
SEKEDIKRKLDDLLRRHREVSRESNRELKRLLEEHRRTSKRLDDEIKRLLREIEEA

SEQ ID NO: 5937 - protein, 56 aa, Artificial Sequence
  Synthetic sequence.
TETVRKEIEDIARRSKEKLEKNTRDVKRMVDRSKEELKRILKELEDAIREIKKKVD

SEQ ID NO: 5938 - protein, 60 aa, Artificial Sequence
  Synthetic sequence.
SEKERILERLKELVERSNEKLERILRRSEKLFTDSNKELKDILDRARKLIEEIDDRIRKV

SEQ ID NO: 5939 - protein, 55 aa, Artificial Sequence
  Synthetic sequence.
KKIRDDAERLITENKERNERVNKRDEDLLRRNRKENEELNRELERLVKEIREKLK

SEQ ID NO: 5940 - protein, 60 aa, Artificial Sequence
  Synthetic sequence.
EEKERILETAKKLAEEIKRRAEEILKRSEELVRDSNKKLREVLEEARRLIKKIEDEIREI

SEQ ID NO: 5941 - protein, 55 aa, Artificial Sequence
  Synthetic sequence.
KEIEDEVRRLVREIEELLRDIERRDKELLDENRKLNEEVNRDAERLVRKIRKALE

SEQ ID NO: 5942 - protein, 60 aa, Artificial Sequence
  Synthetic sequence.
SEVEELLRRIRELSKRSKDEIKRMLKEIRELSEKSKRDIERMLRRNEDLARKIKELIDRD

SEQ ID NO: 5943 - protein, 55 aa, Artificial Sequence
  Synthetic sequence.
EEIKREVEKLLEENRKLLEDLEEDVKRLIEENKRALEEVERESKRLNDESRERTK

SEQ ID NO: 5944 - protein, 57 aa, Artificial Sequence
  Synthetic sequence.
DDLERVLKEIKKAADKIREDNKRTADKIRKRVKELDDETRDMLRRIRKLVKEIKERV

SEQ ID NO: 5945 - protein, 59 aa, Artificial Sequence
  Synthetic sequence.
DEALRRVEEEVERLIRDLRRVLKETSDRVRELIDKHRRLSEEVEKDVKRLIDELKKKTD

SEQ ID NO: 5946 - protein, 61 aa, Artificial Sequence
  Synthetic sequence.
SEIEEILERIKKISEDSKRRLEDILRKAKKISDESRETNKKTLEDVRRIADEIRKRLEEAG

SEQ ID NO: 5947 - protein, 59 aa, Artificial Sequence
  Synthetic sequence.
KDKLERVEREIRRLIKENKDIVERIERAIEELVRRNEKSVEDSKKDIKRLVDELDREAR

SEQ ID NO: 5948 - protein, 57 aa, Artificial Sequence
  Synthetic sequence.
SEVERIKERIDKLVEENRKLVEEIEEEDRRLLEENREIVKRIEEEIEKLLRDLERRV

SEQ ID NO: 5949 - protein, 59 aa, Artificial Sequence
  Synthetic sequence.
EDVLRDILREIERLSKESKDRLKDLLRKSEELSKESKKLLKDILKKVEDLIREAREEAR

SEQ ID NO: 5950 - protein, 60 aa, Artificial Sequence
  Synthetic sequence.
EEKERLKKSLEDLAKRIRDILRKHEEDSRRLSKEIRDVLRRHREASRKLVEEIKELIKSV

SEQ ID NO: 5951 - protein, 59 aa, Artificial Sequence
  Synthetic sequence.
EEMLKRVLEELERIVRDIERRIKEASERIRKIVEDIKKRIKEADDRIKDIVREIAERIR

SEQ ID NO: 5952 - protein, 60 aa, Artificial Sequence
  Synthetic sequence.
DEEEEALKDVERLLRRNEKLIEEHERRSEKLLRELEDVVRRHEERSKELLERIRERIKRL

SEQ ID NO: 5953 - protein, 55 aa, Artificial Sequence
  Synthetic sequence.
EEVLKKLRKLSKESEDDIRKMSEEVEEIVRRIKRLLEEATRKLEELVKRIEERID

SEQ ID NO: 5954 - protein, 60 aa, Artificial Sequence
  Synthetic sequence.
DEDEEAKREVERLLRENEKLIEDHKRLSEELVRRLEDLIRRHEETSERLLRELREIIKRQ

SEQ ID NO: 5955 - protein, 55 aa, Artificial Sequence
  Synthetic sequence.
EDVLRELRDLSRRSKEEIKKMSEEIEKLARDILKRIREMTEEAKRIVKEIKDRIR

SEQ ID NO: 5956 - protein, 61 aa, Artificial Sequence
  Synthetic sequence.
SEIERVLKELDEVSKKSLEEIRRMSEESRRLSKESIDRIREMLERAREKADRIRETIKREG

SEQ ID NO: 5957 - protein, 59 aa, Artificial Sequence
  Synthetic sequence.
KDKLRRLRERVEELKKRNEDLLKEHRDENKRLIDENRDLVDKLRKTIKRLIDDLERRVR

SEQ ID NO: 5958 - protein, 60 aa, Artificial Sequence
  Synthetic sequence.
SKVDELRKTVEKLLRELRDSLRRYEEESKRLLEELDDSLRRSKKTVEDLLREIKEILKRV

SEQ ID NO: 5959 - protein, 55 aa, Artificial Sequence
  Synthetic sequence.
DRAKERLERLVRKIKEDNKRSLTENERLVRKIKKENEDAIRRLKDVAKKIKEELT

SEQ ID NO: 5960 - protein, 57 aa, Artificial Sequence
  Synthetic sequence.
SEKEELKKEIRRNLEENKDVLRRHEEENRRLKKRIKELLERHARTNKRLKEEIDRTI

SEQ ID NO: 5961 - protein, 59 aa, Artificial Sequence
  Synthetic sequence.
SRLLEELLRKLEKLSRDSKEKLKEISKRSKELVKRIERELEKMTKKSRDLVKKIKEEEK

SEQ ID NO: 5962 - protein, 60 aa, Artificial Sequence
  Synthetic sequence.
SEVEELRKELERIVKETKDVAEELSRESEEVLKKSEENLRRLTEKSDDVLRRVAELIRSN

SEQ ID NO: 5963 - protein, 55 aa, Artificial Sequence
  Synthetic sequence.
KELKERIERVNREVREEARKHHDKNRDIRRRVTELHKRHKERNEEIRRKVEEDAK

SEQ ID NO: 5964 - protein, 60 aa, Artificial Sequence
  Synthetic sequence.
DEIEDLRRKVEKVVRDAEKVLRDLSRKSRKVHEDSRENVDRLLKEVEDVVKRVADLIRSN

SEQ ID NO: 5965 - protein, 55 aa, Artificial Sequence
  Synthetic sequence.
EELKRTLEELLKRVEDLVRRHHEENKKLTDDNRRLHRRLRERLKEVLREVERRRD

SEQ ID NO: 5966 - protein, 60 aa, Artificial Sequence
  Synthetic sequence.
SDVERIEEELRKLTEENRKLTETLKTELRKIRREVEKILKELEDRLRELSERVKDLIRKR

SEQ ID NO: 5967 - protein, 59 aa, Artificial Sequence
  Synthetic sequence.
KEVLDDIRRKLKKLHDESKKTHRDILERLKEALKRLLELAERVLEELERRAEELRREIK

SEQ ID NO: 5968 - protein, 60 aa, Artificial Sequence
  Synthetic sequence.
DDVERLEERLKELDKRNKELTKDLEDKLRKLTRDNRELLKKIEKRLEEVRREVKRLITER

SEQ ID NO: 5969 - protein, 59 aa, Artificial Sequence
  Synthetic sequence.
KEVAERIREELERLHEESKRLHEKILEDLERAHDETRRIVEDILRRLEKVARELKEEIR

SEQ ID NO: 5970 - protein, 57 aa, Artificial Sequence
  Synthetic sequence.
DELRELIKTLREILERLLDRSRRLNDKLKEILERIERASKKMNDDDRRRVRRLEEEV

SEQ ID NO: 5971 - protein, 59 aa, Artificial Sequence
  Synthetic sequence.
SRRLEDVERVVEEAKRALERSLRENEKSVEDIKKRIRESVEENKKSVRDTLERLKRTLE

SEQ ID NO: 5972 - protein, 57 aa, Artificial Sequence
  Synthetic sequence.
STEEEVRKRVEEIERTLRESLERNRETVERSEERLEELLRRARRVVEESKKRLDKEI

SEQ ID NO: 5973 - protein, 59 aa, Artificial Sequence
  Synthetic sequence.
DEVMRDLIRKLEDILRRLKEESDRLNEEHKEILKELVRRLEEIIKEHREIVERILKKTR

SEQ ID NO: 5974 - protein, 56 aa, Artificial Sequence
  Synthetic sequence.
DEEEEVKRLLDRIREEVKRLHDENKKRLDELRRTVDKLLRESERENKRVNDEVRKD

SEQ ID NO: 5975 - protein, 56 aa, Artificial Sequence
  Synthetic sequence.
VETLKRRIEDVLRRVEEESRRLNKELEDVLRRAKELVDRSKKKLEEVLRRVKEKAK

SEQ ID NO: 5976 - protein, 56 aa, Artificial Sequence
  Synthetic sequence.
DEEREIEELLRTLTREVKRLLDESRKLNEEILRKVKRLHDENRKRIREVLEDVKRR

SEQ ID NO: 5977 - protein, 56 aa, Artificial Sequence
  Synthetic sequence.
VETLKEEVKRALEEVEKRVRDSKRDLKRVAEEVEETSRRLNDELRKVREDVRRRAT

SEQ ID NO: 5978 - protein, 61 aa, Artificial Sequence
  Synthetic sequence.
EEAERIADEARKVEEDVRRMVEESKRKLKKVLDDSKRLIDELKRRLEDIRRKVAEMAKRLR

SEQ ID NO: 5979 - protein, 59 aa, Artificial Sequence
  Synthetic sequence.
ERVLRDIERLLEEIRRELERLARESEKVNERVNREDRRLLEEIRELLERIRKELEERTR

SEQ ID NO: 5980 - protein, 56 aa, Artificial Sequence
  Synthetic sequence.
SLKEEVDELLRRIEEEIRRLADKSRRTNERVKEEIDRLARESEETNKKLKKKIEDI

SEQ ID NO: 5981 - protein, 59 aa, Artificial Sequence
  Synthetic sequence.
AKIVKKLLEDLKRLLKEVKELMERINKETKELLERVAREVKRLNTDTERLLKEVEDRVR

SEQ ID NO: 5982 - protein, 60 aa, Artificial Sequence
  Synthetic sequence.
SEREEIEELSRRSRRSLEELKKEIRKVNERNKRLLEELEREIRRVSKESRDRLRELRRRL

SEQ ID NO: 5983 - protein, 56 aa, Artificial Sequence
  Synthetic sequence.
TKDLIRRLRELTRTIERRATELIKRLEEVSREIAERVRKLIKELRDMTRKIDEDAR

SEQ ID NO: 5984 - protein, 59 aa, Artificial Sequence
  Synthetic sequence.
SEVEKLLERLKKILEEIARLVDRSNTEDDKILRKAEEDVRRLLDKLKKILERAAELLAR

SEQ ID NO: 5985 - protein, 59 aa, Artificial Sequence
  Synthetic sequence.
EKLRREIRKLVKELKETIKRLEKKSRDTVKRTEDELRRLEEEAERLITELKERLDELRK

SEQ ID NO: 5986 - protein, 60 aa, Artificial Sequence
  Synthetic sequence.
REDEEMLKDLKRVLEDAERVSRDTLRELEDAVRRLHELSEDTLDKLRKVLEEADRLIRSN

SEQ ID NO: 5987 - protein, 55 aa, Artificial Sequence
  Synthetic sequence.
EDVRRILERVRKELKRLLEENEKLLRRVEKELEENERRNEEEIRRVKKTVEERAK

SEQ ID NO: 5988 - protein, 59 aa, Artificial Sequence
  Synthetic sequence.
SRVEEVLKENRDTNEELKDTVRKILETNRRTLERAEEEVRKILEDLRDIARKIEEMVEN

SEQ ID NO: 5989 - protein, 59 aa, Artificial Sequence
  Synthetic sequence.
KEMLERLRRSLEESKETVKRLLEELRKSLEKSKRDVERLLKELEDLLRELEKKVDDRRR

SEQ ID NO: 5990 - protein, 59 aa, Artificial Sequence
  Synthetic sequence.
DEAREILTRIRKLLEEIRKEAEEVSERHKRLVDELDKEVKDINKRAEDLLRELAEIVKR

SEQ ID NO: 5991 - protein, 56 aa, Artificial Sequence
  Synthetic sequence.
EKEVRKVLEEIKRVLEELKRHAEDNLRRAREVLKKLADEAKRVNERSEELLRELKK

SEQ ID NO: 5992 - protein, 60 aa, Artificial Sequence
  Synthetic sequence.
SMADEILRELKELTEEIERRVREASREHRERLEKLRREVREINKELKRRLDELREIVERG

SEQ ID NO: 5993 - protein, 56 aa, Artificial Sequence
  Synthetic sequence.
KDRVEKILRENKERTDRLRRHIEKNLEDARDLLRKLKEEVKRVNEESEKSLRDLRK

SEQ ID NO: 5994 - protein, 60 aa, Artificial Sequence
  Synthetic sequence.
SLEEDIRRILDENRRSTERIKEEIREINERDKRSLEDIERRIRKVLEDLRKLLEDLAREG

SEQ ID NO: 5995 - protein, 59 aa, Artificial Sequence
  Synthetic sequence.
EEAVRKILKEVRDVNEELKRRVEKILEDIRDANRRLRETVEEIIRRAKEAVDKLRDEVR

SEQ ID NO: 5996 - protein, 59 aa, Artificial Sequence
  Synthetic sequence.
SEKERVDDLLRRVDELLKRSKREVEKLLEDNKRLLERIERENRRLTKELEDKVRRLKEK

SEQ ID NO: 5997 - protein, 56 aa, Artificial Sequence
  Synthetic sequence.
VEEIAKEIRDVLREHKELIDEIRKKAKKISDKSRKLMEELERHLRRVIKELDEKAR

SEQ ID NO: 5998 - protein, 60 aa, Artificial Sequence
  Synthetic sequence.
SEEEEVEELLRRNRKKAEEVDREIDRLLKEVEKLVKDSRKRIEDLLRRAREKVEDLRRKG

SEQ ID NO: 5999 - protein, 56 aa, Artificial Sequence
  Synthetic sequence.
VREISEEIERITRETEDRIRKIAEEIRRVLKRHKELIEELEKEIRDVLKKLDDDVR

SEQ ID NO: 6000 - protein, 57 aa, Artificial Sequence
  Synthetic sequence.
SEIEKLLKDLRDLLKKSEETVREMLKRLEEIVRRAEEDHKRLLEKLKRLLEKLRRDV

SEQ ID NO: 6001 - protein, 59 aa, Artificial Sequence
  Synthetic sequence.
EEVRKRLEDLADEVDKRNRDIERKIRELMKRAKEVSERLNKELEDLAREAEKLLRELKK

SEQ ID NO: 6002 - protein, 57 aa, Artificial Sequence
  Synthetic sequence.
DEIEELLKRLRDIVRKIREDHERLSRESERINKDARRRHDEMLRRLEELLRKVEKEV

SEQ ID NO: 6003 - protein, 59 aa, Artificial Sequence
  Synthetic sequence.
EKVKRDIERIRKEVKEESKRLNDHIRDNERRNKESSEELNRRIKKIADEVRELLEKLKT

SEQ ID NO: 6004 - protein, 56 aa, Artificial Sequence
  Synthetic sequence.
REEERLRELMDESRKRIEAVEKRARDLKRKSDRLIEDAARKIKTILDKIRKLIEDL

SEQ ID NO: 6005 - protein, 56 aa, Artificial Sequence
  Synthetic sequence.
LKDVEKKIREVNKTVKEEVDRLVEKNERLNDEARRVVKELLDKVERMLEEVEREAR

SEQ ID NO: 6006 - protein, 60 aa, Artificial Sequence
  Synthetic sequence.
SEKEDMARKIKELIDRDRERIERVIREIEKLIKELRDHNKRVLETDKRLLDDLKRVADDG

SEQ ID NO: 6007 - protein, 55 aa, Artificial Sequence
  Synthetic sequence.
EDLRRLKEEVDRVAEETRRLLEEIKKKVDKVVREVETSNRRSEEEVRRLLDEIRR

SEQ ID NO: 6008 - protein, 60 aa, Artificial Sequence
  Synthetic sequence.
DEKEEAARRVEKLITELRKHNEDVLRDIKRLIDELRRHNEEVLKRDRELLERLRKVAEEG

SEQ ID NO: 6009 - protein, 55 aa, Artificial Sequence
  Synthetic sequence.
KELDDLRKRAEDVLRDLRRTNRKILEDVRRVIEELERSNERSLTEVERLLREVRK

SEQ ID NO: 6010 - protein, 59 aa, Artificial Sequence
  Synthetic sequence.
SEKERVLTELEKILEELRRRVEEILKEIEKLIEELRRHNERALERDKKLLEELKEVRER

SEQ ID NO: 6011 - protein, 55 aa, Artificial Sequence
  Synthetic sequence.
RELEKVKEKLDRLMKDIKEKLDRVKEKVRRVLKELEESNRKSEKDAKELIDRIRK

SEQ ID NO: 6012 - protein, 57 aa, Artificial Sequence
  Synthetic sequence.
SEVEDLLRDIERLIEESRRLVERLLERLEELIRRHTRLVEELIRELERMLKKVADEV

SEQ ID NO: 6013 - protein, 59 aa, Artificial Sequence
  Synthetic sequence.
DEIRTEIKKVVDKAREVNKRIKELIDKIKREAEENSKRANELIERITREIRRLLEDLRR

SEQ ID NO: 6014 - protein, 60 aa, Artificial Sequence
  Synthetic sequence.
SELEELRKRVKDLIRETKKLVEEVAEKVERLNKETKKLLEDVARIVEELIRRAEEVAERI

SEQ ID NO: 6015 - protein, 59 aa, Artificial Sequence
  Synthetic sequence.
EEVLRDIERLAREIEKVNREAEERIRRLKKKSEETNERVKRAIDKLAEELRRVLEEIRR

SEQ ID NO: 6016 - protein, 60 aa, Artificial Sequence
  Synthetic sequence.
SELEELAKAVEKLLEDLRRMTREVEEKVKEINERTKKLLKDVAERVKTLLREIEELAKKI

SEQ ID NO: 6017 - protein, 59 aa, Artificial Sequence
  Synthetic sequence.
REVLKAIKELMERIKKTLDEIRKRIKELEDESEKTNRELKKKIEDLKRELEELLREIKR

SEQ ID NO: 6018 - protein, 61 aa, Artificial Sequence
  Synthetic sequence.
SEIDEVIKTLEKLLEDLRRELEELSRRNKKVLEDILRRVKRLSDENRRLLERIKRTVDKRG

SEQ ID NO: 6019 - protein, 59 aa, Artificial Sequence
  Synthetic sequence.
EKIEKKVKEVRERVKEVLERIERLVDENRRENKEVVDRIKKLLKENEEEVREVLKRIRD

SEQ ID NO: 6020 - protein, 61 aa, Artificial Sequence
  Synthetic sequence.
SEIDDLVKKNKELVKKIREDVERLSEENKEVLKDIERKVRKVSEENDRLLEEIKDTVRKRG

SEQ ID NO: 6021 - protein, 59 aa, Artificial Sequence
  Synthetic sequence.
RKVEKKVRENKKENEDVLRDIERLVKENKDRNREVLKRIEDLLRKNAERVKRVADEIRR

SEQ ID NO: 6022 - protein, 59 aa, Artificial Sequence
  Synthetic sequence.
KEVEDIVDDVRRVIEELKRKVEEVSKKNEKLVREIEERVERISRRNKKLIKELKEIVDR

SEQ ID NO: 6023 - protein, 56 aa, Artificial Sequence
  Synthetic sequence.
EELLRKIARDLEKVREEIKELVKENRKTNEEVVRRIEKLAKENDDENRKVLKEIED

SEQ ID NO: 6024 - protein, 60 aa, Artificial Sequence
  Synthetic sequence.
DEVERIVEDIRRLLDEVRREVEKVSRENKELVDRVREKVKEISKRNKKLAKDLTDLVREG

SEQ ID NO: 6025 - protein, 56 aa, Artificial Sequence
  Synthetic sequence.
KELLDRIKEEIERVIKEIRELVEENKRTNEEVLRRIRELARRNEEENKRVLEDIRR

SEQ ID NO: 6026 - protein, 60 aa, Artificial Sequence
  Synthetic sequence.
SVEELIKEVKDRLRKVLREIEELIRENEEENRKNVEDVKRTADKLRRDLEKVVDEIDKRV

SEQ ID NO: 6027 - protein, 59 aa, Artificial Sequence
  Synthetic sequence.
KEVIDKVVKRVEDLVREIKEEVDKISEENKELVKRDTRRVEEVRERIRKLVEELRREVT

SEQ ID NO: 6028 - protein, 61 aa, Artificial Sequence
  Synthetic sequence.
SEIDRVIEKSDKTNEEIKRDVDRAVRRSEETLKRIRETVEEIVKTVEKLIRDLRRRVEDKG

SEQ ID NO: 6029 - protein, 56 aa, Artificial Sequence
  Synthetic sequence.
KDKAKELRDRLERSLREIAKKIKKVLDDTDRVLRDIERTIEELKKRLREVLERVRK

SEQ ID NO: 6030 - protein, 61 aa, Artificial Sequence
  Synthetic sequence.
SEIDDVIKKLKDLIEELEREVKEMSDENKRLLEEIEERVKEAIKRSKDTLEEIADRVRKKG

SEQ ID NO: 6031 - protein, 56 aa, Artificial Sequence
  Synthetic sequence.
KDKATKIEKDLRDVLRKIEKTMEDNRRENEELLKKVEEEVRRLEEETEKVLRDLRR

SEQ ID NO: 6032 - protein, 60 aa, Artificial Sequence
  Synthetic sequence.
SEVDEILKRIEELIRRIEDEVEKMIRESEDTIRRDEKEVKDAVRELADLIRRIEKRVRER

SEQ ID NO: 6033 - protein, 56 aa, Artificial Sequence
  Synthetic sequence.
EKKVREIDKRLKDALREIRKLIERSKEESRRALKRSRELMKRLEEELRRVLKEIRD

SEQ ID NO: 6034 - protein, 61 aa, Artificial Sequence
  Synthetic sequence.
DEVDKVLKRIKELIDEDKKEVEKVIRDSKRTLREDEERVRRAAKEVEDRIRDIEDIVRRRK

SEQ ID NO: 6035 - protein, 56 aa, Artificial Sequence
  Synthetic sequence.
KKKLEDIDRELDRVLEESKKEIEKSKRESEEVLKKSRDLVKRLAEELKRVLDEIRR

SEQ ID NO: 6036 - protein, 60 aa, Artificial Sequence
  Synthetic sequence.
SRVEEVLKEIDKLIKEIKERVKRLIEESKRLNREDEERVRKVIEESKKTLEEIREVMERN

SEQ ID NO: 6037 - protein, 56 aa, Artificial Sequence
  Synthetic sequence.
KDLLREIERRLREMLKEIEERIRRSKREVEESAERSERLIRKSEEDSERVLRELRR

SEQ ID NO: 6038 - protein, 60 aa, Artificial Sequence
  Synthetic sequence.
DEVERILERIEELLRKIRKDVEEAIKDSERLNKDDLKRVRDAVETLRELIRRIEEEVRRR

SEQ ID NO: 6039 - protein, 56 aa, Artificial Sequence
  Synthetic sequence.
KDLARDIDEKVRRLLEDIRRLVEESEKKVDESTEESRRLVTELERELREVLKRIRD

SEQ ID NO: 6040 - protein, 57 aa, Artificial Sequence
  Synthetic sequence.
SRVDELVKEAEDLLEEAKKANAESIRRIEELLKRVAEEIRRLSEEDKKLVEEVRKRV

SEQ ID NO: 6041 - protein, 59 aa, Artificial Sequence
  Synthetic sequence.
KRAEDKLRRVEEDARRVLEDLKRTLKRLEEEVRRVLEEARDILRKNAEENRKVLEDLRR

SEQ ID NO: 6042 - protein, 57 aa, Artificial Sequence
  Synthetic sequence.
SRVEELVEELKRLLRTVEKENEDSIREIERLLREVKRRNEESSREDEKTIRTVRREV

SEQ ID NO: 6043 - protein, 59 aa, Artificial Sequence
  Synthetic sequence.
KRAEEILERLRKEAEEVLKKLEDTLRELRKRAEKVLRDMEETLKKNKKDNEKVLRDLRK

SEQ ID NO: 6044 - protein, 57 aa, Artificial Sequence
  Synthetic sequence.
SEVDKIIKEIEDLLDEARKTNEKSSRDDKRLVEEVKELNKESSERNKRLVKEAREKI

SEQ ID NO: 6045 - protein, 59 aa, Artificial Sequence
  Synthetic sequence.
KRAEDKIRRIAKDAEDVLRTMEKTLRDNERENREVLKELEKTLRENEKENEKVLRDLKR

SEQ ID NO: 6046 - protein, 56 aa, Artificial Sequence
  Synthetic sequence.
EEIERVEEKVRRLIKELEDELRKIEERIERLLRRSRERNKEISDRNRRLLEEMRRS

SEQ ID NO: 6047 - protein, 56 aa, Artificial Sequence
  Synthetic sequence.
EEKARELEEELRRAVERVDRKIEELEERLDRVLKESRDTVDENEKRNEKVLRELET

SEQ ID NO: 6048 - protein, 56 aa, Artificial Sequence
  Synthetic sequence.
KEIEDVVETVRRLLRTSEELNERISRDNEKLLRDSEKLNREISERNRKLLKDLKDS

SEQ ID NO: 6049 - protein, 56 aa, Artificial Sequence
  Synthetic sequence.
EEAARDLARKLKEVHDRSRETIKRNEDKNRRVLEESKKTARENEERNKRVLDELRK

SEQ ID NO: 6050 - protein, 60 aa, Artificial Sequence
  Synthetic sequence.
SEEDRVLEDVERLLRELKKETDRIAEKNKKLNEDVTRETEEIVRRVRELLERLLDLVRKV

SEQ ID NO: 6051 - protein, 56 aa, Artificial Sequence
  Synthetic sequence.
SEKAREVEREVRRIREEDERILRELEERNRENKKRDEDILKELEDRAERVLEEIKR

SEQ ID NO: 6052 - protein, 60 aa, Artificial Sequence
  Synthetic sequence.
SEEDRVLKEAKDLLEEIERELDEVAERNKELNKRLTDETRKIERRVRELLRELKDKVRKV

SEQ ID NO: 6053 - protein, 56 aa, Artificial Sequence
  Synthetic sequence.
SRKLEKLEKEVREVEKRIRDILKKLEDDNRANRKRDEDIIDELRKEADRVREEIKR

SEQ ID NO: 6054 - protein, 59 aa, Artificial Sequence
  Synthetic sequence.
SEVEELVRRVEKSNRDIEEMVKKIDKRNRDLLRKIEKDLREADRRNEELLREIDDLVRR

SEQ ID NO: 6055 - protein, 56 aa, Artificial Sequence
  Synthetic sequence.
EKLLKEVEDRNRESAKEVKRLADENRKANEELKRRVEKLVRDNRRKNEELKKKVKD

SEQ ID NO: 6056 - protein, 59 aa, Artificial Sequence
  Synthetic sequence.
REVEELLKEIRKRIEDVRRRVEEIDRRNRKLLKEVEERLEKVRREVEKSNTDIKELAER

SEQ ID NO: 6057 - protein, 56 aa, Artificial Sequence
  Synthetic sequence.
EDLLRRVREEIERVIREVKRLLEENKKRNDEVRKRVEDIVRRLEEHHRELKRRVEK

SEQ ID NO: 6058 - protein, 56 aa, Artificial Sequence
  Synthetic sequence.
KDIEDILKESEKTNREILKRAEDASEENERINKRITDRVDRVRKEIERLLEELTRR

SEQ ID NO: 6059 - protein, 56 aa, Artificial Sequence
  Synthetic sequence.
KKLVDELRRRVEETLKRLRKLIADNREKNKDNLRRIEEEVKKLEEEIKKIKDEMKR

SEQ ID NO: 6060 - protein, 56 aa, Artificial Sequence
  Synthetic sequence.
KELEDIARESEKTNRDIKRRVDEVRKTIEDLLRRIDEEVKRAAEESKDTNRRIREE

SEQ ID NO: 6061 - protein, 56 aa, Artificial Sequence
  Synthetic sequence.
EDLMRKLKREVEETDKEIKDIIRRLKEEIEKIKRKIEEIIKKLKKENEDTRREADK

SEQ ID NO: 6062 - protein, 56 aa, Artificial Sequence
  Synthetic sequence.
SDIDDILRESRKINKEINDTVTEMMKRSKKTNDEIREKVKEVREESEKTNEEIRRE

SEQ ID NO: 6063 - protein, 56 aa, Artificial Sequence
  Synthetic sequence.
EKLVKELEDELRKSEERARRIIERLKEELKKTRKEIEDIIRELRKKLEDTLRDVEK

SEQ ID NO: 6064 - protein, 56 aa, Artificial Sequence
  Synthetic sequence.
SDIEKILRESKDINRRINERVDRVVERSKKTNEDILKKVKDAAEESKKTNDDIRKS

SEQ ID NO: 6065 - protein, 56 aa, Artificial Sequence
  Synthetic sequence.
EELVRELRRLVEESLKRIEKIIKDLEELIKETKRRLEEIIERLEKKNEDTEREARK

SEQ ID NO: 6066 - protein, 56 aa, Artificial Sequence
  Synthetic sequence.
DEIREIVKESKRINEEINRKVEEVVRRSEKTNEDIRDTVRRLVRESDETNRRIEES

SEQ ID NO: 6067 - protein, 56 aa, Artificial Sequence
  Synthetic sequence.
EDLVRELRKEVKRSEDRIRKIIRDLDELNRRSKEDIKRKIDELRKRVEETKRRVTK

SEQ ID NO: 6068 - protein, 56 aa, Artificial Sequence
  Synthetic sequence.
DDIEEILKDVKRLLDEILAKVKKASDDNKRILDEIERKVEEMVRRSEKTNEDIRRS

SEQ ID NO: 6069 - protein, 56 aa, Artificial Sequence
  Synthetic sequence.
EELVRELKKRVDEIKERARRLIEENRERNKEIKERAERIIERLRKINEDTKREAEK

SEQ ID NO: 6070 - protein, 56 aa, Artificial Sequence
  Synthetic sequence.
DEIEDIVRRVKKLIRDLEERVKKLEEDSDRTNERIRREAEKASKRNKEILDKLRKS

SEQ ID NO: 6071 - protein, 56 aa, Artificial Sequence
  Synthetic sequence.
EELVKELRKELEEVKEEIRKIIEELKRRNDKSRRDLERLIRDNEDKNRRLKKEAED

SEQ ID NO: 6072 - protein, 56 aa, Artificial Sequence
  Synthetic sequence.
EEIERIIRESEKINKEINRTVKEVEKRSEETNRRIREELKRISKRNKEILDRLRKE

SEQ ID NO: 6073 - protein, 56 aa, Artificial Sequence
  Synthetic sequence.
EKEVEKLKRKVEKSEEDIRRIIEKLREENKRSEEEVRRLITENEKRNRKLLEEAKK

SEQ ID NO: 6074 - protein, 56 aa, Artificial Sequence
  Synthetic sequence.
SELEKIAEDSERINKEINERVKRISDENKRILEEIEKAVEEASRDNKRILDELRKS

SEQ ID NO: 6075 - protein, 56 aa, Artificial Sequence
  Synthetic sequence.
EELVRELERRVDESRKRAEDLIRDNKKKNDEARRRVEELIRRNREENRRIAEEARK

SEQ ID NO: 6076 - protein, 60 aa, Artificial Sequence
  Synthetic sequence.
SDAERIMRESEELNERINDVVRRVAEESKRLNDRINDVLREVSKRNKDLIKRIKEVVDRN

SEQ ID NO: 6077 - protein, 56 aa, Artificial Sequence
  Synthetic sequence.
ERIIERLDRLTKKSLEELKRIIEDLKRRTKESEDRARELIKRNREENKRLLEEAEK

SEQ ID NO: 6078 - protein, 60 aa, Artificial Sequence
  Synthetic sequence.
DEAERIREESEELNERINREVDKMIDEDRKLNEDIRRTVEEMVREIKELLDRIRKVLEEN

SEQ ID NO: 6079 - protein, 56 aa, Artificial Sequence
  Synthetic sequence.
KEIIKELRETTERSRKRLEELIRDSEEKNRRTEDELEKIIRELDERLRRLEEEARK

SEQ ID NO: 6080 - protein, 60 aa, Artificial Sequence
  Synthetic sequence.
DEAEDIARKSRELNERILRRVKEMIDEDRDLNREIEKTLRRVSERNRELVEEIKREVERN

SEQ ID NO: 6081 - protein, 56 aa, Artificial Sequence
  Synthetic sequence.
ERIIEELRRLTEDTKRRADKLIKDSEDENRKTLRRARELIEENRDRNRKLEEDVRR

SEQ ID NO: 6082 - protein, 60 aa, Artificial Sequence
  Synthetic sequence.
DEVREIVKRSDDLNDTIREVLKRVADDSRRLNEEIRRKVTEASRENEELIKEIEDRARKN

SEQ ID NO: 6083 - protein, 56 aa, Artificial Sequence
  Synthetic sequence.
EEIIKRLRDRTKKTLDEVRKIIEDLKDESRKTSEELRELIKRNKEKNDELLERLER

SEQ ID NO: 6084 - protein, 60 aa, Artificial Sequence
  Synthetic sequence.
SEAEKIERESRDLNRRIREVVERASEDNERLIREIRKRLEEVVRTIEKLIRDILERVRKN

SEQ ID NO: 6085 - protein, 56 aa, Artificial Sequence
  Synthetic sequence.
EEIIKELKKITDKTRRELERLIDENRKRNEELLKRVEDIIRELKRRLEKLDEEVKR

SEQ ID NO: 6086 - protein, 60 aa, Artificial Sequence
  Synthetic sequence.
SEVERIEKESRDLNREIKEEAKRASEDNRRLLEDIRRKLEKVSEENKDLLRKIEEEMRRN

SEQ ID NO: 6087 - protein, 56 aa, Artificial Sequence
  Synthetic sequence.
EEIIKKLKRLTDETEKELEKLIRKNEKENRDLEREIRRLIKENRDRNRELKKRAED

SEQ ID NO: 6088 - protein, 60 aa, Artificial Sequence
  Synthetic sequence.
SEVEKAVREIEELIKRIEDRLREMARRVEETNKTLLRDVERLSKENEELVREIKERVREN

SEQ ID NO: 6089 - protein, 56 aa, Artificial Sequence
  Synthetic sequence.
EELVRELERKIKTVLDRVEEIIRRLDKKTKDTVRRVRELIEDNKRKNKKILDEVRK

SEQ ID NO: 6090 - protein, 60 aa, Artificial Sequence
  Synthetic sequence.
SEVERIVKESEELNEKITRDLEEAEKEVRKTNDEIRRVVEEMSRRNEKLIRDIDDEVRKR

SEQ ID NO: 6091 - protein, 56 aa, Artificial Sequence
  Synthetic sequence.
DEIIKELEKKTRDNLDKVRKIIERLRRETDKTEKELRDIIRKNEDENRKLEEKVRR

SEQ ID NO: 6092 - protein, 60 aa, Artificial Sequence
  Synthetic sequence.
SKVEKLAKEVEETNRRILDEVRRASEENKDLVRRIEETVKRAVEEIKRLIEKIDDVVTKN

SEQ ID NO: 6093 - protein, 56 aa, Artificial Sequence
  Synthetic sequence.
EEIIKELRKRSEDSEREARKLIRRNEEENEKLRKKLKEIIDRLREELEKVLDRVRK

SEQ ID NO: 6094 - protein, 61 aa, Artificial Sequence
  Synthetic sequence.
SEVERAAEESKRLNKTIRDENREVLREIRDLIRRMKEENRRMVKRVDEVLKEIRELFRRDK

SEQ ID NO: 6095 - protein, 59 aa, Artificial Sequence
  Synthetic sequence.
EKVREILERLERESRKTAKELDESNREAEELLKRVADEAKKSNETLRERLERLAREAEK

SEQ ID NO: 6096 - protein, 61 aa, Artificial Sequence
  Synthetic sequence.
SELEELIRKIEELIRRIEEENKEMVRRSRKLNEDLERRLDEVRRRVEKLIREIEELLKRDK

SEQ ID NO: 6097 - protein, 59 aa, Artificial Sequence
  Synthetic sequence.
ERAKRLLDELKRLIKELEDKLRESNEELKRRSDDSARKAEKILRELKKKVDEMADRARK

SEQ ID NO: 6098 - protein, 60 aa, Artificial Sequence
  Synthetic sequence.
DEAEKLAEDVRRVIKRIREDNKRLSDRNKELLEEVEKDNKKSEEDVKRVIEDIERRVREL

SEQ ID NO: 6099 - protein, 56 aa, Artificial Sequence
  Synthetic sequence.
RELLDELRRRIEELRKRLEDSNRENEEELRKIADKVRKTNKRLNEEVEDMFRRAKT

SEQ ID NO: 6100 - protein, 57 aa, Artificial Sequence
  Synthetic sequence.
DEARELLRDDERLNRELNDLDRDSSKKDEDLNRKLNEDDKESVERADTLLERIKREV

SEQ ID NO: 6101 - protein, 56 aa, Artificial Sequence
  Synthetic sequence.
RELIRELEERNRDSVRKSRKSNEDNERTNRESIERSRRSNEELRRRAEELIKDLRR

SEQ ID NO: 6102 - protein, 57 aa, Artificial Sequence
  Synthetic sequence.
SEVEELLERDKDLNRRVNELNEKTSREDEKLNDEINKRIDRLVERARELLERIRREV

SEQ ID NO: 6103 - protein, 56 aa, Artificial Sequence
  Synthetic sequence.
ERLIRELEERNRESVERVRRSLKENEDRNRESKKRLEDLLREVKRLMDKLEEDLRK

SEQ ID NO: 6104 - protein, 57 aa, Artificial Sequence
  Synthetic sequence.
SEVEELLERDKRLNDEANRLNRELVERDKRLNEELNKELKRMADEIKRLLEEIRRKV

SEQ ID NO: 6105 - protein, 56 aa, Artificial Sequence
  Synthetic sequence.
ERLIEKLERENRESEKRARDSNKELEKRNRESEDRARRILKKLEDDVRRLKKELET

SEQ ID NO: 6106 - protein, 60 aa, Artificial Sequence
  Synthetic sequence.
SELEKVRTDVERVIRELEKELKEIDEENKKVNKDVEEEVKRIEEENKEMNDRLDDLRRRG

SEQ ID NO: 6107 - protein, 56 aa, Artificial Sequence
  Synthetic sequence.
SKEMEEVREELERLLRRIKKILEELRDENRKSLERLEDVLRRLEKRNRDTLEEVKR

SEQ ID NO: 6108 - protein, 60 aa, Artificial Sequence
  Synthetic sequence.
KETEDVERDVERVIREIDTKLKEIEKKNDKANKELEEKLKKIEEDNKRVNERLKRLREEG

SEQ ID NO: 6109 - protein, 56 aa, Artificial Sequence
  Synthetic sequence.
SEEMRRVREEAKRLLDKVKKILRDLERRNEEVLKKIKDIMRRLEKRNRDTLEEIRT

SEQ ID NO: 6110 - protein, 60 aa, Artificial Sequence
  Synthetic sequence.
SEEEKVLEEVKRAIDELKKELEEVEERNKRVNDDIRRLTDEIRKENKTANDRLRKLLEEG

SEQ ID NO: 6111 - protein, 56 aa, Artificial Sequence
  Synthetic sequence.
SKKLEEVRKEVKRLKDEVEKILKDLRKRNKDLLEEDKRVLDRLRETNEKTLDDVRR

SEQ ID NO: 6112 - protein, 61 aa, Artificial Sequence
  Synthetic sequence.
KEEEDITRRIDKILRDLREKLRDVNRRVEELSKRLHDKLEKVLKRIKDEAERLRKEIREKL

SEQ ID NO: 6113 - protein, 55 aa, Artificial Sequence
  Synthetic sequence.
KELEDKVEKDARDVERHIRKDLTDVRRRHEDLDRKIKELLDRVRKAIRDVEEKIK

SEQ ID NO: 6114 - protein, 61 aa, Artificial Sequence
  Synthetic sequence.
SKAEELLRRVEELLKRVKDKVDDIVRKIEKSNRDLERRDEEVLREVEETNRRLEEELRRRG

SEQ ID NO: 6115 - protein, 55 aa, Artificial Sequence
  Synthetic sequence.
EEVLRRLEELIRRAERKLEKMLEDLTRLNKEWEDRTRKLLEDLRRINEEIKRKIK

SEQ ID NO: 6116 - protein, 61 aa, Artificial Sequence
  Synthetic sequence.
SEKDELLRDVRRLLKEVEKELEEIRRRVTESNRELEKLVREVLEESKRSDDKLREDLERAG

SEQ ID NO: 6117 - protein, 55 aa, Artificial Sequence
  Synthetic sequence.
KDLLERLKELIKRLKDKLKEIADRLRRINEDIERKIREILEDSRRFNEEIKKKID

SEQ ID NO: 6118 - protein, 58 aa, Artificial Sequence
  Synthetic sequence.
STLETLEDEVRKIVTDIERVIRESNKHLKKSIDDVERVIEEIERRAREIVKKVRDVIS

SEQ ID NO: 6119 - protein, 58 aa, Artificial Sequence
  Synthetic sequence.
EKLERILREIKRIVEDLKKKVEDSLKRYEEELERLKEDLRRLLKRIRDEVEELKKESD

SEQ ID NO: 6120 - protein, 59 aa, Artificial Sequence
  Synthetic sequence.
DEEEKLRDEVEKIVKKIEKAIEDLRRHAEKSVTDIRKVLKELEDHIRESVKDAERFISE

SEQ ID NO: 6121 - protein, 58 aa, Artificial Sequence
  Synthetic sequence.
EKLEKILREIERIVEKLKEDLDRLLKRYEDELRRLKEELERILDTYRRLLEELERRLR

SEQ ID NO: 6122 - protein, 58 aa, Artificial Sequence
  Synthetic sequence.
DTARELEREVKKIVDEIEDVIRRLRRHIEESVKRAEKVLREIEKHARESAKRIADVVS

SEQ ID NO: 6123 - protein, 58 aa, Artificial Sequence
  Synthetic sequence.
EELKEILERIEEIVKRLEEELRRLLEEYKKRIEELAKRIKEVLDEYRKILKRLEDETK

SEQ ID NO: 6124 - protein, 60 aa, Artificial Sequence
  Synthetic sequence.
DEAEELRKDVKRVLDEIKKRHEELLRKVREDLDRIRRKLEELAKRHRELLKEVKKIVDRD

SEQ ID NO: 6125 - protein, 56 aa, Artificial Sequence
  Synthetic sequence.
DKIRREIDELIKKLEEESRRIEEEIKKLVEDLKREADKIMEELERETDKLKKELDK

SEQ ID NO: 6126 - protein, 57 aa, Artificial Sequence
  Synthetic sequence.
SEKEKILEEIREVLKRILDRLKKELEDDKKSLDDNKRRTEEALREDKKSLEEIRRAN

SEQ ID NO: 6127 - protein, 56 aa, Artificial Sequence
  Synthetic sequence.
DKILRDLEKALDKLRRDIEEILKRSRDLNKKLEDDNREALRRSEELNRELEERERK

SEQ ID NO: 6128 - protein, 57 aa, Artificial Sequence
  Synthetic sequence.
SEEERIRREIKKILDDIKEEAERRLEEDKKSLDENRKKTEEVLKKIRDDLKRIEEAK

SEQ ID NO: 6129 - protein, 56 aa, Artificial Sequence
  Synthetic sequence.
DEILRRIEKLIEDLKRTIDKILEDSERLNRKLEKENREALKELRDLLRELEERLKK

SEQ ID NO: 6130 - protein, 56 aa, Artificial Sequence
  Synthetic sequence.
EELERILRKITEMLREIARKLKKLLEDDKESLDRNKEKTEDDLRRDKESLDRLRKS

SEQ ID NO: 6131 - protein, 56 aa, Artificial Sequence
  Synthetic sequence.
DKILRDLEELLKDLERKIRRILDESRKLNDELRKENKKAEDTSRRLNEELEERLRT

SEQ ID NO: 6132 - protein, 56 aa, Artificial Sequence
  Synthetic sequence.
SELEEILKRVEDVLRDILRKLKEVLDRAEKVIRDNKRKTKKMLDDDKRSLDEIRKA

SEQ ID NO: 6133 - protein, 56 aa, Artificial Sequence
  Synthetic sequence.
DKILRELEKRLEDLRKRIKDILDDLKRKLEELKRENEKFLRRSKKLNEDLERELET

SEQ ID NO: 6134 - protein, 56 aa, Artificial Sequence
  Synthetic sequence.
DELEEIRDRIKRKLEKLKEETKRTLEEDRKSLDDNRRKTEEALRRDRESLERIERA

SEQ ID NO: 6135 - protein, 56 aa, Artificial Sequence
  Synthetic sequence.
RDILEELTRLLDKLRRDHERVSEESKRRNDELEEENRRVLKESEDRNRELEERLRQ

SEQ ID NO: 6136 - protein, 55 aa, Artificial Sequence
  Synthetic sequence.
SELEKLLDDVKKDLKRIEEHLRRDEEDSKRRIEELERHLERDKKEVEKAIRELDK

SEQ ID NO: 6137 - protein, 56 aa, Artificial Sequence
  Synthetic sequence.
EKVVRTIEKLLTDLERKIREIEKRSKELLTRLEEKIKKAERESRKLLRELTERIDR

SEQ ID NO: 6138 - protein, 61 aa, Artificial Sequence
  Synthetic sequence.
DELKKLLDDVREVSKRLNDELRKIMEEIRKVSEDLNKELDDIVRKIKKVIDDISEKIKRDG

SEQ ID NO: 6139 - protein, 55 aa, Artificial Sequence
  Synthetic sequence.
EEIEKEIRELLKENRRRADEIRRRAEKSLKDNERRVEKVEREAERLLREIEKELK

SEQ ID NO: 6140 - protein, 61 aa, Artificial Sequence
  Synthetic sequence.
SELEKLAEDVKRKLTEIREKIKKLLKETRDVSRELNKELEDLLRRTTEVIDEIRKKIEKEG

SEQ ID NO: 6141 - protein, 55 aa, Artificial Sequence
  Synthetic sequence.
EDIKKEIEDLLRDLERLLRDVNREVEELLKENRKRLEEINRTVERLLEEIEKRLR

SEQ ID NO: 6142 - protein, 61 aa, Artificial Sequence
  Synthetic sequence.
SELEELVRRLREVSKRLNEELDRILDRTRRLAERISEDIKRLADETKEVIERIKEEIKKKG

SEQ ID NO: 6143 - protein, 55 aa, Artificial Sequence
  Synthetic sequence.
EEIEKEARELLRDNRRRIEEINREVEELIRRLEKLLKEVNETVKRLLEEIRKDLD

SEQ ID NO: 6144 - protein, 61 aa, Artificial Sequence
  Synthetic sequence.
SELEKLMKDVKEVIDEIRKKLRKILEDTTRVAKRNEEKLKRIADEAEKVIREIRDEIEKKG

SEQ ID NO: 6145 - protein, 55 aa, Artificial Sequence
  Synthetic sequence.
EEIKKRIDDLLRRIEKEIEEINRRVEELHKRLEDLHKEIEDKVRELLTRIEERLK

SEQ ID NO: 6146 - protein, 56 aa, Artificial Sequence
  Synthetic sequence.
SEVEEILERIERLIRDDNRKLKDVERRNRENIKEDNERLKRMMEELKKIADEIRKA

SEQ ID NO: 6147 - protein, 55 aa, Artificial Sequence
  Synthetic sequence.
DSIRRTVEKLLEDNRRRNEEILKESEDLLRKNREKTKEIVERAERLLDKLRRERK

SEQ ID NO: 6148 - protein, 57 aa, Artificial Sequence
  Synthetic sequence.
DEAEELKERIERLSRRIDEEYRRLLEDYERLLRELEKKIEDLKRELEKLVEELRREG

SEQ ID NO: 6149 - protein, 55 aa, Artificial Sequence
  Synthetic sequence.
EELKEKVKEIVKRSEEDIRRLKKHLDESIRTAEEVIRRLREKIKRIIDTVRDAKR

SEQ ID NO: 6150 - protein, 57 aa, Artificial Sequence
  Synthetic sequence.
SELEELEKRIRRLSEEIKKLLDDLRREYEELVKELRRRLEELRKEIERLSEELKAEG

SEQ ID NO: 6151 - protein, 55 aa, Artificial Sequence
  Synthetic sequence.
DEMREKVDEIVKRSRDVIKELREHIEESIRRAEKVLRDLEREVRKIIEDARERTR

SEQ ID NO: 6152 - protein, 56 aa, Artificial Sequence
  Synthetic sequence.
REVDELRKEIERLSRKIEDDLKKLEDRYEELLEKLERDLEKLKEDYDRLLRKLEED

SEQ ID NO: 6153 - protein, 55 aa, Artificial Sequence
  Synthetic sequence.
EKAEEDVRRTVTESKKVIDELREHIKKSIREVEEAIKRLREHVERSIRRAEEATK

SEQ ID NO: 6154 - protein, 60 aa, Artificial Sequence
  Synthetic sequence.
SEEEKLDEDLERLREEIRELHRELEELIKKLREEVRRIIEKVRTHLKRDRDRAKEVIEKV

SEQ ID NO: 6155 - protein, 55 aa, Artificial Sequence
  Synthetic sequence.
ERMREKLEKIKKDVDKLSKELHDKLDKVLKEIEELLRDVKRAIKKVNDDIKERLR

SEQ ID NO: 6156 - protein, 61 aa, Artificial Sequence
  Synthetic sequence.
DEIRELVRRFEELVRRNVEHLKKLLRDAEKLVKENEKHLEDLLREIEETVKRLLDKIRREG

SEQ ID NO: 6157 - protein, 59 aa, Artificial Sequence
  Synthetic sequence.
KDKARDVEKRIEDLNREIKEIIRRVEERLKELNKRIEKLLEEVRDTLRRLKEELDRAMT

SEQ ID NO: 6158 - protein, 61 aa, Artificial Sequence
  Synthetic sequence.
SEIEELLKEVERRVRENKKHLKRLLEDIKRLVERNAEDLERILRDAERIVRELIKKIRRDG

SEQ ID NO: 6159 - protein, 59 aa, Artificial Sequence
  Synthetic sequence.
KDKLRRIEKALEDLNREIEEILRRVKEEIERLNREIEELLKRVEEELKRLEKELEEELK

SEQ ID NO: 6160 - protein, 61 aa, Artificial Sequence
  Synthetic sequence.
SEIEELLKEVRKRVKENAEDLKRLLDEAKKLADDNVKHIEDLIREVEDIIRRLKERIKRTG

SEQ ID NO: 6161 - protein, 59 aa, Artificial Sequence
  Synthetic sequence.
KDKARRLREELRKLNEDIERLLKRVEDELRKLNKKIKDILEEVEEVLERLLRELREEER

SEQ ID NO: 6162 - protein, 63 aa, Artificial Sequence
  Synthetic sequence.
REKEELKKELKKLIEELKRSHDELKEELKRLLKRIEDILRENRKTTEDLSRELKKLLEELRKK

SEQ ID NO: 6163 - protein, 59 aa, Artificial Sequence
  Synthetic sequence.
REELKRLLEELRRMIKELKDRNRKALEELEKVIREIEEEIKDINRRLREEIRRLEEEAR

SEQ ID NO: 6164 - protein, 63 aa, Artificial Sequence
  Synthetic sequence.
SKEEELRETLKRLVDEIRRMLEEDRRSDEELVRRIERVLEEDKREDDRLHKRLRDELRRLRKD

SEQ ID NO: 6165 - protein, 59 aa, Artificial Sequence
  Synthetic sequence.
EDELRRLLRELEEMAKKLEKELRDNNRDLRRVAEELKELIDDNTRKLKEVIEKLEREIK

SEQ ID NO: 6166 - protein, 63 aa, Artificial Sequence
  Synthetic sequence.
SEKETVRDELRKLVETIRKLLEEDKESDKRLADRIRELNEENKEDTERLIRELEKVLEELRKK

SEQ ID NO: 6167 - protein, 59 aa, Artificial Sequence
  Synthetic sequence.
EERLRKLLERLERVIRDLLRKIEENNKRLRKAIKELLDELRKINKELREVIKKLLDDAR

SEQ ID NO: 6168 - protein, 63 aa, Artificial Sequence
  Synthetic sequence.
SEKERLKEELEKLSKEIEDILRDDKRSDDELRRRLRELLEKDRREDERLNEELKRMLEEARKR

SEQ ID NO: 6169 - protein, 59 aa, Artificial Sequence
  Synthetic sequence.
EELLRRLLEKLKRMAEKLKRDIEDNNRKLRKVATELAKEIEDNSEKLREDAKRLSEKIK

SEQ ID NO: 6170 - protein, 63 aa, Artificial Sequence
  Synthetic sequence.
DEEEELRKRLEKLSKEVRELLRRDEEEDRRLNRELEELLKDHERTVRDLSREVEDLLRKARRK

SEQ ID NO: 6171 - protein, 59 aa, Artificial Sequence
  Synthetic sequence.
EDELRELLRRLEDVIRKLAEDLKRNTEDLRRVIKELAERLEELNKRLKREIRRLKEELR

SEQ ID NO: 6172 - protein, 60 aa, Artificial Sequence
  Synthetic sequence.
EKSERLRERLRDLLRKHKELLDRNEKTLEEAERRVEKLLEDNERELKKIEDEVRELLKRL

SEQ ID NO: 6173 - protein, 55 aa, Artificial Sequence
  Synthetic sequence.
KEILREIEERFKRLAEDLKRSNDKVRELVDKAEKDIRKSNEELRKLARDVRERVR

SEQ ID NO: 6174 - protein, 60 aa, Artificial Sequence
  Synthetic sequence.
SDEDRLRELLRKLREDHERIVRELRKRLEEVLREIERLLKKNEEDLERIRREVEELLKRI

SEQ ID NO: 6175 - protein, 55 aa, Artificial Sequence
  Synthetic sequence.
EDIEREIRDTLRRLREDLERIKEDVERLRREIKKRIEDSNRKVRDLLRRVKEAVR

SEQ ID NO: 6176 - protein, 60 aa, Artificial Sequence
  Synthetic sequence.
DEERKLEKSLKDVEDTHRRLLEKNDEDLKELRKRVEDMLRRLEDALRRILEDIEEKLKRI

SEQ ID NO: 6177 - protein, 55 aa, Artificial Sequence
  Synthetic sequence.
EKILREVEDLLRKVAEDLKRSNDEVKELAERLEETIRDLLRRIEEILKEIEERVR

SEQ ID NO: 6178 - protein, 60 aa, Artificial Sequence
  Synthetic sequence.
KDEERLKRFLEDIRRRHRELLERNERALDEIRRRHEELLRRNEEAIKDIERRVRELLKRL

SEQ ID NO: 6179 - protein, 55 aa, Artificial Sequence
  Synthetic sequence.
EEILKEIEELLRRLEENLRRNHKEVRELLEKVRRNIEENHREVRRLLEEVERRAR

SEQ ID NO: 6180 - protein, 60 aa, Artificial Sequence
  Synthetic sequence.
DEEETLEDVLRELEERVEKLLRDLTRDLERVEKEHKELLKRNKEAIDEIEKRIEELLKRI

SEQ ID NO: 6181 - protein, 55 aa, Artificial Sequence
  Synthetic sequence.
DEILRKIEELLRRAEEVIRDLERKVRKLERDIRENIKKNHREVREILRKIEEDVR

SEQ ID NO: 6182 - protein, 57 aa, Artificial Sequence
  Synthetic sequence.
KDEERLRELIKRINTEVKKSLDENKERLDKVEEDIRRSLKENEDRMERVRREVEKAN

SEQ ID NO: 6183 - protein, 56 aa, Artificial Sequence
  Synthetic sequence.
IEEIKKRLEDILEETRDMSRRLNEELRRILERVKEVSKELNRELEEILKRVEDARR

SEQ ID NO: 6184 - protein, 57 aa, Artificial Sequence
  Synthetic sequence.
SEKEDLERELEEVRRRVEESLRKNEEDVKRVRDELKKLLDENRKELERIRREVERAN

SEQ ID NO: 6185 - protein, 56 aa, Artificial Sequence
  Synthetic sequence.
MEEIKKEIEKILRDIERVSRELNKKLEEIVRRLKKVSDELNRRIEEIAERVRRRRK

SEQ ID NO: 6186 - protein, 56 aa, Artificial Sequence
  Synthetic sequence.
KDEERLDEELKRVNDEVRRLLARNEETLERIEREVKRLLDENEKRAEDIRKEVEDS

SEQ ID NO: 6187 - protein, 56 aa, Artificial Sequence
  Synthetic sequence.
IEEIEKTIREELKETRKVSEELNRELERILRELRKVSEELNKDLEKILRRVKKERK

SEQ ID NO: 6188 - protein, 56 aa, Artificial Sequence
  Synthetic sequence.
SEEERLREILKDINRRVEELLKENEERMERIREELEELLERLKEELERIRKRVEEE

SEQ ID NO: 6189 - protein, 56 aa, Artificial Sequence
  Synthetic sequence.
VEEIEKDIRRLLRETERVSEELNKKLEEIARELREMIKEIKERLKRILEEVEKRRR

SEQ ID NO: 6190 - protein, 56 aa, Artificial Sequence
  Synthetic sequence.
SEEDELRRLLKEVNERVERLLDEIRKELEKIAEELRDLLKKNEDKLREIKRRVEEN

SEQ ID NO: 6191 - protein, 56 aa, Artificial Sequence
  Synthetic sequence.
TEDIAREIRELMERTRRVIEEIKKELRDILEKLRRVSEELNKKLDEILKRIEDRTR

SEQ ID NO: 6192 - protein, 60 aa, Artificial Sequence
  Synthetic sequence.
REIEKLIRDYRRILRELSEKIRRLAEEHEDIVRKLIETLKRLIDEIRKIMEDLSRLLRRD

SEQ ID NO: 6193 - protein, 59 aa, Artificial Sequence
  Synthetic sequence.
KKLMDELRRVSEEVNTRLEKLLRDLEKKLRDSEERAKELIRRIEKTLEDIDRRLKEEEK

SEQ ID NO: 6194 - protein, 61 aa, Artificial Sequence
  Synthetic sequence.
RELEKLMEDAERYAKRSMEAFEDLIRKHDELLKRLEKKLRDLIKRIEKLLREIKEKIERTG

SEQ ID NO: 6195 - protein, 59 aa, Artificial Sequence
  Synthetic sequence.
EELLKRAKELIETIEERSKRVVDENKRVVERSRRRLKKLLEDIERVLERIERRLTEAKK

SEQ ID NO: 6196 - protein, 61 aa, Artificial Sequence
  Synthetic sequence.
SELEKLLEDIERYVKRSKEKARELIKRHKEYVRRSEERLRRLIEKLEKLAEKLKELIRRTG

SEQ ID NO: 6197 - protein, 59 aa, Artificial Sequence
  Synthetic sequence.
DSLLKEVEDLLRKVEEESRRVIEENKRVVEESRKRSERLLREIEKELRRVEKEFRDEKR

SEQ ID NO: 6198 - protein, 61 aa, Artificial Sequence
  Synthetic sequence.
SELEDLMRDVKRYADESARRIEEIIKRHRKLVREISKKIEELIRELRKLIERILELIRRDG

SEQ ID NO: 6199 - protein, 59 aa, Artificial Sequence
  Synthetic sequence.
EELLDRARKLIREIEERSKELSKRNKEEVDRSEERIRRLLKRAEEELRRVREELKEASR

SEQ ID NO: 6200 - protein, 56 aa, Artificial Sequence
  Synthetic sequence.
SREEEIRELLKRSKESLEKLLRELDKEHKESEKSARELLKRNEKRLREIREEIRRL

SEQ ID NO: 6201 - protein, 59 aa, Artificial Sequence
  Synthetic sequence.
EEVMKRLLKEIRDVNKEITERLEEHRKRLEEINRDVERIIRELNEEHKEVLKRIREKAK

SEQ ID NO: 6202 - protein, 60 aa, Artificial Sequence
  Synthetic sequence.
SEREELRKLLRRIEEEAKRLLEELKRTTDDTRRENEELLRRLEELSKETKKRVEDLLREL

SEQ ID NO: 6203 - protein, 56 aa, Artificial Sequence
  Synthetic sequence.
VKDVLKKLEDVLRELKKAVEKIKRDNKRAVDENRELVERIMKENKDAMKKLEEDVR

SEQ ID NO: 6204 - protein, 60 aa, Artificial Sequence
  Synthetic sequence.
SEREELRDLLRRIKEDAERLLKEHRDLLEEVRKEVEKLLRELRKLSKETEDEAERLLREL

SEQ ID NO: 6205 - protein, 56 aa, Artificial Sequence
  Synthetic sequence.
IKDVLKKLKEVLKKLRDDVEKSKRDTKRVLDRLRDTVRKIMEENRRALKEIADEVK

SEQ ID NO: 6206 - protein, 60 aa, Artificial Sequence
  Synthetic sequence.
DDEERLREEVERVERTVRDLLRRLRELTKKTDEDNRKLLKEHEDLLREVVKRVTDLLKDL

SEQ ID NO: 6207 - protein, 56 aa, Artificial Sequence
  Synthetic sequence.
VKDVLKEIKEVLREVTERAKEIADDNRRALEENEREVKRSKEDTKRALRKLEEEVK

SEQ ID NO: 6208 - protein, 56 aa, Artificial Sequence
  Synthetic sequence.
SSSEELEKLLEEVRRELRRLAEEVKRLNEEIDKDIDRLAEENDRLHKEVKKDLDRL

SEQ ID NO: 6209 - protein, 59 aa, Artificial Sequence
  Synthetic sequence.
EEVVKRILDEIRRTLEEIKEIARRYLEKNKKEMREIRETMKRDNDHLEDLLRKIRETAR

SEQ ID NO: 6210 - protein, 56 aa, Artificial Sequence
  Synthetic sequence.
SDEERIRKKLREIEERHKKLSEELKELLRRSEESVRRLLEKNRKDLDEVRKRIEDL

SEQ ID NO: 6211 - protein, 55 aa, Artificial Sequence
  Synthetic sequence.
EEVERRLDRLLDESRRLAEELKERIKRVNKRARELVRESEEHLRELLEKVERDAT

SEQ ID NO: 6212 - protein, 56 aa, Artificial Sequence
  Synthetic sequence.
SDKDELKTRLDRVREIIERLARESEELHKELKKRLEDLKRDSERLHRKNLEDIRRS

SEQ ID NO: 6213 - protein, 58 aa, Artificial Sequence
  Synthetic sequence.
EVTDRIREDIKRVIEEVRRLAEEDKESVKEILKKIEKLADEDRRSVEKNHKEVEDTRR

SEQ ID NO: 6214 - protein, 58 aa, Artificial Sequence
  Synthetic sequence.
RDEERAEELLKEIKDTVDELKKEVEKVLDESRKRDKKLNDELRKLLEDSRRTIERDVR

SEQ ID NO: 6215 - protein, 55 aa, Artificial Sequence
  Synthetic sequence.
DKLLEELRKILEELRKKVKDLIEEHRRLVKTSADRVKRLLDEHRRILKELKDRRK

SEQ ID NO: 6216 - protein, 61 aa, Artificial Sequence
  Synthetic sequence.
DEAEELIKRIEDLLRELARRMEEILRRHEEYVKKSAEDVKRLLEEVEKLADDLRREVERDG

SEQ ID NO: 6217 - protein, 59 aa, Artificial Sequence
  Synthetic sequence.
EEVARKIEEVLRRVKEELTKLVEENERKLRESRERSKKLAKEVEDLLREIKRRVEELER

SEQ ID NO: 6218 - protein, 56 aa, Artificial Sequence
  Synthetic sequence.
SERETLEELLERVERLLEKLKRELDEAHKKNKEDLDRLRDKNRKRLEDIKRTIDRI

SEQ ID NO: 6219 - protein, 55 aa, Artificial Sequence
  Synthetic sequence.
EELLKELKEVLERIRKEVEKLLRTLEEINKTTRKLVEETNEKADRILEKVKRDAK

SEQ ID NO: 6220 - protein, 56 aa, Artificial Sequence
  Synthetic sequence.
SEDEKMEELIKRSEDKLRKLEEDVRRLLEEIRRRAEDNTRRNERTLREIERTLREI

SEQ ID NO: 6221 - protein, 55 aa, Artificial Sequence
  Synthetic sequence.
EELVRELEKIDRETTEVVKKLLEELKDIMRRVHERSEESLREAKKILREVEERAR

SEQ ID NO: 6222 - protein, 60 aa, Artificial Sequence
  Synthetic sequence.
SEEEELDKLLKEVREKDERLKREVEELLRRIKKRLEELKRENDELLKEVREVLKKLAKET

SEQ ID NO: 6223 - protein, 56 aa, Artificial Sequence
  Synthetic sequence.
VEDVLRRIEEVARRIERLYEELLKKLRDVVREIEKRVREHNEDVKRVVREIEKRIK

SEQ ID NO: 6224 - protein, 56 aa, Artificial Sequence
  Synthetic sequence.
DEVEKVKEEIKRLNEDVRRLVEEYRKRLEKLNRDHRDYVKKSEKRIRDLIREVRRR

SEQ ID NO: 6225 - protein, 59 aa, Artificial Sequence
  Synthetic sequence.
EDATREIDKALEDHRESVERLVRELERLNEENRKSVKKSEEDSRRLLEEVRRELRRKRK

SEQ ID NO: 6226 - protein, 58 aa, Artificial Sequence
  Synthetic sequence.
DEEERVEELLRRDRESDKELRERLRKLNEENRDETEKLIRELEDSLRRLKEELEKKGK

SEQ ID NO: 6227 - protein, 55 aa, Artificial Sequence
  Synthetic sequence.
KELEKELRDNNRRLEEVIRRLEEELKRISEELRKVIKKLKRDNEEKLRRLDEATR

SEQ ID NO: 6228 - protein, 60 aa, Artificial Sequence
  Synthetic sequence.
DEEERVKDINRRNEEDSRRLERRIRELNRENRKSSKELADRVRELLKRAEERLRTEGKDK

SEQ ID NO: 6229 - protein, 55 aa, Artificial Sequence
  Synthetic sequence.
EELVKKLEDINRRLREAIKRLEDTIREINKELRKKIKELLDRLKEIVKRLEDRAR

SEQ ID NO: 6230 - protein, 58 aa, Artificial Sequence
  Synthetic sequence.
SAEERIKRINKKNRDDSEKLKRRIEESNRENKRSSDELVKRLEELLRKLEEDLKRKGK

SEQ ID NO: 6231 - protein, 55 aa, Artificial Sequence
  Synthetic sequence.
KELEKKLRKINEDLKRAIRKLEEDNKRANEELKKRAEDLLREIEEIIRRLEERTR

SEQ ID NO: 6232 - protein, 58 aa, Artificial Sequence
  Synthetic sequence.
DEERRAEEINRRNKKDSDRLAETIEKILKEDEDRDKELHDRLEEILKELRKRLEEEGK

SEQ ID NO: 6233 - protein, 55 aa, Artificial Sequence
  Synthetic sequence.
EELVKELEKINEELRRDIKRLIDEIRENTERLERMIRELEKKIRKILKELDDRAK

SEQ ID NO: 6234 - protein, 55 aa, Artificial Sequence
  Synthetic sequence.
DLEKELTDLMKKHAEENDRLRRRLEELLKRHAEENDRLRDRVRRINEEVEEILRR

SEQ ID NO: 6235 - protein, 59 aa, Artificial Sequence
  Synthetic sequence.
EDVIREALERIKRISDESKRTIDEVVKEIEKITKESRDLITKYERDVERSIEEAERRAT

SEQ ID NO: 6236 - protein, 60 aa, Artificial Sequence
  Synthetic sequence.
SLEERIRELLKRHEDLTRKLKKENDESLRRHRELTKKLRKELEELLKRAEDVLRDLEREG

SEQ ID NO: 6237 - protein, 59 aa, Artificial Sequence
  Synthetic sequence.
AREVDDLLRKIEDISKKSADRNRELNEELEDISRRSKEEMKKLLDELRRDVEEIKKRTK

SEQ ID NO: 6238 - protein, 60 aa, Artificial Sequence
  Synthetic sequence.
DLEDRIRRLLEESKKNLDELKRRNEESLKRSEDLLKDLKRKLDDLLRKAEEVLRELRKRG

SEQ ID NO: 6239 - protein, 59 aa, Artificial Sequence
  Synthetic sequence.
ARDVDRLLEDVKRISDTVHKRNEELNRRLREISERAREAVEDLLRRLEEIVRRIKTRTE

SEQ ID NO: 6240 - protein, 60 aa, Artificial Sequence
  Synthetic sequence.
EEIERILEKLRRDLEEVRKKVKKVLDELRELTEELKRKVEKVLRELKRLSEEIARRVEKG

SEQ ID NO: 6241 - protein, 55 aa, Artificial Sequence
  Synthetic sequence.
RELRTVAREIREELKKLREELDKLLREHRETSKELEKRLKEVLDRHRELSDRLRR

SEQ ID NO: 6242 - protein, 59 aa, Artificial Sequence
  Synthetic sequence.
DELREMIRKVREINERSKDEIRKILEAIKKIVEDHRRVVEKLLRDLKDIVRRARETRSR

SEQ ID NO: 6243 - protein, 59 aa, Artificial Sequence
  Synthetic sequence.
EEARKRLEDLSRENKRSLDELRKRIDDILDENRRAVEESRERAKRVLDEVRETLKRDEK

SEQ ID NO: 6244 - protein, 60 aa, Artificial Sequence
  Synthetic sequence.
SEVDEVEKRIREAIKRHRDRVKKIIDEIKKLLDDHRRRVKKLEDDLKKRADDVRKETKDG

SEQ ID NO: 6245 - protein, 59 aa, Artificial Sequence
  Synthetic sequence.
KEARDRIRELLKKYEDDLRRSEKEIEDILRRYERELRESEKRMREVLKRLEDELRRAEK

SEQ ID NO: 6246 - protein, 60 aa, Artificial Sequence
  Synthetic sequence.
DEVKEVEKKIRKVLREHKKLVEELIRKIKEMIDRHKEIVERIIRTIRRELKRAEELARKG

SEQ ID NO: 6247 - protein, 59 aa, Artificial Sequence
  Synthetic sequence.
EEMEKRIEDLLREYREELERSRRELERLLEEYEKVVDESRKRIKTILDEVEKLLRDLDR

SEQ ID NO: 6248 - protein, 56 aa, Artificial Sequence
  Synthetic sequence.
SSRERFKELSDRNKEVVERSRRRLEKLLEENKREVEKSKKRIEDMLRKADDLLRKL

SEQ ID NO: 6249 - protein, 55 aa, Artificial Sequence
  Synthetic sequence.
ERLSEEIKRLIETHEKLLRELEKKIRDLIRKHREDVERIIKEIDKLLKKIDEDTR

SEQ ID NO: 6250 - protein, 57 aa, Artificial Sequence
  Synthetic sequence.
SEEETLDELNRENEELLRRSKERLDRSHEKLKKILDDISERVKELLKRAEKLLRDEN

SEQ ID NO: 6251 - protein, 56 aa, Artificial Sequence
  Synthetic sequence.
KDRVSDRIRRLLEEHERVVRELLESNDRMAERLRRVAEELVKEIKKELDDLRRRTT

SEQ ID NO: 6252 - protein, 56 aa, Artificial Sequence
  Synthetic sequence.
SEEETLERLLRKNEEELKKSKERLKELNRTNRKELRDSERRIKRALEEVEDLIRRE

SEQ ID NO: 6253 - protein, 56 aa, Artificial Sequence
  Synthetic sequence.
KDEVTKTIERIIEEHRRMIEELIKEIRKLIKEHRDKVRELLKRIKDILRRLKEERR

SEQ ID NO: 6254 - protein, 61 aa, Artificial Sequence
  Synthetic sequence.
SLDERIDELRRTLEEMLDRIRRSNEEVLRDSRRVLEEIDERARRVVEEAEKLLREIDKRKG

SEQ ID NO: 6255 - protein, 59 aa, Artificial Sequence
  Synthetic sequence.
EEDIKRLLEKVREIIEELKRRNDELNKRIKDLSEEMRRRVKKLLDEIKEDLERIKRRAD

SEQ ID NO: 6256 - protein, 61 aa, Artificial Sequence
  Synthetic sequence.
SLEEEIKELIKRAEEVLERLARSNKEVLDRSRKVLKELRETNKRLLEELKRALDKIRKDKG

SEQ ID NO: 6257 - protein, 59 aa, Artificial Sequence
  Synthetic sequence.
EEDIKRLLEEVERIIRKLAEENKKLNKEIEDLSRRARERNERLLREVEKIIRDIRERAR

SEQ ID NO: 6258 - protein, 58 aa, Artificial Sequence
  Synthetic sequence.
SEVEELTKKAKKIIEDHRRYVEKSARDVERLIREHERYVEESAKKVEKLLREIKELDK

SEQ ID NO: 6259 - protein, 56 aa, Artificial Sequence
  Synthetic sequence.
KDKIRELERENEEVIKESRERSERLARKNKKVLEDSERRSRELSERVERLLDESRR

SEQ ID NO: 6260 - protein, 56 aa, Artificial Sequence
  Synthetic sequence.
REEDVLRKLEKEIRDLLERIKRKSEELIERNKRTNDDIRRRSKETIDELRELTKRV

SEQ ID NO: 6261 - protein, 56 aa, Artificial Sequence
  Synthetic sequence.
DEDIRREAERLLREMEKRAKENEEDVRRNLKRLRDALKEHKEKVEKLLEEIKKDAK

SEQ ID NO: 6262 - protein, 56 aa, Artificial Sequence
  Synthetic sequence.
SETDDIIRRIRRLIEELLRNSKRTSDDNRRTLEELERNSERAIKKIKDVLEKLSRD

SEQ ID NO: 6263 - protein, 55 aa, Artificial Sequence
  Synthetic sequence.
EKAEKIRKELEDMARESRKLMRENKREVDRVEKKSRKLLKDILDEIDKVDEDEKR

SEQ ID NO: 6264 - protein, 57 aa, Artificial Sequence
  Synthetic sequence.
SEAERIAREVERVLREIEEEVKRLSEENRELVERIERESRKSIEDIERRLEEVKRKV

SEQ ID NO: 6265 - protein, 56 aa, Artificial Sequence
  Synthetic sequence.
RRLLEALRREVEEVLKRIRETLEENRRRNEEVLRRDKELLERIRDKIRRVLEELKR

SEQ ID NO: 6266 - protein, 60 aa, Artificial Sequence
  Synthetic sequence.
DEERELRKLERELEDVVRKDRKILEDLRRTLDTVRREDERILRELEETLKEVVKRVREKG

SEQ ID NO: 6267 - protein, 56 aa, Artificial Sequence
  Synthetic sequence.
IRRISEEAKELLKRWEDESRKVEEEHRRSLEEWRERSERIAREHKKSLEKLEKDVE

SEQ ID NO: 6268 - protein, 56 aa, Artificial Sequence
  Synthetic sequence.
SIEELLKKLEEDIERVLRKSEELLKRNEEENKKVLDESKRLLDELKKRAEKVLREL

SEQ ID NO: 6269 - protein, 59 aa, Artificial Sequence
  Synthetic sequence.
EEVLKEIVKRVRDDIERHDRESKKLSDENKRVVDEHRKRSEELARKLEELLREIRERVT

SEQ ID NO: 6270 - protein, 59 aa, Artificial Sequence
  Synthetic sequence.
SDIEKLAEEVDRLNKELTDRLERLREEHKRTLDEIRKTLEKLKREVDKELEEVKKIVKD

SEQ ID NO: 6271 - protein, 59 aa, Artificial Sequence
  Synthetic sequence.
ERVKKILDDLKRKNEENDERVERIMRELRERNRKLNEEIDKIVEDIRREVEKVSREARR

SEQ ID NO: 6272 - protein, 59 aa, Artificial Sequence
  Synthetic sequence.
DAVDRVREENKKDSERNKKRVEDVKRRAEERSRRNKKKVKELRDRNREEIKRIKELKDR

SEQ ID NO: 6273 - protein, 56 aa, Artificial Sequence
  Synthetic sequence.
RKVEEESRRSFKRNKEENKKVRDEIKKTIEENEAENRKAHEDSKRSFEELEDELRK

SEQ ID NO: 6274 - protein, 60 aa, Artificial Sequence
  Synthetic sequence.
DKEREATRRLRELEKENTKLVKEIRDADREIEKRLREIHKKLEDENRKLEEEIKDMVRRK

SEQ ID NO: 6275 - protein, 54 aa, Artificial Sequence
  Synthetic sequence.
RIVEEVKKHHERNERRLREYLDESRKYLEDHIRRLEKYLEDSRRLATRIKEETK

SEQ ID NO: 6276 - protein, 57 aa, Artificial Sequence
  Synthetic sequence.
SSVEEVKRKNEKSLREIERASEEHLERLKRELEKSEDEARKHNKKLDDDLERLERKG

SEQ ID NO: 6277 - protein, 58 aa, Artificial Sequence
  Synthetic sequence.
ERVKDLERTHEESKRRVEELMKENDDLLKRIEEESKRLNEENERKVEDIEKKVEDLKR

SEQ ID NO: 6278 - protein, 59 aa, Artificial Sequence
  Synthetic sequence.
SEIERVAKELKDEADRLRKEVEKHRRRSKEELDRLREESKKVNEDLKRMLERIREIAAQ

SEQ ID NO: 6279 - protein, 58 aa, Artificial Sequence
  Synthetic sequence.
EEFKKLRDLIEDIKRRLEELVKALEETNKKIEDDVRDSVRKNRETLERIKKEIEDTAT

SEQ ID NO: 6280 - protein, 61 aa, Artificial Sequence
  Synthetic sequence.
KDVERILREIRETLRRVEEEAKRSNDEIRKLNEEAERIVREILKEIEKELREVRKRLTEKG

SEQ ID NO: 6281 - protein, 59 aa, Artificial Sequence
  Synthetic sequence.
DELLRRLKEELDRVERTIRELIRRNEEVLERSDESVEKLLRELEELLRRVEEEIKKAAT

SEQ ID NO: 6282 - protein, 60 aa, Artificial Sequence
  Synthetic sequence.
SEREERAKRLRKILEDLKRESEEHLRRLKTRLDKLREDSKKHLEDVRRKLEDLKRIVEEN

SEQ ID NO: 6283 - protein, 55 aa, Artificial Sequence
  Synthetic sequence.
DELRKLVRKVEEDLKRLDEENKKLLEKVKRDLDRLKKENKDLLKRVEEELRREAT

SEQ ID NO: 6284 - protein, 60 aa, Artificial Sequence
  Synthetic sequence.
SEEEERKRRLEEKLERLEEKSRRHLKEVKRTLEELEERSRRHLDENRRLLKRLKEIVDRN

SEQ ID NO: 6285 - protein, 55 aa, Artificial Sequence
  Synthetic sequence.
EEIKKLVKDIKEELKRLLEENKRLLEEAKKTLKKLLEDNRRLIEKIKKELDEARK

SEQ ID NO: 6286 - protein, 60 aa, Artificial Sequence
  Synthetic sequence.
REEERLKRELEKDLERIKKLSDEHKKRLEEENRDLRRKSREHKEKLERDLRRVEEIRRRE

SEQ ID NO: 6287 - protein, 55 aa, Artificial Sequence
  Synthetic sequence.
DEVERLLKEIEDRVRKLEKENEEIARRSTETLEKLLKENRETLKEIRDRVREAKR

SEQ ID NO: 6288 - protein, 60 aa, Artificial Sequence
  Synthetic sequence.
SEEEELKRRLKEILRELKELSERHKKRLRELNEKLKRLSEEHKRKLEEITEDLRRIATRE

SEQ ID NO: 6289 - protein, 55 aa, Artificial Sequence
  Synthetic sequence.
EEVKRLLDEIRRELERLKEENRKIVEDSTRTLKELLEENKRILEESSRDLERLKR

SEQ ID NO: 6290 - protein, 60 aa, Artificial Sequence
  Synthetic sequence.
SEEEKIKEEIKRDLEDLRRLSKEHKDRLRKLLEDIKKLSEEHKDKLRRITKELRDVVRRE

SEQ ID NO: 6291 - protein, 55 aa, Artificial Sequence
  Synthetic sequence.
EEVKRLLEKVKEDLKRLLDENKRIIERIEREVERLKRENEEILKESSRDLERAKK

SEQ ID NO: 6292 - protein, 60 aa, Artificial Sequence
  Synthetic sequence.
SKEEKLKEDLKRTLDDARRLAEETKRRLEEILEKLKRLSEKSKEDVKRTTDELRDIVRKR

SEQ ID NO: 6293 - protein, 55 aa, Artificial Sequence
  Synthetic sequence.
EEIKDLLRRIREELKRLKDELRRIIEEIRKELERLKRENEELNRRSSEELKKAKK

SEQ ID NO: 6294 - protein, 57 aa, Artificial Sequence
  Synthetic sequence.
SEVEELLERHKRALDKAKKVSEDHKRDLKEKLDDVKRKVEELERRLKRALDELTKEG

SEQ ID NO: 6295 - protein, 59 aa, Artificial Sequence
  Synthetic sequence.
EDLVRTLDELHKDIERRLRKLEEENRDILRRIREEIERLKRKLDEIARRIKEEVKKLKK

SEQ ID NO: 6296 - protein, 57 aa, Artificial Sequence
  Synthetic sequence.
SEVEELKKEHKKVLDEVRRASKKHKEELEEMLRDLKRKADELARRLEDALRRLEEEG

SEQ ID NO: 6297 - protein, 59 aa, Artificial Sequence
  Synthetic sequence.
KKAVDELRELHKEIKRRIEKLLKENEEILRKIEEDIERLLEDLRRKAEEIKRRVDETRR

SEQ ID NO: 6298 - protein, 57 aa, Artificial Sequence
  Synthetic sequence.
SEVEEIEKENKDAVRRMREKSRRHKEELKDALREAEEISRRHKEELKRKLEELTKRG

SEQ ID NO: 6299 - protein, 59 aa, Artificial Sequence
  Synthetic sequence.
EELVRKLRRLDKRTHEDVRRLLDENRRTLEKIEEDIRRLIKENEDTLREIEKRVEDKKR

SEQ ID NO: 6300 - protein, 59 aa, Artificial Sequence
  Synthetic sequence.
SEDEELKKEIEKLLRELRKRSTESKKEIEDLLDELRRKSERSRKEIEDTLRELEERAKG

SEQ ID NO: 6301 - protein, 55 aa, Artificial Sequence
  Synthetic sequence.
EEIKELLERLRRDAERLKKENEDLNRRLREEVEKNKEDNKRLNEELRKKVEEDRR

SEQ ID NO: 6302 - protein, 61 aa, Artificial Sequence
  Synthetic sequence.
SLEETLDKILEDIRRRIRENEERNRRLKEEIDKAIKRNEEENRKTNEDIKRKIDDLERKRG

SEQ ID NO: 6303 - protein, 59 aa, Artificial Sequence
  Synthetic sequence.
KKEVEELIRELEDELRKLEERSKEHLDRLREELKELDERSKKHLDELRKLEEKLRRDAD

SEQ ID NO: 6304 - protein, 60 aa, Artificial Sequence
  Synthetic sequence.
SETEKLLERIRRNVEENEKYAREHLKKLDKNLKDNKEYIDRHVKKLKERLDTLREIAREK

SEQ ID NO: 6305 - protein, 55 aa, Artificial Sequence
  Synthetic sequence.
ERIEKLLRELERTHRELKEELDKLHKRLEEEHRRLEKKLRDIHRKVEKDLRDLKR

SEQ ID NO: 6306 - protein, 60 aa, Artificial Sequence
  Synthetic sequence.
EEKERLKKRIRDNVEENKKYAEEHLKRLKEKLEEVRKYIEDHKDRLRRKIEELKKDAERK

SEQ ID NO: 6307 - protein, 55 aa, Artificial Sequence
  Synthetic sequence.
EEIRRILEELRRTHKKLEEELEELHKRVEDELRRLEDELREIHERLEETLRRLRK

SEQ ID NO: 6308 - protein, 60 aa, Artificial Sequence
  Synthetic sequence.
SEKEKLKEEIKRNVEENRRYVEEHKRDLERNAEENEKYIREHLKRLKEEAEEVRDRVAKE

SEQ ID NO: 6309 - protein, 55 aa, Artificial Sequence
  Synthetic sequence.
KEIERLLRELERTHRELRKDLKRIHDELKKKHDDLRRTLEEVHKRVKEELDRARR

SEQ ID NO: 6310 - protein, 60 aa, Artificial Sequence
  Synthetic sequence.
SEKEELIERIRRNLEENRRYIERHLEELEKKLDDVRRKAKRHLEKLREELEKLKDDARKK

SEQ ID NO: 6311 - protein, 55 aa, Artificial Sequence
  Synthetic sequence.
EEIRKLLEELRKTHEKLKRDLERLHKKVRDTLKKLEDELKELHKRVDDELRKLRK

SEQ ID NO: 6312 - protein, 60 aa, Artificial Sequence
  Synthetic sequence.
DEERKLEELEKENDKLLEDAKRTLEKLLKDNRDLVKRVEDELRRLEEENKKLADDVRRDG

SEQ ID NO: 6313 - protein, 56 aa, Artificial Sequence
  Synthetic sequence.
SKELEDRSREHLERLKARLKELEDKSRKHLEEVKKELRELEEKSKKHLKRLEDARR

SEQ ID NO: 6314 - protein, 60 aa, Artificial Sequence
  Synthetic sequence.
DEEETLKRLDEENDKLLEEVKKTLEDSLRRLEELHKRTEEELRKSRRELRELVKDVERKG

SEQ ID NO: 6315 - protein, 56 aa, Artificial Sequence
  Synthetic sequence.
KEELRDKSRRHLEDVKRRLEELKKSNEEALRRDEKKLEDLRRSNEKVLRELKEKAR

SEQ ID NO: 6316 - protein, 60 aa, Artificial Sequence
  Synthetic sequence.
SEEEEVRRLEEELKKLHDDIKRRLEELLRENEKILRDIDREIKKLLEELRKTIDKADKDG

SEQ ID NO: 6317 - protein, 56 aa, Artificial Sequence
  Synthetic sequence.
KDELRKIVEELKRDHEKDLRKVEKLSEEHKEKLRRALEELKRLAEEVKKRLDDERR

SEQ ID NO: 6318 - protein, 59 aa, Artificial Sequence
  Synthetic sequence.
SVEERLEEMERRNKDLIRRVEEDLERLLKENRDLIRRIKEELKRLKEELKELVERISRE

SEQ ID NO: 6319 - protein, 59 aa, Artificial Sequence
  Synthetic sequence.
EEVLKELEEENRKHEKRLRDALERLRRRSKKHKDEARKILEELKERAKTIKRRLEEDRR

SEQ ID NO: 6320 - protein, 60 aa, Artificial Sequence
  Synthetic sequence.
SVKEDLRKAKEENKRLIEKAEDDLRKLLRENKELLKRIDEELKRLKKELDDIVRRIEDKG

SEQ ID NO: 6321 - protein, 59 aa, Artificial Sequence
  Synthetic sequence.
EEVLEKLKRDNEDHKRRLKEDLRRLREESKKHKKKLEDRLKKLEERARRIKEKLKEEER

SEQ ID NO: 6322 - protein, 62 aa, Artificial Sequence
  Synthetic sequence.
DDEERIRKIAEDIKRKLKETLERLRDESRKNKRKLEDLLRKSEEKAKRLKDKLRKMEEEKER

SEQ ID NO: 6323 - protein, 55 aa, Artificial Sequence
  Synthetic sequence.
EDVKRLLRELKEITDRIDEEVKRLREENERITRRIEEEHKRLNKELERILREIER

SEQ ID NO: 6324 - protein, 57 aa, Artificial Sequence
  Synthetic sequence.
SSEEKAKELRKRLRETHKRVKDEIKRLKEELEESHKRLEERSRETLRKLEELIKELN

SEQ ID NO: 6325 - protein, 56 aa, Artificial Sequence
  Synthetic sequence.
DTELEKDVRRVEEKNRRALEDVRRKVEEVKESNKRALEKNERIVREVERRLREEKK

SEQ ID NO: 6326 - protein, 57 aa, Artificial Sequence
  Synthetic sequence.
SSEERFEKLDRELKRTHEELERAIRELKKDYERSLKRVEEELKRLLDELEELARRVG

SEQ ID NO: 6327 - protein, 56 aa, Artificial Sequence
  Synthetic sequence.
DTKVTETVRRVREENKRMLEDVKRDVDRLRTSNEKVLRDIRRTVKRAKERLKELKE

SEQ ID NO: 6328 - protein, 60 aa, Artificial Sequence
  Synthetic sequence.
SAEDELRRLRRELEKSHEELKRRIDELLKRLRELVKRVKDRSKELLDELRKLLEDVKRKG

SEQ ID NO: 6329 - protein, 56 aa, Artificial Sequence
  Synthetic sequence.
DTRVRERVKETRRRNEEVLREVERIAKEVEDDLKRILEELEDNVRRVKKKIKDVER

SEQ ID NO: 6330 - protein, 60 aa, Artificial Sequence
  Synthetic sequence.
SSEEELKKLEKELEETHRKLKEDVERLLRDLDRKVKKVEDDSKKLLDELRKLLEEAKRRG

SEQ ID NO: 6331 - protein, 56 aa, Artificial Sequence
  Synthetic sequence.
ERDVRKRVKEMKEDNRRALEDIRRKTEEVAKKLREILKKLRENVRRVAEEIKRVAD

SEQ ID NO: 6332 - protein, 60 aa, Artificial Sequence
  Synthetic sequence.
STEEELERLRRELERTHERLREESEKLVRELRKLVEEVREALERLRRDLKRLLKEVREKG

SEQ ID NO: 6333 - protein, 56 aa, Artificial Sequence
  Synthetic sequence.
ETEVREEVKRTKEENKRVEEKLRRNVDEMRKKLEEILRRIKEEIDKMRRKIEEIER

SEQ ID NO: 6334 - protein, 60 aa, Artificial Sequence
  Synthetic sequence.
DVEEDLKRLEKKNRDLNKRMEDSNRKLEEDDERVNRKIRKDHKKAEDDLRRVIKEVEEEN

SEQ ID NO: 6335 - protein, 55 aa, Artificial Sequence
  Synthetic sequence.
EKTIEDIERHLDRLRKENDKLRKELEDHIRRLEEEVRKNLDRIREEIERARERVR

SEQ ID NO: 6336 - protein, 59 aa, Artificial Sequence
  Synthetic sequence.
RAEDEVRKIKKEIDELIRRLEKLNEDIKREIDELVRRLEELNKRVKEEIKRLIEELKKE

SEQ ID NO: 6337 - protein, 56 aa, Artificial Sequence
  Synthetic sequence.
DRELKERLDRMRDHARKHEEKLKESLKRVREHVKRHAERVEESLRRLKRDVDELRK

SEQ ID NO: 6338 - protein, 57 aa, Artificial Sequence
  Synthetic sequence.
SSDEKLEEIERHHRKVEEESRRLDEDIKRHHKEVEDESRELLERIKKKLEDVTRALG

SEQ ID NO: 6339 - protein, 55 aa, Artificial Sequence
  Synthetic sequence.
DEILEKLERDNRRYKEESEEEVERAKEENRRYLEESRREVEEFDRKLKEIADRAR

SEQ ID NO: 6340 - protein, 57 aa, Artificial Sequence
  Synthetic sequence.
SELEERVKKVEKVNEDLKRRVEEHERRVKRTLERLEEEVRRHAEKVKKRLEELRRLA

SEQ ID NO: 6341 - protein, 59 aa, Artificial Sequence
  Synthetic sequence.
ERIEDLLRRLDDRNRETEREIEERHKRLKEELDKVEERIRREHEKLKRELEEVERRTRK

SEQ ID NO: 6342 - protein, 60 aa, Artificial Sequence
  Synthetic sequence.
DVVDELRRIAKEVRDRLREIVERLDRIAKEVVKENEEVVRHNDELAKRVVTTAKRIVDEV

SEQ ID NO: 6343 - protein, 58 aa, Artificial Sequence
  Synthetic sequence.
EEVKRVVETVRKLLRDAEKEIEEVVKKVRDLLRRVNKELKESVERVRRLLEEVRERAR

SEQ ID NO: 6344 - protein, 61 aa, Artificial Sequence
  Synthetic sequence.
SDLDRVLRKIEELVREIEKESERTNRKSERDTEEVARRSEDSDRDIERLVREIRDRLRKAG

SEQ ID NO: 6345 - protein, 59 aa, Artificial Sequence
  Synthetic sequence.
KDVVRELEEIVKELEERAKENVKRSEKSVKEDLDVLADNVRRSKEIVEEIKKRADEVVT

SEQ ID NO: 6346 - protein, 57 aa, Artificial Sequence
  Synthetic sequence.
SEKEKVIKEARELLERLRKRLKDVNDDVTRLLDELRKENEKSREDVEREVKRLEEEV

SEQ ID NO: 6347 - protein, 56 aa, Artificial Sequence
  Synthetic sequence.
AEELKRVADRLRRRLERLVEENERVVKKILDEIRRSVEENKRIVDKVRKDLDERRK

SEQ ID NO: 6348 - protein, 57 aa, Artificial Sequence
  Synthetic sequence.
DEDEKVLRKIEELVRRLHEKNRKVLEESKRTLEKVEERLRRVLKEIEDLVRDAARRV

SEQ ID NO: 6349 - protein, 56 aa, Artificial Sequence
  Synthetic sequence.
VSELDKIIKELKREADESVKKLKEIVKRSLDHLEEVVKELKKRLDDLKREIDTKAK

SEQ ID NO: 6350 - protein, 59 aa, Artificial Sequence
  Synthetic sequence.
SLEEEVKKVVEEIKRRIEDDVRRIRELVERIKKLIEKDVTDLKRVVDENRDLAEKAKRI

SEQ ID NO: 6351 - protein, 55 aa, Artificial Sequence
  Synthetic sequence.
EELLRELRRVLEEAREDSRRLLEEIRKVLEEAEEKSRRVLEESKRVNDELRERLR

SEQ ID NO: 6352 - protein, 59 aa, Artificial Sequence
  Synthetic sequence.
SLDESAKRVLEEIKRLAKEDLDELKRVLDEIKEILREVLEANRDSVRRIEEEVEKLARV

SEQ ID NO: 6353 - protein, 55 aa, Artificial Sequence
  Synthetic sequence.
DRVLEEIERVIRKIEEDSRRLLKEIADVIKKVREESKRLLDDLKRVIDELRERAR

SEQ ID NO: 6354 - protein, 59 aa, Artificial Sequence
  Synthetic sequence.
SLEEVLDRVRRESDKVRKTLERVKEEVERVSREVVEDLKRVEEEVRRLIERVKDILRRS

SEQ ID NO: 6355 - protein, 59 aa, Artificial Sequence
  Synthetic sequence.
EELIRDVLREAERLVKESLDDIRRLLDEVRRLVEESRRNIERLLEEVRRLVEEIERAAE

SEQ ID NO: 6356 - protein, 60 aa, Artificial Sequence
  Synthetic sequence.
DKVDEVLKRVKRVVEEIEDRVRKLNKEVRDVVKRIEELAREVLDHSRKVVEEIKKTAEDR

SEQ ID NO: 6357 - protein, 56 aa, Artificial Sequence
  Synthetic sequence.
EEVVRTVKEELDKALEKAERVLEHSRRMLERVLKEAKRVLDEVKELNKRVIDEVRR

SEQ ID NO: 6358 - protein, 56 aa, Artificial Sequence
  Synthetic sequence.
SVEDVAREVDKLLKRANEESKRVLEEVERLLRTVSRELEKVIRDVKKLIDDVEKRV

SEQ ID NO: 6359 - protein, 59 aa, Artificial Sequence
  Synthetic sequence.
SETAEKVLRDVERIVRRNEELVREVLRRVKKIVDENRKIAEDALRKVEELVKELEERAR

SEQ ID NO: 6360 - protein, 59 aa, Artificial Sequence
  Synthetic sequence.
SEAEEALERVKELVKRSEELAEESLRRARKSVEEVARRAEEALERVKKSVEEVKEVRKE

SEQ ID NO: 6361 - protein, 56 aa, Artificial Sequence
  Synthetic sequence.
KEVLDKVRDLVRRVDEENRRVIEEAKKLSEDVARRVDKVIKDVERLSKRVEDEVRR

SEQ ID NO: 6362 - protein, 58 aa, Artificial Sequence
  Synthetic sequence.
DEDRRAVEELRRVVEEVNKLNEDTLRELERIVRENIRRVRELLKEAEDVVREVEKEVR

SEQ ID NO: 6363 - protein, 55 aa, Artificial Sequence
  Synthetic sequence.
EEVLREAKDLIDHVRKTIEEVNDTVRDLVRKVHEVNKEVLDRIRKLVEEVRKTVE

SEQ ID NO: 6364 - protein, 61 aa, Artificial Sequence
  Synthetic sequence.
SSLDRVRRAIEELVKKVNTDSKRVKDRVRKLLKEVNDTSDRVRRDVKRKLDKVKDDARKAG

SEQ ID NO: 6365 - protein, 59 aa, Artificial Sequence
  Synthetic sequence.
DRVVERVVREVERIVRENEELVKEVVRRAEEIVERNERHSRELLRRLAELVDDLRRKIE

SEQ ID NO: 6366 - protein, 61 aa, Artificial Sequence
  Synthetic sequence.
SSLDEVRKRVTELLKKVDDTSKKVEDDVKRLLDKSTRTSDEVRKAAERLLEEVEESARRKG

SEQ ID NO: 6367 - protein, 59 aa, Artificial Sequence
  Synthetic sequence.
DEMVKRVLEELKKIVDDLERHSRKLLKDARRIVEESIEHSDRVLKEATRIVEKLERDIR

SEQ ID NO: 6368 - protein, 59 aa, Artificial Sequence
  Synthetic sequence.
DEIEEVLREMRELVERNVREIEKVVRENEKLVEDNIRLVREVAKELRDLVRKLIERVAR

SEQ ID NO: 6369 - protein, 58 aa, Artificial Sequence
  Synthetic sequence.
EELEEVVKEARRLLKKSEEDLRRVEKRVEELNEKSKEEMERVRDDVRRLLEEVKERAR

SEQ ID NO: 6370 - protein, 60 aa, Artificial Sequence
  Synthetic sequence.
SEVDELLRLADEIVRELRELVRRHDEIVDKLVEENRRIVEEHLRRVEDVVRRLKELVKKI

SEQ ID NO: 6371 - protein, 58 aa, Artificial Sequence
  Synthetic sequence.
EEAERVVKEARRLLREIEELVKRSVERVERLHREVHERIKESTKRVEELVDEVRKAVK

SEQ ID NO: 6372 - protein, 60 aa, Artificial Sequence
  Synthetic sequence.
SAVDEVRKVIKEIFDRLAELLKHNSDMVRRLLEEIRELVKNNTEIVREVLKKLEDILREL

SEQ ID NO: 6373 - protein, 59 aa, Artificial Sequence
  Synthetic sequence.
EEKLEKVAEDARRAIKDIEDKLRDSNRRLDKLIKEVRRRLEESHKRIEREIKEIEERVR

SEQ ID NO: 6374 - protein, 61 aa, Artificial Sequence
  Synthetic sequence.
DKLDEVKEAARRVVEEAHKKNRRVLEKLDEVSRRAHELDKRVKEKLKEVVKRADDLLKEKG

SEQ ID NO: 6375 - protein, 60 aa, Artificial Sequence
  Synthetic sequence.
VDTLVERLRRLVEELRKHSDDTVRRMEDIVRRNKKHSEESVRKMDDIVKKLEELAREVVR

SEQ ID NO: 6376 - protein, 61 aa, Artificial Sequence
  Synthetic sequence.
DRLDKVKEDLKRSSEDAHRKNKEAIELLDEVSTEAHKLDEDVRRKLEKVVREVRKLLEDKG

SEQ ID NO: 6377 - protein, 60 aa, Artificial Sequence
  Synthetic sequence.
IDTIVRDAEKIVEDNRRHSDETVRRIERLVTENLRHSEESVRTLDRLVEELLRTAEEVVR

SEQ ID NO: 6378 - protein, 61 aa, Artificial Sequence
  Synthetic sequence.
DKLERVLRELERSSKEAHEKDKKVLEDLDEVSKRAHKANEEVIARLEDVVRKAEDELRKKG

SEQ ID NO: 6379 - protein, 60 aa, Artificial Sequence
  Synthetic sequence.
LDTLVKRIEDIVKENEDHSRRSVEEIRRIVEENERHSRESVKTIKDLVEELERRAEEVVR

SEQ ID NO: 6380 - protein, 61 aa, Artificial Sequence
  Synthetic sequence.
SELEKVLKDLEESSKEAHKADEEVLRRLERVSREAEKELKRVLDDLRRVVEEVERLLREKG

SEQ ID NO: 6381 - protein, 60 aa, Artificial Sequence
  Synthetic sequence.
LETLVRDARRIVKENEEHSRDSVRRIDKIVKENADEVRRVVKEIKDIVKRLEELARETVR

SEQ ID NO: 6382 - protein, 56 aa, Artificial Sequence
  Synthetic sequence.
SLDEDVDELVKRVEEEMRRNVKELDKLVKEDKRLAEENVRRLEEIVDRSRKLADRK

SEQ ID NO: 6383 - protein, 55 aa, Artificial Sequence
  Synthetic sequence.
EEVLKRLREVIERARRDSERVLRKLEKTTDKVRRDSERVLRENEKSIEDVARKMT

SEQ ID NO: 6384 - protein, 61 aa, Artificial Sequence
  Synthetic sequence.
DELERLLEELKRTTRKIEEELKEVNRRLDDTTREAEKELRRLKEKLEEVVKRAEELLRRRG

SEQ ID NO: 6385 - protein, 60 aa, Artificial Sequence
  Synthetic sequence.
EKDVVKRLEDLVRDDDRIAKEDVKRLEDLVREDRTLVKEIVDRLEELVRTVEKLVKEVVN

SEQ ID NO: 6386 - protein, 56 aa, Artificial Sequence
  Synthetic sequence.
SAIEKVKEVVERVLETVRDSVRRSHEESKRLIDKVRKRLEEVREEVKELIERVRRK

SEQ ID NO: 6387 - protein, 59 aa, Artificial Sequence
  Synthetic sequence.
KDAVEDVLRRIEELIRDLNKKNDDNVRRVKEVIDRAEKLVRDLLREIRKLIEKLIRDTE

SEQ ID NO: 6388 - protein, 57 aa, Artificial Sequence
  Synthetic sequence.
SVLEEVRRRVEELLKTVKESVDRSHERSERLIEEVRESLKEVKRRVKELVERVREKG

SEQ ID NO: 6389 - protein, 59 aa, Artificial Sequence
  Synthetic sequence.
DKVARDVLEEIERLIREANERNKRNLEDVERVIRELNKENERVLREVEKKIEKLIRETE

SEQ ID NO: 6390 - protein, 57 aa, Artificial Sequence
  Synthetic sequence.
SSIERVEKEVRRLLRESDESLKRVMEEAKELIKSVRESTKRVEEDARDLLRKVVERT

SEQ ID NO: 6391 - protein, 59 aa, Artificial Sequence
  Synthetic sequence.
EEEVERVLEEVRRIIEKLKEDDKRSLERIERIVRRNNELNKESVDRIRKIIKEMEERAD

SEQ ID NO: 6392 - protein, 57 aa, Artificial Sequence
  Synthetic sequence.
DESEDVEEKMRRLLEKSKDETRRVKEEVERLNEESKRVTEEVEKRVRDLLREVREKV

SEQ ID NO: 6393 - protein, 56 aa, Artificial Sequence
  Synthetic sequence.
VETVLREAKRLIEESIERIERVLKENRELAERSIKVLRDVLREVEDLIRKLEERAK

SEQ ID NO: 6394 - protein, 56 aa, Artificial Sequence
  Synthetic sequence.
RKVEEVKKEAERLLRRSEEVSKKVADDADRLLKRSREVSDRVRRESERLLKEVAEA

SEQ ID NO: 6395 - protein, 59 aa, Artificial Sequence
  Synthetic sequence.
DKRVEDVLREARDLVRRSIKKIDEVLKEAKRLVEESIKLSEDNVRRNEEIIRDLERRTR

SEQ ID NO: 6396 - protein, 56 aa, Artificial Sequence
  Synthetic sequence.
SAVERVKEEVDRLLERSKKESERVRKESEDLIRESDEVSRKVEEDSRRLIEEVERS

SEQ ID NO: 6397 - protein, 59 aa, Artificial Sequence
  Synthetic sequence.
ERVVTRLLEEAKRLVERSIEEIKRNVKENRKLVEESIKLSEENVKRNKRLVDEAIRAAE

SEQ ID NO: 6398 - protein, 61 aa, Artificial Sequence
  Synthetic sequence.
SVVEEVVERVKRIAEELKRSSEENVDTVRKVVAEAKKLVEDDVREVEKLARRLKEVVTRDI

SEQ ID NO: 6399 - protein, 59 aa, Artificial Sequence
  Synthetic sequence.
ERVLKDVKDKADKLIREVEETSKRSEEDVRKVIEEVREVLRESHERVKELIKEVREAER

SEQ ID NO: 6400 - protein, 60 aa, Artificial Sequence
  Synthetic sequence.
SEAEKVAEDARKLAEEVIRLIEEVVERSKELVDRNEKEIRRVIEESDKLVEEVIRLLRRG

SEQ ID NO: 6401 - protein, 58 aa, Artificial Sequence
  Synthetic sequence.
ESVREVEKIVRDVVREIREMLKRSKDETRRVIKRVREVNDRSEKRSRDVVREARETSR

SEQ ID NO: 6402 - protein, 60 aa, Artificial Sequence
  Synthetic sequence.
SEAEEVARRARKLVRELEELIRKSVEDSRELVKRNIEKIKRNVRKSEEDVDRVIKLLRRG

SEQ ID NO: 6403 - protein, 58 aa, Artificial Sequence
  Synthetic sequence.
EAVREVDRIVKEVVRRVREALERSREETRRVIEEAKKANKESDDVSRKVAKEIDEEAT

SEQ ID NO: 6404 - protein, 57 aa, Artificial Sequence
  Synthetic sequence.
RVIEEVDKEIKRVIKESEDVTKEVKDTSRKVLEDSKRESERVRRRSEEVLKKVEEEG

SEQ ID NO: 6405 - protein, 59 aa, Artificial Sequence
  Synthetic sequence.
EDEVRRVAEKVKRLVDESIKRLKDNVKRNKELVDESIREVERNVEENERLATKVIEEAK

SEQ ID NO: 6406 - protein, 57 aa, Artificial Sequence
  Synthetic sequence.
SVIERVEEEMEKVIRDSERVTKEVEDRAREVHERSEKRIREVEETSRRVLEELRRAG

SEQ ID NO: 6407 - protein, 59 aa, Artificial Sequence
  Synthetic sequence.
EEEVKKLAEEVRRLVEDSIRKLEELARRVDELVRESIERVDRNVEENKRLVREAIERRR

SEQ ID NO: 6408 - protein, 57 aa, Artificial Sequence
  Synthetic sequence.
SVDREVEEIMRRVHKESEDVIRKVKDTVRRVLERSREVSERVKRDAERVLEEVKRAG

SEQ ID NO: 6409 - protein, 59 aa, Artificial Sequence
  Synthetic sequence.
KDFLKRVAEEVKRLVEESIKRVEDVAREVERLVEESIRLLEAVAKKVRDLVREVKRRRT

SEQ ID NO: 6410 - protein, 59 aa, Artificial Sequence
  Synthetic sequence.
KEIEDLVKKIREIVDRIKKTVEDSVREVRRIVDESAKSVEELVKELKKLAEELRKLVED

SEQ ID NO: 6411 - protein, 58 aa, Artificial Sequence
  Synthetic sequence.
ELIRTVERELREVEKEVKKMLDESTEVLKEVEERVRRMNDDVRRVLEKVARDVERDLR

SEQ ID NO: 6412 - protein, 59 aa, Artificial Sequence
  Synthetic sequence.
KEVEEVVTKVDDLVRELEERSRRHVERVKEIADRNEKLVREVVKRSRDNVRELEELVRR

SEQ ID NO: 6413 - protein, 59 aa, Artificial Sequence
  Synthetic sequence.
REVLEEVKKRIRDVLKRVEDASKRVKETIDEVLKRIKELTEDVERKSREVLRRVKEARK

SEQ ID NO: 6414 - protein, 59 aa, Artificial Sequence
  Synthetic sequence.
KEVEDIIRKLRRHVKEIERTIREMVESVKRLADEVVKVLKDALDSARDHVRKILETLRD

SEQ ID NO: 6415 - protein, 59 aa, Artificial Sequence
  Synthetic sequence.
EDVLRELRKVIEDTERTIKRLVDELEKVHREVKERIRKIAKDLRDKHKKSKRDIRETER

SEQ ID NO: 6416 - protein, 57 aa, Artificial Sequence
  Synthetic sequence.
SAKDEVKDVNDKVRKEVRRVIEESRAVNEEIKRRVDTVLKESEDVNREVKREVEDKV

SEQ ID NO: 6417 - protein, 59 aa, Artificial Sequence
  Synthetic sequence.
EKVAKEIVRKSEDVVRRIVEELKEDAKRSRDLVRELVKEIKEDVKRSRELVKRVVEEAK

SEQ ID NO: 6418 - protein, 60 aa, Artificial Sequence
  Synthetic sequence.
REAEELVKRNEKIVTDIRRLVEKTVRDSRRVVEELKREAEETVERSRRVVTKLKELVERG

SEQ ID NO: 6419 - protein, 58 aa, Artificial Sequence
  Synthetic sequence.
RMVEEVERTSREVEEEVKRVLKKSRDVTREVEEEVRRLLERSRKETDDVRKRLEEAER

SEQ ID NO: 6420 - protein, 60 aa, Artificial Sequence
  Synthetic sequence.
DEAERLVEEIKRVVKEAEDLVRRTVEISRRVVETLRKEAEDLVRDSERVVKELTELARRG

SEQ ID NO: 6421 - protein, 58 aa, Artificial Sequence
  Synthetic sequence.
ELVEKVRRVIEEVEKRLRDMLRKSRDVTREVKERVARMLEKSKKVTDDVEKRVTDEDR

SEQ ID NO: 6422 - protein, 60 aa, Artificial Sequence
  Synthetic sequence.
KEAEDLVRRVEEVVEELERRVEKLVRESEEVVKKLSKEVKESVDTNRDIVRRITELARRG

SEQ ID NO: 6423 - protein, 58 aa, Artificial Sequence
  Synthetic sequence.
EKVEEVERVIRRVKKRVEEVLRKSKTTTTDVERRVREMLERSEESTRRVKERADRERT

SEQ ID NO: 6424 - protein, 59 aa, Artificial Sequence
  Synthetic sequence.
SEADDVVREIEDLVRRDKELVDEVVKRIKDLVRRDKKLVDEVVKEIKDLVTELEDLARK

SEQ ID NO: 6425 - protein, 59 aa, Artificial Sequence
  Synthetic sequence.
EEMLRKLERVVEEVKRRSTEALKRLREVVKEVKETSKRANEELERVVREVKKRLDDATK

SEQ ID NO: 6426 - protein, 59 aa, Artificial Sequence
  Synthetic sequence.
DEVREVVKEIRKLVEDDKRRVDKVVEDDRRLAKRDLDLVEDVVRRIEDLVRRVLEEARK

SEQ ID NO: 6427 - protein, 59 aa, Artificial Sequence
  Synthetic sequence.
KSVLDELRKVVEEVKERSDRALEEVERSIRESEKESRRANEKLRKVVEEVRKKLEEAER

SEQ ID NO: 6428 - protein, 59 aa, Artificial Sequence
  Synthetic sequence.
SEVDKVVKDIRDLVRRDLKRVEDVVRTDRRLAEEDLRRVKEVVEKIEKDVKELDELARK

SEQ ID NO: 6429 - protein, 59 aa, Artificial Sequence
  Synthetic sequence.
ESVLKKLKDVVDEVERESREALRKVEESIKESKRRSEKALEELREVVKRVDRLLEEARR

SEQ ID NO: 6430 - protein, 59 aa, Artificial Sequence
  Synthetic sequence.
SEVDEVVKEVEDLVRRNEELVEEVVRRVEKVVTDDRRLVEEVVREIRKIVKDVEDLARK

SEQ ID NO: 6431 - protein, 59 aa, Artificial Sequence
  Synthetic sequence.
EKVLRKLEKVIREVRERSTRALRKVEEVIRRVREESERALRDLERVVKEVEKRMREAAR

SEQ ID NO: 6432 - protein, 60 aa, Artificial Sequence
  Synthetic sequence.
DEVDEIVRRIEKLVTDDLKRVEDLVREVKKLVDEDKRKVDEIVKEIRRLVEEIRKEAERD

SEQ ID NO: 6433 - protein, 59 aa, Artificial Sequence
  Synthetic sequence.
EKVKRKLRKVVEEVERRSKKANEELEKKVREVEELSKRVLEKLKKVADEVRKEVKDAKD

SEQ ID NO: 6434 - protein, 60 aa, Artificial Sequence
  Synthetic sequence.
DSVERLVETIREIARESLRRAKELVKSNKKLAEDSKRRVDKLVKELKDLVTRVKETLKRK

SEQ ID NO: 6435 - protein, 58 aa, Artificial Sequence
  Synthetic sequence.
EVLELIEEVVREVKEVNTTVSKEVEDVVEETRKVNEDVAKLIEKVVREVKRVVDEVRT

SEQ ID NO: 6436 - protein, 60 aa, Artificial Sequence
  Synthetic sequence.
SELERLVEEIRRLVREIEERSKKTTEDIKRLAEDIRRRSKEAVDENEDLARKIRKRAEER

SEQ ID NO: 6437 - protein, 55 aa, Artificial Sequence
  Synthetic sequence.
REIDKVIEEVRKRLKEVTDSDREVIKEIEEVLREVEERNRRSIEKIRKVLEDVTK

SEQ ID NO: 6438 - protein, 60 aa, Artificial Sequence
  Synthetic sequence.
SEVDELVEKIRTTVKRVLEKHKRNTDETRRLVEEILERHTRTSRRIERVVREATDKLRRR

SEQ ID NO: 6439 - protein, 58 aa, Artificial Sequence
  Synthetic sequence.
EMLEKLREVLERAAEVLKRAEESDRTVDEEVERRVREVARSDDEVLKEVKREVERVKT

SEQ ID NO: 6440 - protein, 60 aa, Artificial Sequence
  Synthetic sequence.
SEAEEVAKRVKEIAKENADLAREVAKDIKRLADENKKHADDVARDIERLAKELLEAARRG

SEQ ID NO: 6441 - protein, 59 aa, Artificial Sequence
  Synthetic sequence.
ERAEKLARDAAEEAKKAAEESNKLIREAAERLKEAARRADKLVEEAARRLEKAAEEARR

SEQ ID NO: 6442 - protein, 60 aa, Artificial Sequence
  Synthetic sequence.
DEVDEVVRRDERLAEENLKRNTESSKRDRDLARENLKDAKRVVERIRKLMEDLKKLFDRG

SEQ ID NO: 6443 - protein, 59 aa, Artificial Sequence
  Synthetic sequence.
EKLTRRVEESLKRSEEVLRRVNESDKRSLEETRKVLEESNKEIEKVVRDLEELLKEVRR

SEQ ID NO: 6444 - protein, 60 aa, Artificial Sequence
  Synthetic sequence.
SEADKVVKEVDDIVARNTEENDKSSKRVEDIIRENDKHAEEVVRDIRRLAEELRELRERG

SEQ ID NO: 6445 - protein, 59 aa, Artificial Sequence
  Synthetic sequence.
EELEKRLRDVVRRAEERLRDVNRSDEEVVRRAEELLKRVDDRVKTVVEELKKTLDDERR

SEQ ID NO: 6446 - protein, 60 aa, Artificial Sequence
  Synthetic sequence.
EEVDRVVKRDDDLARKNLEENERSSREDDRLVKENEDHAKKVVDDIRKLMEELRELARRG

SEQ ID NO: 6447 - protein, 59 aa, Artificial Sequence
  Synthetic sequence.
EELEKRLRESLRRSREVLKRVNESDRDSLERTKKRLEDVDREVRKVVEELRKVIRDEEK

SEQ ID NO: 6448 - protein, 60 aa, Artificial Sequence
  Synthetic sequence.
SEAEEVARRVEKIAEDNARHAEKVAKDIEDLARENLELNERTSRRVERLARELLKAARRG

SEQ ID NO: 6449 - protein, 59 aa, Artificial Sequence
  Synthetic sequence.
EEARKLARKAAEDARRAAERANELVKRAADELRRAAEEANKSDEDAAREARRAAEEAER

SEQ ID NO: 6450 - protein, 60 aa, Artificial Sequence
  Synthetic sequence.
KDVEDVVREDEELAKTNKKHADDVVRRIKELIDRNRRLNEETSKRIEDLVRRLLELARRG

SEQ ID NO: 6451 - protein, 59 aa, Artificial Sequence
  Synthetic sequence.
ERVRKEVERSLRKSDEVLRRVNDKVRRVLEELRKVLEDVNRSDEKVLRELEELLERVRT

SEQ ID NO: 6452 - protein, 58 aa, Artificial Sequence
  Synthetic sequence.
SEDEKVRKVVEEAKEVNRRAEEAIKDVSERLERVNREVTKRSRDVSEEVRKMLERDAS

SEQ ID NO: 6453 - protein, 56 aa, Artificial Sequence
  Synthetic sequence.
VDEVVKRIKELVDRSLELAERIVERNERLVEKSERDVRKIVEDNKRLADEVAKRAT

SEQ ID NO: 6454 - protein, 58 aa, Artificial Sequence
  Synthetic sequence.
REDELVDKVLRELEELLRRVKKRLEDVSRDLERVNREVRDELRRVSKKVEDMARRDVG

SEQ ID NO: 6455 - protein, 56 aa, Artificial Sequence
  Synthetic sequence.
AETVVRDIRRLAEELLRTVDKIVKDNERLARESRERVRRIVERNEELARDLARKAR

SEQ ID NO: 6456 - protein, 58 aa, Artificial Sequence
  Synthetic sequence.
DDEKKVEDVVRKVKKVAEDVRRRLEKVSREVKKVLDEVRRRVEEVSREVEEILRRAAS

SEQ ID NO: 6457 - protein, 56 aa, Artificial Sequence
  Synthetic sequence.
ADEVVKRIEDLVRDLERRVDEIVKRNKELVKRVEEEADKIVEDNKRLAEEVLRKAT

SEQ ID NO: 6458 - protein, 57 aa, Artificial Sequence
  Synthetic sequence.
DSRRKVKEVIKELEEVLRRVKEEVEKVSRDLERLLKEVKEKLERVSRKVEEEIREKA

SEQ ID NO: 6459 - protein, 56 aa, Artificial Sequence
  Synthetic sequence.
ADTVVKRIKELMKDVERIVEEIVRENRKLVTDLLREVDRIVEENERLAEELAERAR

SEQ ID NO: 6460 - protein, 58 aa, Artificial Sequence
  Synthetic sequence.
SSKEKVERVVERLRRVNEEVIRLIEKVSRELEEVNKEVRERIERSVKETEDILRTAAS

SEQ ID NO: 6461 - protein, 56 aa, Artificial Sequence
  Synthetic sequence.
VDTVVREIEKLMDDSKKKADRIVDENRELVKRSEEAVEELVRRDKKLAEDVFRKAE

SEQ ID NO: 6462 - protein, 58 aa, Artificial Sequence
  Synthetic sequence.
DDERKVKKVVKEVRKVDEEVARRLDKVSKELRDVNREVKKKMEDSVKKTEDLAKKDAS

SEQ ID NO: 6463 - protein, 56 aa, Artificial Sequence
  Synthetic sequence.
ADTVVKRIKELAEESEKRVDKIVKRNKELVDKSKKDVDELVKRDEELMKDLVEKAR

SEQ ID NO: 6464 - protein, 58 aa, Artificial Sequence
  Synthetic sequence.
SAEEKVRKVLKELREVNERVERELKRVSDESERVDDEVNTRAKKVVRDVERVLEERAG

SEQ ID NO: 6465 - protein, 56 aa, Artificial Sequence
  Synthetic sequence.
VDEVVERIERLARESKKRVERIVRENEKSARESEKRADEIVKTIEELAERVARRAT

SEQ ID NO: 6466 - protein, 58 aa, Artificial Sequence
  Synthetic sequence.
KDEERVKEVVKKLRKVNEDVRRLIERVSRESKRLDEEVNRELDESAKDTERALRERLG

SEQ ID NO: 6467 - protein, 56 aa, Artificial Sequence
  Synthetic sequence.
ADEVVKEIEKLAKTSEELARRIVRENEESARESLERARKLVEDDRRLVKEVVERAE

SEQ ID NO: 6468 - protein, 60 aa, Artificial Sequence
  Synthetic sequence.
DLEERLATVVRKVEEDLKKLRRDNEKVIREVEKLNEDLNRRNKKLIDEVRKLLEKAKREG

SEQ ID NO: 6469 - protein, 59 aa, Artificial Sequence
  Synthetic sequence.
EKRVRELLEKIKRLLEEVDRRVKESIKEIEDSLRRSKEKADRSIEEIKKLLDDLRERAR

SEQ ID NO: 6470 - protein, 59 aa, Artificial Sequence
  Synthetic sequence.
SVEDLLRRVVEEVRKELERLKRKNEKVVKEVRKKNKEVNDRNEEVIRRVEKRLKKLKED

SEQ ID NO: 6471 - protein, 59 aa, Artificial Sequence
  Synthetic sequence.
EEEVRRLVRRIEKIVDEVRKRVDKSVEEIKRSLKRSKELADESLERIRRLLEEIDERVR

SEQ ID NO: 6472 - protein, 60 aa, Artificial Sequence
  Synthetic sequence.
SSDEELKKVLEDMKRVLEKVREDMKRVNDELKEAVERVKKESDDVDRELRRVIEEVVRED

SEQ ID NO: 6473 - protein, 56 aa, Artificial Sequence
  Synthetic sequence.
VKDLVRTVERLVEEIKDLVRKDVERVKKIVRRIEDLAKKDVEVSEKLVKEIKDRAK

SEQ ID NO: 6474 - protein, 60 aa, Artificial Sequence
  Synthetic sequence.
SAKELLDDVAKKLEEVVERVARKLDEVDERLREMIERVRKELEDVNRRLRDLVRRVVDKD

SEQ ID NO: 6475 - protein, 56 aa, Artificial Sequence
  Synthetic sequence.
VEEVVRDVERIVDEIEKRAEKVVRDSEKLVRDIEELVRRDVREVERIAEEIEKEAT

SEQ ID NO: 6476 - protein, 60 aa, Artificial Sequence
  Synthetic sequence.
SADEELERVLRELDKVIKDVVEESRDVDRKLERVVREVERLLDDVDRRLKEVIERVVREV

SEQ ID NO: 6477 - protein, 56 aa, Artificial Sequence
  Synthetic sequence.
VKDVVTEVKKLVETVKRLVEENVKRVEKIAEEIRRLVEKVVRESDELVERIERRVR

SEQ ID NO: 6478 - protein, 59 aa, Artificial Sequence
  Synthetic sequence.
SAEELIRKAAEDARRANKEAEDLIREAAKEARRANEEAERLIREAAKRAEDALRDADRK

SEQ ID NO: 6479 - protein, 59 aa, Artificial Sequence
  Synthetic sequence.
EEEAKKLADDIREAAKRSLDRARELAKRIREAARRSLEEAKKLAEEIKKAAEKALRDAT

SEQ ID NO: 6480 - protein, 60 aa, Artificial Sequence
  Synthetic sequence.
SAVERVVREVKKTVDESRKRAEKEKREVEDVVRRIREKVKRVVDDNRRVVETIKELSKER

SEQ ID NO: 6481 - protein, 59 aa, Artificial Sequence
  Synthetic sequence.
EEAREKLDRVRKELDDANRRVEEELRRVARELEKVLREVEELLRKVDEDIRRVLDEERR

SEQ ID NO: 6482 - protein, 60 aa, Artificial Sequence
  Synthetic sequence.
KDVEEVARKVKRVAERSEELVAELVKKNKKVVDESREKVDDVVRRNKELVDTIRDLARRR

SEQ ID NO: 6483 - protein, 59 aa, Artificial Sequence
  Synthetic sequence.
EEIRKLAEDVKRELERVNKKVKELSDRAAEELKRVNEEVRKKLEEVDREIRKVLEEVRK

SEQ ID NO: 6484 - protein, 60 aa, Artificial Sequence
  Synthetic sequence.
SLMEEVKKEVDKVVREIKELVRKVEEDVKKVVKESRDKVDKVVKENKKVVEKIRDLARRR

SEQ ID NO: 6485 - protein, 59 aa, Artificial Sequence
  Synthetic sequence.
DEIRKLIKEALDKLKEVLDEARDRLKKVKEELETVNREVEKLLRDVDREIEKVLKEVEK

SEQ ID NO: 6486 - protein, 60 aa, Artificial Sequence
  Synthetic sequence.
SEAEKIVREVERVVEESRRVAKENEKEVDKVVDTIRKLIEDLARRVEDILKKIEEERRKG

SEQ ID NO: 6487 - protein, 60 aa, Artificial Sequence
  Synthetic sequence.
VKRIEDLLREVEERLRRVSEEVKKRLKELHERVEEVLRELRKRLRDLERKARKVLEEAKK

SEQ ID NO: 6488 - protein, 57 aa, Artificial Sequence
  Synthetic sequence.
DVKEVLDEARKVVEDSIRRSKELIDEVRKRVEESVEESKRLAETVAEEVREVIERAR

SEQ ID NO: 6489 - protein, 56 aa, Artificial Sequence
  Synthetic sequence.
IETVLREVKRLVRENVKRIAELVKTIEDLVRENSERVRRVVREIRELVKELEKKAR

SEQ ID NO: 6490 - protein, 57 aa, Artificial Sequence
  Synthetic sequence.
DVDELLKRVEDEVRRSKEESEKLRKEVRKEVEDSAKTSKDLIDDARRTVEEVIKKVK

SEQ ID NO: 6491 - protein, 56 aa, Artificial Sequence
  Synthetic sequence.
VDTVVERIRKLVKENSDRVREVVDTIKKLVEENVREVRRLVEEIKRLVEEVKRREE

SEQ ID NO: 6492 - protein, 57 aa, Artificial Sequence
  Synthetic sequence.
DVKEVLKRAEEEVRRSIKRTREVLERVEKMVRDSSRTTTDLIRKVRREVKRVIDEVN

SEQ ID NO: 6493 - protein, 56 aa, Artificial Sequence
  Synthetic sequence.
IDTVLEDVKRLVKENSEKIDEVVREIRELVETNRKLVEDLVREIKELVEKALRDAK

SEQ ID NO: 6494 - protein, 57 aa, Artificial Sequence
  Synthetic sequence.
DVKEVLKRAKDEVRRSSDRTRRLIEKVRDESERVVEEVKKLNEDVNREVERVIREVK

SEQ ID NO: 6495 - protein, 56 aa, Artificial Sequence
  Synthetic sequence.
IDTVLREVEKLVRDNERLVEKLVKEVEDSVRETKKRVEESVDTVRRIVEELKRRAT

SEQ ID NO: 6496 - protein, 60 aa, Artificial Sequence
  Synthetic sequence.
SEAEEVLREVKEVVDRSRELAERVLRAVRELVKRDEDLARKILEDVARVVKTIDDLARER

SEQ ID NO: 6497 - protein, 56 aa, Artificial Sequence
  Synthetic sequence.
KEVVDRADRALREVNKRLDEVVREVEKLLRESLDRSRRVIEEVAKRLEEVLKKLED

SEQ ID NO: 6498 - protein, 60 aa, Artificial Sequence
  Synthetic sequence.
DEMDEVRREVERVVREDEKLARDLKRRVEKVVEDIKRSADEVLKEVKKLVEEIRELMKKR

SEQ ID NO: 6499 - protein, 56 aa, Artificial Sequence
  Synthetic sequence.
REVVRRVEEELERSLRKSREVVKRVEKELEDVLREHRKVLEEVTDLLRRVLEELRR

SEQ ID NO: 6500 - protein, 60 aa, Artificial Sequence
  Synthetic sequence.
REAEEILKKVAEVVKEDKKLADDLRKKNKETVDDIRRKAEELLKRVKKVVEELKRRMEEG

SEQ ID NO: 6501 - protein, 59 aa, Artificial Sequence
  Synthetic sequence.
DELRKIAEEVRKRLEDSVRTTRDIIRRVKRENEEVIKELERVMRKVREDLKRVKEEIER

SEQ ID NO: 6502 - protein, 59 aa, Artificial Sequence
  Synthetic sequence.
SREEVAKEVRELIARSEKETRDIIREVEDRMRRSKEETEEVIKEVKRLLEEVKKRLEEK

SEQ ID NO: 6503 - protein, 56 aa, Artificial Sequence
  Synthetic sequence.
AEEILRTVKKVVDRDRELAKRLLDEARELVRTNRELVKRVLETVTRLVKKIDDEAR

SEQ ID NO: 6504 - protein, 60 aa, Artificial Sequence
  Synthetic sequence.
DEEEVEKRVKDLLRESTERTKEVNERVRRLAEESRKRTEEIIREVRRLAEEVEERLRRRG

SEQ ID NO: 6505 - protein, 56 aa, Artificial Sequence
  Synthetic sequence.
VRELLETVKKLVKDDVDIVRRNLEEVKKLVETNVRLAEEVLKEVDRLVKKVEEDAR

SEQ ID NO: 6506 - protein, 57 aa, Artificial Sequence
  Synthetic sequence.
DELDEIRKRVEELIKRSEEDSREVRRRLEEIIERNRKISRDVEREIEKLIKDVRDSN

SEQ ID NO: 6507 - protein, 62 aa, Artificial Sequence
  Synthetic sequence.
GEELRRVEEVVKRVRELVERSKEETDKIAEDVRRLLKESNDDTERIKRKVEEMLKELEERIK

SEQ ID NO: 6508 - protein, 57 aa, Artificial Sequence
  Synthetic sequence.
RELDEVVKTVRKLVDESKKESDDVAREARELLEKLERESEEVVRRVRELVKELKKKR

SEQ ID NO: 6509 - protein, 56 aa, Artificial Sequence
  Synthetic sequence.
VDEVLRKAKELIDDSRRLIEDVKRRLKELIDRDRRLIERVLEEAERLIRELDEEAR

SEQ ID NO: 6510 - protein, 60 aa, Artificial Sequence
  Synthetic sequence.
KEIEELDKMVEDIVRELDELVRAHTETVDRLIRDLERSNEELRKLIKKIVDELEDLVRRG

SEQ ID NO: 6511 - protein, 62 aa, Artificial Sequence
  Synthetic sequence.
EEVVRRLKDVERKVKKLAEDVKEKLRRSVERVTKLLKEVEDNSREVEKEAEERVDRVLKKVK

SEQ ID NO: 6512 - protein, 56 aa, Artificial Sequence
  Synthetic sequence.
REVEELVERIERSSRRALERLEDLDRTIKKSSEDARRRLKEMDDRLEELVKRARDN

SEQ ID NO: 6513 - protein, 56 aa, Artificial Sequence
  Synthetic sequence.
EEEIKKVLEEDRKLVEKLERDNKRVLDEDKELVRRNEERNREVLERIRELIERART

SEQ ID NO: 6514 - protein, 56 aa, Artificial Sequence
  Synthetic sequence.
DEVEKLIKDIRDIIRRVEEAVARLVEENNKLVKEVDDRLRELSKENRDIVRKVREG

SEQ ID NO: 6515 - protein, 60 aa, Artificial Sequence
  Synthetic sequence.
KRTLLEEAKRVLEDIEKEARDLLRRLEEIIRRTRKLVKDILDRSRDILRRTRELVDRVRR

SEQ ID NO: 6516 - protein, 57 aa, Artificial Sequence
  Synthetic sequence.
KEAEDLLRRIEDLIRKVKKEVEDLVRENNRLVEKVVRELEKLSDELRKLIKRIKDAG

SEQ ID NO: 6517 - protein, 60 aa, Artificial Sequence
  Synthetic sequence.
KETLLRDIERIRREIEKLIEELLRRAEEIIRDTERLVEKILRESKELLKEIRELAEREKQ

SEQ ID NO: 6518 - protein, 59 aa, Artificial Sequence
  Synthetic sequence.
DLERVVEESSRLVERVVRRNKKVVEDIRRRVREVERKNEEVTKEIKKILDEVRRRLERD

SEQ ID NO: 6519 - protein, 59 aa, Artificial Sequence
  Synthetic sequence.
REELKKLLERSREMLEKSERTVDTSREEAKRVLEESEELVERTLREVEEIIRRVIERVR

SEQ ID NO: 6520 - protein, 60 aa, Artificial Sequence
  Synthetic sequence.
SLEEVLRAVRKLAEDVKRKNKEVLDRIRDSSRRSEEKLEDSLRKIEELVRKLEEELKRDG

SEQ ID NO: 6521 - protein, 59 aa, Artificial Sequence
  Synthetic sequence.
DEDLKRLLEEIKRVLEESEEKVERSLREMEEVDKETEKRSRKLNREVREVVKDVADKVR

SEQ ID NO: 6522 - protein, 60 aa, Artificial Sequence
  Synthetic sequence.
SRLEDLLRKVKKVLDEIRRTIEKSLEDVRELIKRIERTIEKLLERSRDVVRRVLEDAERR

SEQ ID NO: 6523 - protein, 59 aa, Artificial Sequence
  Synthetic sequence.
EKAKEVLKEVKDRVDEVAKELTDVNRDIRRIVDELRRRAEKVVRESRELSRELREELEK

SEQ ID NO: 6524 - protein, 60 aa, Artificial Sequence
  Synthetic sequence.
SELERLLEEVEKELRKIERTITELLRRSRELLEEIERAIKESLRDSERLLREIEDTVRKR

SEQ ID NO: 6525 - protein, 59 aa, Artificial Sequence
  Synthetic sequence.
SKVREVLREVRERVKEVVERLKRVVEESRKRSEEVKKKLEEVNRRSEEESKRVKEELKK

SEQ ID NO: 6526 - protein, 60 aa, Artificial Sequence
  Synthetic sequence.
KLEEVLRTVRKLVEDLREELERVVRTSRELTRRLEEELKEVVKRSEDLSRRLEEILKRDA

SEQ ID NO: 6527 - protein, 55 aa, Artificial Sequence
  Synthetic sequence.
TEALKEVKRLVDEIRKTIEEALRDSKRLVDEIRETIKRSLEEVEKEVRKAEERIR

SEQ ID NO: 6528 - protein, 59 aa, Artificial Sequence
  Synthetic sequence.
SIEDVLRAVEKLLRDLKRRSEEVVKHSETELRRLLEEVRRVLEHSREALERLEERIKDV

SEQ ID NO: 6529 - protein, 59 aa, Artificial Sequence
  Synthetic sequence.
DEVIKEILERVKKLIEEIDERNKELNERTKELIKRIKDRLKELNDKTEKAIDKIRKEVE

SEQ ID NO: 6530 - protein, 59 aa, Artificial Sequence
  Synthetic sequence.
SIEEVLREVEELLKELEKRARDVLRHSEELLRDVIRRSEEVVKHSEDLLRKLKEAAKDV

SEQ ID NO: 6531 - protein, 59 aa, Artificial Sequence
  Synthetic sequence.
DEELKKILDEVRKVIKELEDKLRKLNKKTEDVIRELIERNDRLNKDTKRVIDELKEKVR

SEQ ID NO: 6532 - protein, 59 aa, Artificial Sequence
  Synthetic sequence.
SIEEVVEEVKELLERLIRRSEDVLRHSKKLLEELERKSERVVEHSEDLLRKLEEKIKDV

SEQ ID NO: 6533 - protein, 59 aa, Artificial Sequence
  Synthetic sequence.
DETLKRILEEVREVIKKLIKSSEDVNRETEELIRRLEDRNRKLNEKTEKVIREIEEEVK

SEQ ID NO: 6534 - protein, 59 aa, Artificial Sequence
  Synthetic sequence.
TVEDVLRELRERLKESEKRDRDSVRKAEELLRRSEKRTDDVVKHSERLLEELEEAVRRI

SEQ ID NO: 6535 - protein, 59 aa, Artificial Sequence
  Synthetic sequence.
EDVVRRLLEEVEELLRRNVKKSEELLKEIRERLEDNIRKVEKVNRDNKREIEEILRRVK

SEQ ID NO: 6536 - protein, 59 aa, Artificial Sequence
  Synthetic sequence.
TVEEVLKEAEDLLKESKERSEDSARRAEEILRRSEERTRKVVEHSREMARRLMEKVKEK

SEQ ID NO: 6537 - protein, 59 aa, Artificial Sequence
  Synthetic sequence.
EKVVEDVLREVEKLVRDNIEHSKRLLDEIRRRVEENIRRVDEVNKRNEELIREVEERVR

SEQ ID NO: 6538 - protein, 60 aa, Artificial Sequence
  Synthetic sequence.
SKVEEILERVKRLIEENIKRSEEILEEVRRLIRENTEVSKKLLEEVKREITELEKEVRED

SEQ ID NO: 6539 - protein, 59 aa, Artificial Sequence
  Synthetic sequence.
ERVKDVLRRLKKIVDESKRRSDKVNKEIEDRVRESEKKSRKVNEDIKRLVKRVADEVER

SEQ ID NO: 6540 - protein, 60 aa, Artificial Sequence
  Synthetic sequence.
SDIEDLLKKVEDLIRRNIETSRRLLEEVRKLIEENIRLAERILEEVRRLIEELARLTRED

SEQ ID NO: 6541 - protein, 59 aa, Artificial Sequence
  Synthetic sequence.
EKVKDALRRLRDLIRRSKEDSERVNEEIKDIVRKSRETSEDVVRRARELLDKVRREVEK

SEQ ID NO: 6542 - protein, 60 aa, Artificial Sequence
  Synthetic sequence.
SELEELLKEVAKLIKRNKDRVRKILDEVRKLIKRNEDVSRRLLEDVERLIKELEREVRED

SEQ ID NO: 6543 - protein, 59 aa, Artificial Sequence
  Synthetic sequence.
KKVEDILRTLEELIRESERTSEEVLRELREEAEESKRKSKRVNDRIRELVEKVDREVDK

SEQ ID NO: 6544 - protein, 60 aa, Artificial Sequence
  Synthetic sequence.
SKLERLLEEVEKLIRRNKRIVREILREVRELIERNIRVSEEINRRNRRLIEEIRRLVEED

SEQ ID NO: 6545 - protein, 59 aa, Artificial Sequence
  Synthetic sequence.
ERVKRILKEIERLVEESKRESERVLEEIKELVKDSKRRSKEVNDHSKKLVDEVREAVKK

SEQ ID NO: 6546 - protein, 59 aa, Artificial Sequence
  Synthetic sequence.
SRIDELLKEIRKVTEKTRRDVERLLEEIRKVTDKSRKDSERSLDEARKVLDTIRKLLED

SEQ ID NO: 6547 - protein, 55 aa, Artificial Sequence
  Synthetic sequence.
EALERIKRSSEELAEEVKRVLDEVRRSSEELEKRARDSLRELRELVKRVEEEARK

SEQ ID NO: 6548 - protein, 59 aa, Artificial Sequence
  Synthetic sequence.
SRIEKLLDEIRKVSKKSIDEVRKILEEVEKVTRDSIRKLRKLLREIEKVLEEIERLLKN

SEQ ID NO: 6549 - protein, 55 aa, Artificial Sequence
  Synthetic sequence.
EALKRIKELSDEVREEVKKVLRKIEESSERLEEEAKKVLDTVRELVERVARRAKE

SEQ ID NO: 6550 - protein, 60 aa, Artificial Sequence
  Synthetic sequence.
REAEEALRRVEEVVRRSKTELKKLLEDVRRLIEESERELRDLLRRVEEVIRRIREELRER

SEQ ID NO: 6551 - protein, 56 aa, Artificial Sequence
  Synthetic sequence.
KEMLRTVDELLKDSERDSERVLREIEELLERSKRKSEEVLREIERLLEKIEREVRK

SEQ ID NO: 6552 - protein, 57 aa, Artificial Sequence
  Synthetic sequence.
SEVEEVAREVDELVKESRDESRRIVEEAKRLLKESNKSVKDIERDARRLVKEVEDAV

SEQ ID NO: 6553 - protein, 56 aa, Artificial Sequence
  Synthetic sequence.
VKKVLDEVRELAERSKDLNRRLLERIRELVRRSKERNKELLKRLRDLVERVKREIK

SEQ ID NO: 6554 - protein, 57 aa, Artificial Sequence
  Synthetic sequence.
DEVEEVKKDAERLNKELHESLRRSNEEAKRLLKESKDASREVVKDARRLTKELRETM

SEQ ID NO: 6555 - protein, 56 aa, Artificial Sequence
  Synthetic sequence.
VEKVLRDLRRLTEETKRRNRETLEEIRRLIERSKEEIKRLLEELRELTKRTKDRIR

SEQ ID NO: 6556 - protein, 57 aa, Artificial Sequence
  Synthetic sequence.
DEVKEVKDRARKLVEEVKRAVDEVRKRADELNKEVHESLRRSNREAERLVKEVEDTV

SEQ ID NO: 6557 - protein, 56 aa, Artificial Sequence
  Synthetic sequence.
VETVLREITELAKKILRDIEELLREITKITEESKRENEKSLRELEDLARRVKEKTR

SEQ ID NO: 6558 - protein, 57 aa, Artificial Sequence
  Synthetic sequence.
DEVERLVEELERLLREVRDSVRRSNTEAKELNKEVHEAIRRVVEEARRLLEEVRRTA

SEQ ID NO: 6559 - protein, 56 aa, Artificial Sequence
  Synthetic sequence.
VETVLRRVEEVARRVKKLNEDTLRTLRRITEDSLRKIEKLLRDIEKLVREVVERLR

SEQ ID NO: 6560 - protein, 60 aa, Artificial Sequence
  Synthetic sequence.
SEIEDLERRIKEVVDDLRRLVEENSKKIDDLLRRLKDLIRKVEEMNRKLIREAEELVREE

SEQ ID NO: 6561 - protein, 58 aa, Artificial Sequence
  Synthetic sequence.
EELRKVEESVRRLAEEIKKELEDSRRRVEELVREIEKELEDVNRDARRLVDKVREELR

SEQ ID NO: 6562 - protein, 57 aa, Artificial Sequence
  Synthetic sequence.
REVEELKKTLDRLVEESKRESDKVREDAERTVRESEDKSRRVKDEARRSLEEVEEDV

SEQ ID NO: 6563 - protein, 59 aa, Artificial Sequence
  Synthetic sequence.
KDEIKKILEEAEEVVRDSKKKIEDLLRHNKKRVDDSLRKIEEILKHNRDEIERVREEIR

SEQ ID NO: 6564 - protein, 57 aa, Artificial Sequence
  Synthetic sequence.
DEVETVREEAKRLVEESRKESRRVEEELKKLLRRVEEEARKVKEELEKSVDEVRKAV

SEQ ID NO: 6565 - protein, 59 aa, Artificial Sequence
  Synthetic sequence.
REEIKKILERVREVVKRSKDEIREILKEVRKMIDKVRKEIKEILDHNKEVVRKIKEETK

SEQ ID NO: 6566 - protein, 57 aa, Artificial Sequence
  Synthetic sequence.
SEVEEVKERAERLVRESEELSDRVRREAEKTIEAVRELVERIRKRLKESVEEVERRV

SEQ ID NO: 6567 - protein, 59 aa, Artificial Sequence
  Synthetic sequence.
REEIKKLLEEVKRVVDKSKRDIDELLKHNRRKIDEVLRELEEILRHNETRIKEVLDRAR

SEQ ID NO: 6568 - protein, 60 aa, Artificial Sequence
  Synthetic sequence.
SEVEKLLREAEEDVERILKRLEDSMDSNRELVERILETLKRSLDEVEKEIRKIIEELKRR

SEQ ID NO: 6569 - protein, 55 aa, Artificial Sequence
  Synthetic sequence.
DKVIKRLEDLLRKVEKVVRDTNRTIKDSIRRVKEVVDTTNREAEKLLRRVEDTVR

SEQ ID NO: 6570 - protein, 60 aa, Artificial Sequence
  Synthetic sequence.
SRVEKLLDEVRRLAEDILRDLERSMRSNEELVRKILEKLKESLESNRRLVKRILERLREE

SEQ ID NO: 6571 - protein, 55 aa, Artificial Sequence
  Synthetic sequence.
EKVIREVERLIEEVKRVVDDTNRRAEESIKEVRDLVRRTNEEIEKTIEEVDREVK

SEQ ID NO: 6572 - protein, 57 aa, Artificial Sequence
  Synthetic sequence.
REAEEIKKALDKLAEELRELLERSRDTVRKLIKELRDLVRESRRRVKELIDDIRRRV

SEQ ID NO: 6573 - protein, 59 aa, Artificial Sequence
  Synthetic sequence.
REELKRLLEEVERLIERLKERIKRLTEESEKLVRELLKLIEKSTKESEEDVKRLVDEAK

SEQ ID NO: 6574 - protein, 58 aa, Artificial Sequence
  Synthetic sequence.
SEIEDLLRRVRRLIEESEEVIKRVADEVKEIIDRSREKIKRVTEESREIIKRLKKDGK

SEQ ID NO: 6575 - protein, 58 aa, Artificial Sequence
  Synthetic sequence.
RRVEDVERDIRRLVRKLREDNKRIAKTIEDLVRELRELNKRSEDETRKLVKELRDAAK

SEQ ID NO: 6576 - protein, 61 aa, Artificial Sequence
  Synthetic sequence.
SEVERIKKAVEDLVRKLRKVSKETLDESRELVKELKERDKESEKDSRRLAERLRKLLEEKN

SEQ ID NO: 6577 - protein, 59 aa, Artificial Sequence
  Synthetic sequence.
RKVVKDILDEVKKLIDDIEEHSKRVADRNRRLIEKIKKDTEDVIKRNRDLVTEIEKRIR

SEQ ID NO: 6578 - protein, 61 aa, Artificial Sequence
  Synthetic sequence.
SEVEKIEERVKRLVEELKKSLKESEEETERLARELRDVDRRSKEESRRLAEELEDLLRRRN

SEQ ID NO: 6579 - protein, 59 aa, Artificial Sequence
  Synthetic sequence.
DKVVEELLKEIEEEIRKILETNDKVVKENRRLAREILEDTKRVVDRNRELIKRIAERIK

SEQ ID NO: 6580 - protein, 61 aa, Artificial Sequence
  Synthetic sequence.
DEVETIAKEVKELADKLRREVEESRKDSEDLVRKLRESLKESRKRSKDLVDELRKLLERKN

SEQ ID NO: 6581 - protein, 59 aa, Artificial Sequence
  Synthetic sequence.
KKVVDDLRKRVEKLIKEIEEDIERVIRRSRKLIEDILRDNERVVKENEDLIREIEERIR

SEQ ID NO: 6582 - protein, 61 aa, Artificial Sequence
  Synthetic sequence.
SDVERVEEELRKLLKEIEDSVRESERRLEKLLEDLKRSTEKTKKELKELIDRLEERVRERG

SEQ ID NO: 6583 - protein, 59 aa, Artificial Sequence
  Synthetic sequence.
SERVKEILERVRKLVEDVLRRNKRLVEEVERLIEEILRVDERIVREVRELIKRIEERIE

SEQ ID NO: 6584 - protein, 61 aa, Artificial Sequence
  Synthetic sequence.
SSVEEVKKTLEDLLRESDKSVRESERRLRELLRESDESVERSRKTLEDLIRELEDLVRKRG

SEQ ID NO: 6585 - protein, 59 aa, Artificial Sequence
  Synthetic sequence.
DREVEKILREVTKLIEESLRRDREITEEVRDLIKKSKEKDKEIVDTVRRLIREIKERIR

SEQ ID NO: 6586 - protein, 61 aa, Artificial Sequence
  Synthetic sequence.
RSVEEVVKTLEDLLEKLERSVRESEERLKKLLAESDDSVRKSAEELRRLIEELKDLVRREA

SEQ ID NO: 6587 - protein, 59 aa, Artificial Sequence
  Synthetic sequence.
EREVKRLLDEVERLIDEIRERDKDIVREVDKLIKDSKREDKRIVDDVRRLIEEIKRRIK

SEQ ID NO: 6588 - protein, 61 aa, Artificial Sequence
  Synthetic sequence.
SSVEEVKRELEKLLEDSDRSVEESKKTLRRLLEESNKELRRVAERLKDLIRELKKRVKERG

SEQ ID NO: 6589 - protein, 59 aa, Artificial Sequence
  Synthetic sequence.
DREVEEILRRVRKLIEESKTMDKKIVDDVRKLIEESLRDIERIVEDVERLIKEIKERIT

SEQ ID NO: 6590 - protein, 61 aa, Artificial Sequence
  Synthetic sequence.
SSVETVEKELRRLIKELRDSVKKSEDDLRRLLEESNRLVREVERRLRELLEKLRKLVEERA

SEQ ID NO: 6591 - protein, 59 aa, Artificial Sequence
  Synthetic sequence.
DREVKRILDEVKDRIRRILREDEEIVKEVRRRIKRSEEAIREIAREVDREIEDIERRIR

SEQ ID NO: 6592 - protein, 58 aa, Artificial Sequence
  Synthetic sequence.
SEVEELEERARKLLEDVERLTREVEERAKELVKRVKDSSKRSEDEIRRLLRKLLETSG

SEQ ID NO: 6593 - protein, 56 aa, Artificial Sequence
  Synthetic sequence.
VEKVIRTLEEEVRRDEEKIREVLERVEDLIREDLRRDEELVKELEKLIREVDEKER

SEQ ID NO: 6594 - protein, 58 aa, Artificial Sequence
  Synthetic sequence.
KEVEDLEEELKKLLKEVKTRTEKVVRDAEKSVRDLEKSSRDSDRTLKDLLRRLMETTG

SEQ ID NO: 6595 - protein, 56 aa, Artificial Sequence
  Synthetic sequence.
VKKVLDEVRRLVEEDKKRIEEVLKENRESVKRDKELDDRLLERVRELIERALERAR

SEQ ID NO: 6596 - protein, 58 aa, Artificial Sequence
  Synthetic sequence.
SEVERLEEEAKRLLEELKRLVERVVREAERSVEKVRDSVRRSEEEARRLLEEITKDDG

SEQ ID NO: 6597 - protein, 56 aa, Artificial Sequence
  Synthetic sequence.
VDKVVEDLKDDIRKVKKRIEEVLDENRKSVRKLDEDDRRLVDELRRLVKEVKDKVR

SEQ ID NO: 6598 - protein, 56 aa, Artificial Sequence
  Synthetic sequence.
KEVEDLKEELKKLVEELERLVEKNVREARELVKRSEEESRRVAETARRLVDEIRRA

SEQ ID NO: 6599 - protein, 59 aa, Artificial Sequence
  Synthetic sequence.
RRTITELLKEVEELVKRVLDAIRKSNREVEKLVRESLRRIEKLLREVEKLVKELLERRK

SEQ ID NO: 6600 - protein, 56 aa, Artificial Sequence
  Synthetic sequence.
DEVERLEEELKRLVKEIEDSVRESKKEAEETLRESRKLSREVEERARRLVEELKRK

SEQ ID NO: 6601 - protein, 59 aa, Artificial Sequence
  Synthetic sequence.
EREIRELLEEVRKVVEEIKRRDDELVKENRRSIEESKRRIEELLKEVKELVERVTDTER

SEQ ID NO: 6602 - protein, 56 aa, Artificial Sequence
  Synthetic sequence.
RDVEEVKKEAEELVKKSEESVRRSKEELERTLKRSREESERVKETAKKLVEKIERD

SEQ ID NO: 6603 - protein, 59 aa, Artificial Sequence
  Synthetic sequence.
KETIKRLLDEVRKLVEDSLRHDEELVERNKKSIKDSLDEIERLLREIEELVRKVEEDER

SEQ ID NO: 6604 - protein, 56 aa, Artificial Sequence
  Synthetic sequence.
SDVDRVKEDAKRLVEESKRSVDESAKDMRRTLKRSRDESRRVKEELKRLVDRVKES

SEQ ID NO: 6605 - protein, 59 aa, Artificial Sequence
  Synthetic sequence.
KDEIRELLERVKKLVDESRRHDKRLVEENRRSARDSLREIERLLREVRKLVEKVLRDRK

SEQ ID NO: 6606 - protein, 60 aa, Artificial Sequence
  Synthetic sequence.
DEVETALEEVKELLERVLRKIEDDLRRVRDLLEKLKRTNEELLRKVREEVRRLADLIRKR

SEQ ID NO: 6607 - protein, 55 aa, Artificial Sequence
  Synthetic sequence.
ETVKREIEKARETLERLLKRSEEEVDRVKKEVEEISRRVKKEVKKLVDEIRERLR

SEQ ID NO: 6608 - protein, 60 aa, Artificial Sequence
  Synthetic sequence.
RRVEEVAKELKRIAEKLKRDIEELLRDDKRLADELRETNKELLRKDKEILDRLAEEIKRR

SEQ ID NO: 6609 - protein, 55 aa, Artificial Sequence
  Synthetic sequence.
ETVDRKIDELAERIRRLLEKVKRHVEETKRDVRRVSEEVRKHVEETKRDVRRRLK

SEQ ID NO: 6610 - protein, 60 aa, Artificial Sequence
  Synthetic sequence.
SRVEDLVRRIRELVRRDLKRIKDLEEEIKRLAEEIERHSKKVVDELKELADRLRKMLEEG

SEQ ID NO: 6611 - protein, 59 aa, Artificial Sequence
  Synthetic sequence.
KEKVDDIRREVKRVVRESEEANKRVRKLVEDIVKRAEDSNRRVEELVRELVEDLKRAAK

SEQ ID NO: 6612 - protein, 60 aa, Artificial Sequence
  Synthetic sequence.
SEVDELLKTIEKLARDDVKKIREVVEENKREVRRLEEHSKEVVKEIKDRIKEVLELLRRG

SEQ ID NO: 6613 - protein, 59 aa, Artificial Sequence
  Synthetic sequence.
ERVLERVERLVRRLAEESRRANEKSKEDTKRLEDRLKKSNDDLEKLVRDVVTRVREEAD

SEQ ID NO: 6614 - protein, 60 aa, Artificial Sequence
  Synthetic sequence.
DEVKELEKRIRKLVREIEEHSKEVVKENRRLVEEDLETIKEVLREIKRRIKKLLELLERG

SEQ ID NO: 6615 - protein, 59 aa, Artificial Sequence
  Synthetic sequence.
KDVLKTIKDTVEELVERLKRSNERSREETKKLVKRSREANKRVEDLVRKVVKELREAEK

SEQ ID NO: 6616 - protein, 60 aa, Artificial Sequence
  Synthetic sequence.
EEVERIVKEIRDLAEKDKEHSKRVEEEIRRLVEEVERHSRRVEEEIRRLAEELKRLLDRG

SEQ ID NO: 6617 - protein, 59 aa, Artificial Sequence
  Synthetic sequence.
EEKLEDLERKVRKLADESREVNDRLRELVERVVRRLEEVNERLERLVEELRRRLEEAKR

SEQ ID NO: 6618 - protein, 60 aa, Artificial Sequence
  Synthetic sequence.
DEVEELVERIKRLVERDEREIKRVEDEIERLVRRVDEHSKRVEEEIRRLVTELMELLDRG

SEQ ID NO: 6619 - protein, 59 aa, Artificial Sequence
  Synthetic sequence.
ERVVEKVRRLVDKLAERSRDLLRKLRDLVRRVVKRLEDVNRRLEELVRKLAEELKEKSR

SEQ ID NO: 6620 - protein, 60 aa, Artificial Sequence
  Synthetic sequence.
SEIEKILDDIRREAEKDLRLSEKIVEDIKRLAERDIKRLREIVEEIEKLLREVSDELRKR

SEQ ID NO: 6621 - protein, 62 aa, Artificial Sequence
  Synthetic sequence.
EDAERLIREVEKLVRDLVRESEKSNEEVRKLVEDLVRESDKVLKDVKRLVDEVVRRAREEVK

SEQ ID NO: 6622 - protein, 60 aa, Artificial Sequence
  Synthetic sequence.
SRIDEIVKRIEELARRDEEVSREIVKEIRDLAKRDEDTSKRIVEEIKELVKKIKEELERS

SEQ ID NO: 6623 - protein, 62 aa, Artificial Sequence
  Synthetic sequence.
EDAKRLLDKVRKTVEDLVRRSRKSNEDVRREVEKLVDRSRKSNTTVERLVRKVVRELRETVR

SEQ ID NO: 6624 - protein, 60 aa, Artificial Sequence
  Synthetic sequence.
SRAEEIVERIKKLAEDDKRESDRIVEEIKKLARDIEEAIRRIVKEIRDLVKEVRDVLERE

SEQ ID NO: 6625 - protein, 62 aa, Artificial Sequence
  Synthetic sequence.
ERAKELVEEVERLVRELVKDSDRSNKEVRRTVKEIVERAEKLVRDVEEDVERLVRDLKRKVK

SEQ ID NO: 6626 - protein, 60 aa, Artificial Sequence
  Synthetic sequence.
SEIEKILKEIEDLARRDEEVSKKIVEDIRRLAKEVEDTSRDIVRKIEELAKRVLDRLRKD

SEQ ID NO: 6627 - protein, 62 aa, Artificial Sequence
  Synthetic sequence.
EDAERLVREVEDLVRRLVRRSEKSNEEVKRTVEELVRRMEESNDRVRDLVRRLVEELKRAVD

SEQ ID NO: 6628 - protein, 60 aa, Artificial Sequence
  Synthetic sequence.
SEIEKLRKTVERIKEEVKRLSDEHKKRTRELERTSERLVEEHRERTEELRRRIEEIVRKK

SEQ ID NO: 6629 - protein, 56 aa, Artificial Sequence
  Synthetic sequence.
IDTLVEEIKELMKEDSERIKKSVKEVDDLAKEDSDRIRDSVRTVKELADEAIRRAK

SEQ ID NO: 6630 - protein, 60 aa, Artificial Sequence
  Synthetic sequence.
SEIERLEDRIRRLIRDSRELVKTLKKELKEIIERLEELSERLRREIERVVREVEDVVRKR

SEQ ID NO: 6631 - protein, 56 aa, Artificial Sequence
  Synthetic sequence.
IDELLKKLDEIATRDREKIERLREEIRKIARKDEEDIRKLVKEIRDEVRKLKEDAR

SEQ ID NO: 6632 - protein, 55 aa, Artificial Sequence
  Synthetic sequence.
SEVEELRELVKRLIERIKRVVETNERDLEELIKRVKDAVKKNKEDLERLIEEIDR

SEQ ID NO: 6633 - protein, 55 aa, Artificial Sequence
  Synthetic sequence.
KELLDELKRLIDEVEKKLRESNERVRRLAEEVLRRSKESNDRVRDEARKVKETAR

SEQ ID NO: 6634 - protein, 55 aa, Artificial Sequence
  Synthetic sequence.
DEVEALKRTVEELIKRIRKAVEDNERDLERLLKESRDVVKKNEEDLKRLIEEIER

SEQ ID NO: 6635 - protein, 56 aa, Artificial Sequence
  Synthetic sequence.
IEKLLRELERVIEEIVRRLEDSNRRVRDIARRDKERSKRSNDRVRRLAEEVKERAK

SEQ ID NO: 6636 - protein, 56 aa, Artificial Sequence
  Synthetic sequence.
SEVEELKKLVEELRREIRRLVRENEEDLKKLLEESKRMVERLKELVKKLIEDIRRT

SEQ ID NO: 6637 - protein, 55 aa, Artificial Sequence
  Synthetic sequence.
KELVDELKRVADEIVRRIRESNRKVRKIAEEDKTRIKRLLEELERLIADVERRAT

SEQ ID NO: 6638 - protein, 60 aa, Artificial Sequence
  Synthetic sequence.
SEVERLLRELERSVTEVKERVRRLVEELERIVREVKKRVDEHKERNKRALEDVKRKVRDR

SEQ ID NO: 6639 - protein, 55 aa, Artificial Sequence
  Synthetic sequence.
EEVEKRARKTTEDIKRMADKVTKVAEEVLRRVEKVVEEVREVSRRVVEDIERDTR

SEQ ID NO: 6640 - protein, 56 aa, Artificial Sequence
  Synthetic sequence.
KDVEKVIEDIERILTEVRRHSKEILDRIKRILETIREIVKEVKKRNEDLLREARES

SEQ ID NO: 6641 - protein, 58 aa, Artificial Sequence
  Synthetic sequence.
KSVEDARRAVERVVREARRSNEEVKRAVEEVAKELERLVKESEDESRRIVEELKKTVD

SEQ ID NO: 6642 - protein, 57 aa, Artificial Sequence
  Synthetic sequence.
DEVEEVIKRIRDILRRVEEHSEKILREIEKLLRDATRHSEEVKRRNEKILRDAENSR

SEQ ID NO: 6643 - protein, 58 aa, Artificial Sequence
  Synthetic sequence.
EDVKRVRDEVKKVVERVRRSNKKVEDMVREVERRLRESNKESREDSKRIVEEMDRRVK

SEQ ID NO: 6644 - protein, 59 aa, Artificial Sequence
  Synthetic sequence.
SEVEKIIDELRKVAEEHKRRVKELVDTNRKVLKEVKDRVRDLVRRVREILKDVSDKARR

SEQ ID NO: 6645 - protein, 54 aa, Artificial Sequence
  Synthetic sequence.
EIKEVLKESEEEVRRMLEELEKELRRSRKTVEELLRRLDKTLREVEEAVKRERD

SEQ ID NO: 6646 - protein, 60 aa, Artificial Sequence
  Synthetic sequence.
DRVEELLKRVREILERVEREARRLVEEVEDVMRRHKEKLEELVRHNREVLREVSREARRT

SEQ ID NO: 6647 - protein, 55 aa, Artificial Sequence
  Synthetic sequence.
EEVKKVLKEVEDTVRELVRRLEKKLKESIDTVERLLEELERVLRESNKTVEDETR

SEQ ID NO: 6648 - protein, 59 aa, Artificial Sequence
  Synthetic sequence.
DEVRKILRELREALKRHVEEVKRLLEHNERVLKKVKEDVERLMEEVKRALEDVKRDVDR

SEQ ID NO: 6649 - protein, 55 aa, Artificial Sequence
  Synthetic sequence.
KEVRKVLRESEKLIDDLLRELKRVLEETNRRVEDLLRRLEEVLRRVEKTVRDRAK

SEQ ID NO: 6650 - protein, 57 aa, Artificial Sequence
  Synthetic sequence.
SLKERLEKVVEESLRRVEEVIKKLERRVEESERRVEELVKTLRDVLRKILRELEKEG

SEQ ID NO: 6651 - protein, 59 aa, Artificial Sequence
  Synthetic sequence.
RETVERLLEEIRELLERSRKNVEDLERRIDKLLEDSERNARELLERIRKELRDISEKRK

SEQ ID NO: 6652 - protein, 57 aa, Artificial Sequence
  Synthetic sequence.
SMKEEIDRVVREVAENVRDMIRRLKRVLEESLRRVDELVKEIKKVLDDVRRRIEEDG

SEQ ID NO: 6653 - protein, 59 aa, Artificial Sequence
  Synthetic sequence.
EETVKRLVEKIRELNERSLDNVKKLLDRIRELLEESERNVKDIVRRIRDLLRRIKEKAT

SEQ ID NO: 6654 - protein, 60 aa, Artificial Sequence
  Synthetic sequence.
DEVERVLEEIERMLREVEEHTRRVVEEVRRVLEEVKRHSERVVREIRRLLEELRKLVERG

SEQ ID NO: 6655 - protein, 59 aa, Artificial Sequence
  Synthetic sequence.
KDLVRKVEEEVRRVKRELERLNKELEDEVRRIEEAAKRSNEELKKVVDEVKRELEKASK

SEQ ID NO: 6656 - protein, 60 aa, Artificial Sequence
  Synthetic sequence.
DEVDEVLKEIRKVLEDVRKHSEEVLREIERVVREVKKHSRKVVEEIKEVVKRLEDLARRG

SEQ ID NO: 6657 - protein, 59 aa, Artificial Sequence
  Synthetic sequence.
KRLVDKVRKVVEEVERELKKSVDDVRRVVEEVERRLREVNKEVEDVVREVEERVRRAAT

SEQ ID NO: 6658 - protein, 57 aa, Artificial Sequence
  Synthetic sequence.
DEEKEVEKVVRDVEDKLRRLLEENRDVSRKIKRELEELLKELKRSVDDSKEKLERKL

SEQ ID NO: 6659 - protein, 56 aa, Artificial Sequence
  Synthetic sequence.
IKTVLEEIKKLAKEAEEEIKRTLERVKKLLEEVRRVVEELLRRNRTLLREIVRKAK

SEQ ID NO: 6660 - protein, 57 aa, Artificial Sequence
  Synthetic sequence.
DEERELEEVVKDIERRSKKVVEDNRRVSEEIKRRLEKLLEENRKSAEDSKEMLRREL

SEQ ID NO: 6661 - protein, 56 aa, Artificial Sequence
  Synthetic sequence.
VKTIVTEVRDVVRRDKKKAEDTVRTVKELLDRARKKVEKTIRDNRKVLEEVVRKAR

SEQ ID NO: 6662 - protein, 57 aa, Artificial Sequence
  Synthetic sequence.
SELERVEKVVREVKKALEDLLRRNKESVDRSRTEARRLLEELRESVRRSEEMVRRKL

SEQ ID NO: 6663 - protein, 56 aa, Artificial Sequence
  Synthetic sequence.
VEKVLKEIRDLLREAAERVERSIRRNKKVLDDLKEVVERLLKENERLLREIVEDAR

SEQ ID NO: 6664 - protein, 57 aa, Artificial Sequence
  Synthetic sequence.
SAREKLRKVVEEIRRELKRLLEENKKVSDDIRRKLDELLKELEKSVKESIDTLRRDL

SEQ ID NO: 6665 - protein, 56 aa, Artificial Sequence
  Synthetic sequence.
VDTIVKELRELLKRAEEEVKKTSDRVADLVRRAEEVVKKLLRENEELLRRIVETAR

SEQ ID NO: 6666 - protein, 57 aa, Artificial Sequence
  Synthetic sequence.
SEKEKVEKVVDEVRRRLEDLLRRNRESVRRSDEELKRLLKRNKEVSDEIRKRLRREL

SEQ ID NO: 6667 - protein, 56 aa, Artificial Sequence
  Synthetic sequence.
VKTVLREIRELLKEAEERVKKSIKENEDLLDDVRRKVEESTERVERELERVSREAT

SEQ ID NO: 6668 - protein, 57 aa, Artificial Sequence
  Synthetic sequence.
DEDREVEEVVKEVEERLRRLLKKNEDVSREIEKRLKELLEKNKRSVEKSEEMLRRKL

SEQ ID NO: 6669 - protein, 56 aa, Artificial Sequence
  Synthetic sequence.
VDRVLEEIRELLKRVKEEVERTSRDVKEVLRRAEEEAKRTDDENRKLLEEVVEKAR

SEQ ID NO: 6670 - protein, 60 aa, Artificial Sequence
  Synthetic sequence.
DRSKEVVDRLEEELRKVKEDSKESVDRLRRLLEEVERRAEKSLRDSKEVLRRVKEEAERD

SEQ ID NO: 6671 - protein, 55 aa, Artificial Sequence
  Synthetic sequence.
RELEKVVRDIIDRVRKMLETSEEVIREVLERVRKVLEENRRVNKDIIDKVEERVR

SEQ ID NO: 6672 - protein, 60 aa, Artificial Sequence
  Synthetic sequence.
DEIERLIEEIKTVLDEIRKEAKRMIDENKRLLDEIRELSERVVEENRRLLEEIRDRAEKR

SEQ ID NO: 6673 - protein, 59 aa, Artificial Sequence
  Synthetic sequence.
KELADELRKVLKDVRREIEKLVRDAEKSNEDSRREVERLVKRNRESLEEIRKRVEDLVK

SEQ ID NO: 6674 - protein, 57 aa, Artificial Sequence
  Synthetic sequence.
SSKETLRKEVERLEKELKKLVDESRRVLEEVEREVRRAVRELEESVKKSAKRLRDRV

SEQ ID NO: 6675 - protein, 56 aa, Artificial Sequence
  Synthetic sequence.
VEKLIRRVEELLERVRELVKKNIREIEELLERLRRLVEKVIEDDKRMLKEVEEEAN

SEQ ID NO: 6676 - protein, 61 aa, Artificial Sequence
  Synthetic sequence.
REVEELIKRIERLLDEAREHSKEVIRRDEELLRRVRKIIEEIIREIERLLREAEDIARKRG

SEQ ID NO: 6677 - protein, 59 aa, Artificial Sequence
  Synthetic sequence.
EELLKRIEDVVRRVVEDLKRLNEEIRRSSEETEKELRRLLEEIRKVVEDVERRVRELVK

SEQ ID NO: 6678 - protein, 61 aa, Artificial Sequence
  Synthetic sequence.
DEVREVIKAIRKMLEEAEKHSRDVIRADKELLDKIARHSEEVIKEIRRLLRELEKIAKDKG

SEQ ID NO: 6679 - protein, 59 aa, Artificial Sequence
  Synthetic sequence.
EDLLRRIEEEVRRVVEALEKLNRDIEESSRRTEDTARKLNERIREVVEEVMRRVRKLVE

SEQ ID NO: 6680 - protein, 61 aa, Artificial Sequence
  Synthetic sequence.
SEVERVIEEIRKLLEDAKRHSDEVIKTDEDILRKVKKHSEEVIREIEKLLEEIEELARRRG

SEQ ID NO: 6681 - protein, 59 aa, Artificial Sequence
  Synthetic sequence.
EELLRRLEKLVEDVMRTLKKLNDEIRKSVDETEKTLEELNRRIRKTVEEVRKTAEDLVR

SEQ ID NO: 6682 - protein, 61 aa, Artificial Sequence
  Synthetic sequence.
DEVREVIRRIEKLLEDVKRHSERVIREDRKLLRDAERRAKEVIDEIRRVLEEAKEIVRREG

SEQ ID NO: 6683 - protein, 59 aa, Artificial Sequence
  Synthetic sequence.
EELLKTITDVVRKVEETLKKLNDEIRKSVEDTMRALKKLVDDLRRVVKEVEDRVREEAR

SEQ ID NO: 6684 - protein, 61 aa, Artificial Sequence
  Synthetic sequence.
DVVREVIKTIKKILDEVRDHTRRSIERNEKLLRDIRKIVEDSIRRNRKLLDDAKKVAERDL

SEQ ID NO: 6685 - protein, 59 aa, Artificial Sequence
  Synthetic sequence.
EEMVKTLKKVVEDVERELRRLNKEDEDTVREIAEAAERLVRDDERTVREIEEALKELVR

SEQ ID NO: 6686 - protein, 61 aa, Artificial Sequence
  Synthetic sequence.
DVIRDVEKKIRDILERVREHTKKSIKENRDILDDVRRHTEKSIKENEDILDEVRRVAERDL

SEQ ID NO: 6687 - protein, 59 aa, Artificial Sequence
  Synthetic sequence.
EEMVKRAKDVVDDVARRLEELNREDKKTVEEIVETAKELNERDKETVERIRKKLEDLVK

SEQ ID NO: 6688 - protein, 61 aa, Artificial Sequence
  Synthetic sequence.
DAVRKVIEDIKRALEEVRRHTKESIKRNEDILREVEKIARDIIREIRRILERVREVVERDL

SEQ ID NO: 6689 - protein, 59 aa, Artificial Sequence
  Synthetic sequence.
EEAVETLKRVVDDVAKKAKELNREDEETVRKIVEELKRLLDELRREVERVADEARRAVK

SEQ ID NO: 6690 - protein, 61 aa, Artificial Sequence
  Synthetic sequence.
SVAEEVIRRIEEILKRVEEHTRESIERNKKLLEEVRKHTEDVIRRIRELLERLERVVRRDL

SEQ ID NO: 6691 - protein, 59 aa, Artificial Sequence
  Synthetic sequence.
EEMVKRVKDVVDDVVRRLKDLNETDRRTVDEIVKEARRLNDELRKVVEEVEEKARRDVK

SEQ ID NO: 6692 - protein, 59 aa, Artificial Sequence
  Synthetic sequence.
DEVREIIERIKKLLDDIRKVAEESIRRNEKLLEEVRKRVRESIEELKRIKEEVEKLARE

SEQ ID NO: 6693 - protein, 59 aa, Artificial Sequence
  Synthetic sequence.
EDVVRTIEEVVRRVEKELRRLLEENERVIREIERELKKLVDDNKRVSDEIKDRAERLVD

SEQ ID NO: 6694 - protein, 59 aa, Artificial Sequence
  Synthetic sequence.
SEVEDIIRKIEESARRSEKVVRDSIRENRRLLEEVKREVDRSIERLEDIIRKVEEVARR

SEQ ID NO: 6695 - protein, 59 aa, Artificial Sequence
  Synthetic sequence.
ERAVDTIRRVVEKSKTVSKKVLDENREVVREVDERVRELVRKNEDVSRKIEERARRLLK

SEQ ID NO: 6696 - protein, 59 aa, Artificial Sequence
  Synthetic sequence.
DEEEEVERVVKEAEETIRELLERDKRVVKRLREEADRVLDEVREEVKRSEETAEDLRRK

SEQ ID NO: 6697 - protein, 56 aa, Artificial Sequence
  Synthetic sequence.
GEKLIKELEDVLRELEERSRKTLEELKDVLRKVKETIDELIRTNRRELEKLERDTR

SEQ ID NO: 6698 - protein, 59 aa, Artificial Sequence
  Synthetic sequence.
SEEEEVAKVVEDVRRRLEELKRAVEEVIRRTDEEAKRLLEADRRVVERVREEVKRLVEA

SEQ ID NO: 6699 - protein, 56 aa, Artificial Sequence
  Synthetic sequence.
GKELIKRLRDELKRLEDDARRILERNKKILEDVERESRRTLKELKDVLKELEERAR

SEQ ID NO: 6700 - protein, 60 aa, Artificial Sequence
  Synthetic sequence.
SLVEELERVVKDVEREARKLNEHNRENSKRVEDRLRELNEHLRKNTEEVKRRLEELIRKK

SEQ ID NO: 6701 - protein, 59 aa, Artificial Sequence
  Synthetic sequence.
EDAIREVLRRIERLLEEVKKKNEETSKRSKELLEENAKRNKEVSDRSKRLLEEIKRRAD

SEQ ID NO: 6702 - protein, 60 aa, Artificial Sequence
  Synthetic sequence.
SLTERLREVVRRVEEELKELIRHLRENSERVRKTLEELNRHLKENVEDVKRKLEDLIRKK

SEQ ID NO: 6703 - protein, 59 aa, Artificial Sequence
  Synthetic sequence.
KDAVERVIEEIERLLDEVKKTVEELSKTSKKLLDENKKENEDVSRKSEELLKKIADEVK

SEQ ID NO: 6704 - protein, 60 aa, Artificial Sequence
  Synthetic sequence.
SLKERLEEVVRRVRKELKKLIEHLERNVEEVRKTLEELNRHLDENVKRVKDTLTRLIEEK

SEQ ID NO: 6705 - protein, 59 aa, Artificial Sequence
  Synthetic sequence.
KDEFERVLKRIKEVLDEVKREVEELSKESEDLLRKNEERNKRASDRSEDLLKKIAEEVK

SEQ ID NO: 6706 - protein, 60 aa, Artificial Sequence
  Synthetic sequence.
SLLEELEKVVEEVKRSLDEVNKRNKKNTDDVAKTLTDLNEHLERNVRKVEEDAKDLVRKK

SEQ ID NO: 6707 - protein, 59 aa, Artificial Sequence
  Synthetic sequence.
EKLAKDVLREIRRVLEEVKRDNDRTSKESKDLLDENKKRNEEVSEESERLLRDIARKVD

SEQ ID NO: 6708 - protein, 60 aa, Artificial Sequence
  Synthetic sequence.
DLLEELKDVVDKVRRTLERLNEENRKNVEDVKRRLDDLNRKLEDNVRRVEERARELIKRK

SEQ ID NO: 6709 - protein, 59 aa, Artificial Sequence
  Synthetic sequence.
EKAVRDVLKEIEELLRKVTKENKDTSDESRRLVKTNEDLNREASKRSEDLLARVEEKVR

SEQ ID NO: 6710 - protein, 60 aa, Artificial Sequence
  Synthetic sequence.
SLTERLAEVVKRAEDLLRKLNEENKKNVEDVERTLRKLNKDLKDSVDRSRREAEKLIRRK

SEQ ID NO: 6711 - protein, 59 aa, Artificial Sequence
  Synthetic sequence.
KDAIEKVLEDIERVLREVEKRNRETSRDSERLLRRNEEENRKALERDEKVLKEVADEVE

SEQ ID NO: 6712 - protein, 60 aa, Artificial Sequence
  Synthetic sequence.
SLEEALEKIVREVKETLERLNKENRDSVRETADTLRKLNEELRRNVKRVEEALRDLIREK

SEQ ID NO: 6713 - protein, 59 aa, Artificial Sequence
  Synthetic sequence.
EEEAKRVLRKIEEDLKRVADINRKTIERDKKLLEDNERKNRKVSEESRELLEKIAKDVK

SEQ ID NO: 6714 - protein, 60 aa, Artificial Sequence
  Synthetic sequence.
KEVEEIIEEIKDRLRRLEETVERLLRENREMLRRTREEVKEIIKRIRDLLRELKKIAEKD

SEQ ID NO: 6715 - protein, 59 aa, Artificial Sequence
  Synthetic sequence.
KKLVEDVDKVVKEVEDRVRRLIEALKKVSEDLHRENKKLIEELEEVVKEVKERARELTR

SEQ ID NO: 6716 - protein, 60 aa, Artificial Sequence
  Synthetic sequence.
DEVKEIIKRIEDLLEDLKRKVERILREDERSLEESRKKVEEILKEIEDVLRKLKKDVEED

SEQ ID NO: 6717 - protein, 59 aa, Artificial Sequence
  Synthetic sequence.
ESAIKELRDVVREVKKRAKELIERLRESVERSRETNERLIRELEDVVRRVEETVRRLIK

SEQ ID NO: 6718 - protein, 60 aa, Artificial Sequence
  Synthetic sequence.
KKEEKIKRSVERSKEENERLIEELERSIRDTARRAEKLIERLEKVVREVDKRLRELREEG

SEQ ID NO: 6719 - protein, 56 aa, Artificial Sequence
  Synthetic sequence.
VETVLREDEDTLRRSEEKVDKLIKDDRRLLEELEDKVRELLRTVKELLKRTEERVT

SEQ ID NO: 6720 - protein, 60 aa, Artificial Sequence
  Synthetic sequence.
SSEERLKESIDRSKKRNKEAIEELEKSIRETEKTLEELIKTTRKSIEDVRKRLEDLERKG

SEQ ID NO: 6721 - protein, 56 aa, Artificial Sequence
  Synthetic sequence.
IDTLIEEDKETLRRSDEEVRRLIDEDRRLLEEVEKRARESNKEIRDLLRRVEEEAR

SEQ ID NO: 6722 - protein, 60 aa, Artificial Sequence
  Synthetic sequence.
SEEDELRESVKDSERRLRRLIEEDKRVVEEVEEENKRLIDKVREVIKRIEDRLDELRRRG

SEQ ID NO: 6723 - protein, 56 aa, Artificial Sequence
  Synthetic sequence.
VKEAIRRDRELLKRAEEESRRTLEEMRTSLEESKRRVEELIKTLKRLLDEAEKEAK

SEQ ID NO: 6724 - protein, 60 aa, Artificial Sequence
  Synthetic sequence.
SSEEKVEESIRRSKKRLEELIRDVERVVRKVEEDNRRLEEKLRKSIEDTRRKLEELKRRG

SEQ ID NO: 6725 - protein, 56 aa, Artificial Sequence
  Synthetic sequence.
FETLIRDDKRLLRKVEEDAKRLIKEIRDSLRESEKRVEELIDRDRRLAKEVEDRAR

SEQ ID NO: 6726 - protein, 59 aa, Artificial Sequence
  Synthetic sequence.
SSEERLRESIKRSKKRLEELIREVRKRIEEIRRKNEELIREVEEVIRRIREELKRLRDE

SEQ ID NO: 6727 - protein, 56 aa, Artificial Sequence
  Synthetic sequence.
IDELIKEDERLLREVEKKVKEIIKRLDDSLRDSERRAKELIRELEELLREAEERAK

SEQ ID NO: 6728 - protein, 59 aa, Artificial Sequence
  Synthetic sequence.
SSEDRLRKSIEDSRKRNEELTRALETVIREIRKRNARLIEEVKKVVEEVKRELERLREE

SEQ ID NO: 6729 - protein, 56 aa, Artificial Sequence
  Synthetic sequence.
IDTLIKRDRETLKESEDRVRKLLEDLRRSLRESEKEARRLIEEIRTLLEKVAREAT

SEQ ID NO: 6730 - protein, 56 aa, Artificial Sequence
  Synthetic sequence.
SEVEDVLRRIRELLEEVRELVERNLKEIKRLADEIERLAKENLERSRRLAEELRDG

SEQ ID NO: 6731 - protein, 59 aa, Artificial Sequence
  Synthetic sequence.
EDAVERVERILRDADEKIKELARESERLNRELDELIKRLVDESRELNRELEEIVRERAR

SEQ ID NO: 6732 - protein, 56 aa, Artificial Sequence
  Synthetic sequence.
REVEEVLKKIEDLARELTKKVRKNLEDIKKLAEEIRELAERVLRTSRELIKELRDG

SEQ ID NO: 6733 - protein, 59 aa, Artificial Sequence
  Synthetic sequence.
RELLEEVRKILEEMRRRVDELVRRSEELNRKLRELVERLVKELEDLNDEAKKIVDDRAR

SEQ ID NO: 6734 - protein, 56 aa, Artificial Sequence
  Synthetic sequence.
REVEEILKKIRTLLEEVKRRVEKNLEDIRKLLKELEDRVRRDLDEIRRLAEELRDG

SEQ ID NO: 6735 - protein, 59 aa, Artificial Sequence
  Synthetic sequence.
EKLLAEVRKVLKEAEDKIRELVERSKTINTEVKKEVDRLVEESKKLNKELEDEVDRRAK

SEQ ID NO: 6736 - protein, 56 aa, Artificial Sequence
  Synthetic sequence.
REVEEVLKKIRELIETLEELVRDDLRRIEELLRRIEDKVRENLRRIREVIKELRDG

SEQ ID NO: 6737 - protein, 59 aa, Artificial Sequence
  Synthetic sequence.
EDLLKRVKELLDDIRRKVDELIDRSRRLLEDLRRRVKELAEESKKLNEEAEKIVEDRAR

SEQ ID NO: 6738 - protein, 56 aa, Artificial Sequence
  Synthetic sequence.
KEVEEVLKEIKDIAEEIRELAERDLKRDKELVDEAEDLVRRNLEDIRRVIEELRDG

SEQ ID NO: 6739 - protein, 59 aa, Artificial Sequence
  Synthetic sequence.
EELLRRVEKLLEDLKRTVDEMVKRSEDSLRRSEETVRELEERSRRLNDEIRRIVDERAR

SEQ ID NO: 6740 - protein, 58 aa, Artificial Sequence
  Synthetic sequence.
SEVDKVVKEIKEKLDEIRKEVEKVVREDERLLEEIERLARKVVRENKELLKDIRREGR

SEQ ID NO: 6741 - protein, 59 aa, Artificial Sequence
  Synthetic sequence.
ETVARKLEEVVREVEEEVRRLEEKLKRSVEETEREIRRVVKELEDSVRETEREVRRLSK

SEQ ID NO: 6742 - protein, 60 aa, Artificial Sequence
  Synthetic sequence.
DDVEKLVRDIERLVEKVTRDNKKTVDDDKTLVDEARKENEETVERIKRELEELEKRVRKD

SEQ ID NO: 6743 - protein, 60 aa, Artificial Sequence
  Synthetic sequence.
SEEATRKLEKVLRDLEEELKRVDRENEKSLRESRKIVEDLDRTNKRVVDELRRIVEELRK

SEQ ID NO: 6744 - protein, 60 aa, Artificial Sequence
  Synthetic sequence.
DEIDDVLRKIEDLVRKLRELVKKVLEDSKRLLEEIKRLAKEALERSEELVRRVEELARRG

SEQ ID NO: 6745 - protein, 59 aa, Artificial Sequence
  Synthetic sequence.
EEVIRKLEEAVKRAEELVKRIEEELRKVDEEVERLVREIEKELREVNDRLRRLIEEIAR

SEQ ID NO: 6746 - protein, 61 aa, Artificial Sequence
  Synthetic sequence.
REIEEALKEIEKIIEDLRKIVEEVLKRLEEIDRELRKRNEDSNREIEKIIEDLKDMVRKKG

SEQ ID NO: 6747 - protein, 60 aa, Artificial Sequence
  Synthetic sequence.
SEEAERRAETVLRKLERVVDKVIKDIRKVLKDNERVVREVRKSAEELLDKLRKVVEEVRR

SEQ ID NO: 6748 - protein, 61 aa, Artificial Sequence
  Synthetic sequence.
REIEDVLRRIEEIIRELEERNKKSNKEIAEIDKELRDRNRKSNEEIEKIIEDLKEAVERKG

SEQ ID NO: 6749 - protein, 60 aa, Artificial Sequence
  Synthetic sequence.
SEEAEKRIRDVLDKLREVVERVIRSIEDMLRRNEKVVREVKESIERALKRLEETVKRVRD

SEQ ID NO: 6750 - protein, 61 aa, Artificial Sequence
  Synthetic sequence.
DEIEKMLRDIEEIIKRLRKIVEEVRDTLRRIDEDLRRRNEESNRRLEKIIEDLERVARRDG

SEQ ID NO: 6751 - protein, 60 aa, Artificial Sequence
  Synthetic sequence.
DKKAEDEIRKALRKLKEVVKKVLKEIAEMVERNDRELRRLEKSIRESLDKLRETVKRLED

SEQ ID NO: 6752 - protein, 57 aa, Artificial Sequence
  Synthetic sequence.
DLVEEIRKTIEKIVREIRKVLDEVRKHTEDVIRDIRRVLKEVERHSREVVKRIRDER

SEQ ID NO: 6753 - protein, 56 aa, Artificial Sequence
  Synthetic sequence.
KDELRKLVETLEKVVREVEEELRRLNEELEKVVREVEKRARESNDRLEKVVREVER

SEQ ID NO: 6754 - protein, 60 aa, Artificial Sequence
  Synthetic sequence.
SEVDEVVKEIRKLVEDDEREVEKAIRDIRRSNEELRERVERLLEELERLIKEVEETVRRM

SEQ ID NO: 6755 - protein, 58 aa, Artificial Sequence
  Synthetic sequence.
EAVEKARKILEEVEKVVTDTEKKLDDIRKHVKEVVDRLRKEIEDVLKRVRDVAERERR

SEQ ID NO: 6756 - protein, 60 aa, Artificial Sequence
  Synthetic sequence.
KVEELLKELLDRVKEVVDRIRRELEKALEESRRVVREVEERVKTANREVRKVVDDVRKRS

SEQ ID NO: 6757 - protein, 59 aa, Artificial Sequence
  Synthetic sequence.
EEDVRRVLEEIARLVRELEKMVRDVVKTSRDTVRKLREDVKKVVDENRKLAEKLKRDAD

SEQ ID NO: 6758 - protein, 60 aa, Artificial Sequence
  Synthetic sequence.
RIRETLTKLLEDVKEVVRETDELLKRLNRRVREVVRETEERLEDLNREVRKVVRDIERET

SEQ ID NO: 6759 - protein, 59 aa, Artificial Sequence
  Synthetic sequence.
EETVKDIVRKVKRLLEENRKLAEKITRDNEELLKENKEMLDEVRRRNTELLKRLREEAK

SEQ ID NO: 6760 - protein, 60 aa, Artificial Sequence
  Synthetic sequence.
RIEEDATRLIKEVKDVVKETEERARKVNKEVRDVVRDVERRLKELNEEVERVIRDVKRRS

SEQ ID NO: 6761 - protein, 59 aa, Artificial Sequence
  Synthetic sequence.
EKIADDVAKEIEDLVRRNREVVTEIEKKNRELVRRLRDMVRKVEEDNKRLLEELKKATD

SEQ ID NO: 6762 - protein, 60 aa, Artificial Sequence
  Synthetic sequence.
SVRELVEEARKHSRKVAEESRKLVEDLTEESKRVIDESREKVERLREEIERVLREVKKEG

SEQ ID NO: 6763 - protein, 56 aa, Artificial Sequence
  Synthetic sequence.
IERVLEEVEESDKRDEERVRKLEREIRESNKRDKEIVDRLLDELRRIVEELRERAR

SEQ ID NO: 6764 - protein, 59 aa, Artificial Sequence
  Synthetic sequence.
SVDEAVDELLKNSEEVIKDTERKARELLRHSREVNKRSERESERLKEEIERVLRKLKRD

SEQ ID NO: 6765 - protein, 56 aa, Artificial Sequence
  Synthetic sequence.
IEELVERIKDSNRRDKEIIKDLERKIRESDKRHKERVDDLARRVEEIVKELEEAAR

SEQ ID NO: 6766 - protein, 57 aa, Artificial Sequence
  Synthetic sequence.
SEVKKVEKEAEDISRRSRELLEKIREEVERLSRRSEELLKDVERKVRKVIKEIEDKR

SEQ ID NO: 6767 - protein, 56 aa, Artificial Sequence
  Synthetic sequence.
EETVRELIRDLRRNTKRVKEEADEMIRHLRENTERVEKRLRELREELKKVVERVRK

SEQ ID NO: 6768 - protein, 57 aa, Artificial Sequence
  Synthetic sequence.
EMVDRATEKVRTLSDESRRLLKKVRDENRKTSERSKRLLDEIERRVKEVLKRIRTER

SEQ ID NO: 6769 - protein, 56 aa, Artificial Sequence
  Synthetic sequence.
KDRVKRLIEELKENTERVEKSLRDLDRHNRRNTEEVKRSADELIEELKRVVDEVKK

SEQ ID NO: 6770 - protein, 57 aa, Artificial Sequence
  Synthetic sequence.
DKADEIEETVRRVSETSERLVEEVRKDNERTSKRSDDLLKDIEDKVRKVLERMRRER

SEQ ID NO: 6771 - protein, 56 aa, Artificial Sequence
  Synthetic sequence.
EEKVRRLIKELRDNTKKVAEELKKLDDHNERNVEEVKKRLEELIRRLEKVVEDVKR

SEQ ID NO: 6772 - protein, 57 aa, Artificial Sequence
  Synthetic sequence.
DFVKKAKDDVKEVSKESEKLLREIEEEVRRVSKRSRELLETVRRRVEKVLRDMERER

SEQ ID NO: 6773 - protein, 56 aa, Artificial Sequence
  Synthetic sequence.
EDRVRELIKELEENTRRVEEKLRKLIEDLKRNVREVEERARRLIEELREVVERVKT

SEQ ID NO: 6774 - protein, 60 aa, Artificial Sequence
  Synthetic sequence.
SDLERLKREAEELIERDKRLLRRVEEESRRTLEEDRRSLKESEDRARELIRRIEELAKKI

SEQ ID NO: 6775 - protein, 59 aa, Artificial Sequence
  Synthetic sequence.
DEMRDAARRLIEEITRSVEESERELKRLIEEDKRSVERSKKENDKLIEEVRRVVERVTK

SEQ ID NO: 6776 - protein, 60 aa, Artificial Sequence
  Synthetic sequence.
DVEEVLRKLKKEVEEVIRRTEAEVAKVLKEVEKVVTETREEVRRVLEEVKRVVDDVRRRN

SEQ ID NO: 6777 - protein, 56 aa, Artificial Sequence
  Synthetic sequence.
VEEVRKTVEKLIDDNRRMLEEVVKRAKELIEHNRRVVDKVLKEAKKIVRDLEETVR

SEQ ID NO: 6778 - protein, 60 aa, Artificial Sequence
  Synthetic sequence.
SVEEVLKKLLEEVRRVAEETRRRAEKLLDDDRKVAEESKKRAEELLKEVKDRVDDVRRRN

SEQ ID NO: 6779 - protein, 56 aa, Artificial Sequence
  Synthetic sequence.
MEKVARTIKKLIKENRKFLEEVEKRSRETLKTNKKVLRDLEKRAKKIIEDLERTLR

SEQ ID NO: 6780 - protein, 57 aa, Artificial Sequence
  Synthetic sequence.
KIEELMKRLEDEAKRSLDESEKKLEELRRDSERSVREVEELLKELLDRARRVLEKLG

SEQ ID NO: 6781 - protein, 59 aa, Artificial Sequence
  Synthetic sequence.
EEEVKRVAREVEELIERNRRHSDRIAEEVKETLERNREKVRRVLEKLKKELEDVLEKRK

SEQ ID NO: 6782 - protein, 56 aa, Artificial Sequence
  Synthetic sequence.
DIEELARRLEEAVKDSLRRVEEKLRRLEDESRRSVEDSDRKLKELIDRVRKVLKDL

SEQ ID NO: 6783 - protein, 59 aa, Artificial Sequence
  Synthetic sequence.
DEVVRRVARRIEELLKENDDLVRRVAEEIKRTLKENNEHSDDLRRRIEELIKEITERRR

SEQ ID NO: 6784 - protein, 56 aa, Artificial Sequence
  Synthetic sequence.
DIEELLERLRRRVEKSLEDSDRLLRKLEEDSKESVKRVKRLLEELIKRVKEVLKKA

SEQ ID NO: 6785 - protein, 59 aa, Artificial Sequence
  Synthetic sequence.
KELVKRALEEIEKRLKDNRDHSRRLAETVKDTLDKNDKKVEEVRREIEELLRRLDEKRN

SEQ ID NO: 6786 - protein, 56 aa, Artificial Sequence
  Synthetic sequence.
DIEDLLRELRKRVEDSLKKSEDRLRRLEEKVKRSLDEVEKELKRLLDEAKKVVDKA

SEQ ID NO: 6787 - protein, 59 aa, Artificial Sequence
  Synthetic sequence.
DEEVRRVLERIDRLIKRNDDHSRKLEKEIEDLLRRNNREAEEVAKEVEKLLEDLERRRK

SEQ ID NO: 6788 - protein, 60 aa, Artificial Sequence
  Synthetic sequence.
REIEEVVKELDDLLRRNDERVKRILDELEELIKKHDRRSDEVTKEIRELLRKLEREVERD

SEQ ID NO: 6789 - protein, 59 aa, Artificial Sequence
  Synthetic sequence.
KEARELAEELKKRAKESVDRSKKALEELKKRAREAVRRSREKLKKLKREVEKVVREVRR

SEQ ID NO: 6790 - protein, 60 aa, Artificial Sequence
  Synthetic sequence.
DELREILERVRRVLERSKELSEELLRRVEEVLRRLRKHSRDLEEKVRRILTEIEKRARER

SEQ ID NO: 6791 - protein, 59 aa, Artificial Sequence
  Synthetic sequence.
KDLREKLDKLRRDLEEVLRRNEEIVREATRRIRKVLDENRKKVEELKRRAERVLEELRR

SEQ ID NO: 6792 - protein, 60 aa, Artificial Sequence
  Synthetic sequence.
DDLRRIAKEVEKVLKTSEDLSEELKKEVKRVVDESREDSKRLREEVRKVLEEVKRLADRN

SEQ ID NO: 6793 - protein, 59 aa, Artificial Sequence
  Synthetic sequence.
RELKEILKELKKELERVLEDNRRKVKELEDELREVLKRNEKIARELEKELRRVLEEVRR

SEQ ID NO: 6794 - protein, 60 aa, Artificial Sequence
  Synthetic sequence.
DELRELEERAKKVVDESRENSDRLAKKVKEVLKRSRELSDELRKEVERVLREIKERARRK

SEQ ID NO: 6795 - protein, 59 aa, Artificial Sequence
  Synthetic sequence.
ERLRDILDKIAREVERVLEENRRIVTELKKELEKVLDENRKIVEELERRARKVLKELRD

SEQ ID NO: 6796 - protein, 60 aa, Artificial Sequence
  Synthetic sequence.
DELRELLEEVRRMLRESRENSRKLAEEVERVLRESEEDSKKLKRDVEKILEDVRRKLERN

SEQ ID NO: 6797 - protein, 59 aa, Artificial Sequence
  Synthetic sequence.
DELRRILDELRRRAKKVLDDNRKIVRDLERELRRVLEENRKIVEELEKLLEKVLEELRR

SEQ ID NO: 6798 - protein, 60 aa, Artificial Sequence
  Synthetic sequence.
KELEELAKTVEDLLRENDRLAEEVLRTVDDLLRKNDEISKRLLDTARKLLKELKDLKREN

SEQ ID NO: 6799 - protein, 59 aa, Artificial Sequence
  Synthetic sequence.
EDVKRILEKLIRDVEKSLKDVDDRLRELIRRVEESLRRNEEILKEVERRAEEVVEEVRR

SEQ ID NO: 6800 - protein, 60 aa, Artificial Sequence
  Synthetic sequence.
DDAERLLEDVRRLLEENDRISEEVLKTVKRIVDENDRLAEELLRTVDELVKRLKELRERN

SEQ ID NO: 6801 - protein, 59 aa, Artificial Sequence
  Synthetic sequence.
ERIRKILEKVIKEVEDSLRRNSEIVERAVDRARESVKRVKEIVETVERKIRKVVDEVRK

SEQ ID NO: 6802 - protein, 60 aa, Artificial Sequence
  Synthetic sequence.
SEVEEVKDRVTKLLKENDDISKELEERVRRLLEENDRHSREVEKTVRKLLEDLKRLAEEN

SEQ ID NO: 6803 - protein, 59 aa, Artificial Sequence
  Synthetic sequence.
KRVKDILRRLVEEAEESLRRNEKKLRELEKRVRESLKRSHKINKELEERVKEVLDRVRD

SEQ ID NO: 6804 - protein, 60 aa, Artificial Sequence
  Synthetic sequence.
DEVERVLEEAKKLLDTNDDLLRKLDDTVRKLVEDNNRISEEVRERVERLLRRLEELVRKN

SEQ ID NO: 6805 - protein, 59 aa, Artificial Sequence
  Synthetic sequence.
ERVKRILDRVIKEVTDSLKRVEDRLRELIRRVEESLKRNREELRRLEERVKDVLDKARR

SEQ ID NO: 6806 - protein, 60 aa, Artificial Sequence
  Synthetic sequence.
DRLEDLLRDVKRLLEENDKHSKEVEERIRKLVEDNNEISRTVARDVEEKLKRLRERTEEK

SEQ ID NO: 6807 - protein, 59 aa, Artificial Sequence
  Synthetic sequence.
ERVRRTLEELTRRVEESLKRSHEINRKVIREIEKSMDENKKELERLIDRARRVLEDVRK

SEQ ID NO: 6808 - protein, 60 aa, Artificial Sequence
  Synthetic sequence.
SEAEEVLKRAEEILRENNKISRDLEEEVRRLLKENDDLLREVEETVERLLEELKELAKRN

SEQ ID NO: 6809 - protein, 59 aa, Artificial Sequence
  Synthetic sequence.
ERVKKILERVIRELEKSLKDNERKLRELEERVRDSLRRVEESLRRLERRVEEVLERVRK

SEQ ID NO: 6810 - protein, 60 aa, Artificial Sequence
  Synthetic sequence.
DEMEKLRKDVKKLLEDNNKISRDVEKTVEELLRRNDEHSKEVLKRVEDLLRELKKLKDDK

SEQ ID NO: 6811 - protein, 59 aa, Artificial Sequence
  Synthetic sequence.
EDVKRILEELKKRAEDSLRENEKRLRELIREVEKSLRRSHEINRDAERKVRKVLDDVRR

SEQ ID NO: 6812 - protein, 58 aa, Artificial Sequence
  Synthetic sequence.
SEIEELLERVKELLKRNRELVERVKRTVEELNKDNDRVVKEIEDEARRLLDELEKIMR

SEQ ID NO: 6813 - protein, 59 aa, Artificial Sequence
  Synthetic sequence.
DRMRRIAKKAIDDVRKSVEDSKRILDELRKSTEESVKRTRDILKRVLDEAKKVVEDLRR

SEQ ID NO: 6814 - protein, 60 aa, Artificial Sequence
  Synthetic sequence.
DELEELRTRVEKLLKENNDLVREVLKTVKKLNDENRKLVERILREVERLLRELREIAKTT

SEQ ID NO: 6815 - protein, 59 aa, Artificial Sequence
  Synthetic sequence.
EEMRKKAEELRKRVDESVKDTRKKLEELRKSTEKSVRDTDRILKDLERRAREVVDELEK

SEQ ID NO: 6816 - protein, 60 aa, Artificial Sequence
  Synthetic sequence.
DVEEAVRELRETLDKSVERSERTVRELVKKLETSVEETREEVERVVEELDRVVEEAKKDV

SEQ ID NO: 6817 - protein, 55 aa, Artificial Sequence
  Synthetic sequence.
KEVRKEVKELVERDEDLVRKIREKVEKVVKDNKDLLRRIREAAKRVVREIRERLR

SEQ ID NO: 6818 - protein, 60 aa, Artificial Sequence
  Synthetic sequence.
STMDEIRRIVEKVLKEDKDLAETADRLNRDSVRRDEELAERNKRTNERVVREIEDRLKKE

SEQ ID NO: 6819 - protein, 59 aa, Artificial Sequence
  Synthetic sequence.
KRLEDIVREVKKRLEDSLRDTERIVREVDERNKESLRRSKEIVERVNKLLRDVLERART

SEQ ID NO: 6820 - protein, 61 aa, Artificial Sequence
  Synthetic sequence.
SSKEVADELRKKAEKVLDELRKIIRELERKNEDSLRRTEEIVRRLEEEAERVLRDLVRTRG

SEQ ID NO: 6821 - protein, 56 aa, Artificial Sequence
  Synthetic sequence.
IEDLRRTVDKLVEEIKDLARKLAKSSDDTVREDEKLVEELRKDVKRIVRKIKKDLE

SEQ ID NO: 6822 - protein, 56 aa, Artificial Sequence
  Synthetic sequence.
SAEEVVRELDKELKKVLEDSRDLVRRLEEELRKVLEDNEEVVKEIERSSDDVLRKL

SEQ ID NO: 6823 - protein, 55 aa, Artificial Sequence
  Synthetic sequence.
DELLRRVKELVERARRHSERLLEEVKRLVDEIRERSKELLERARRLNEEMKERTR

SEQ ID NO: 6824 - protein, 60 aa, Artificial Sequence
  Synthetic sequence.
SDLEELFREVKELVDDNLRKSDKLRRDVEKRVRDNERRSEKVHEDNRRLIEKIERLVRRG

SEQ ID NO: 6825 - protein, 59 aa, Artificial Sequence
  Synthetic sequence.
DRVRTLVKELRERAKKSLDDNRRMVEELRKRLEESLRRNKRVVEESEKIAKEVLDKVRT

SEQ ID NO: 6826 - protein, 60 aa, Artificial Sequence
  Synthetic sequence.
KDAEDLERRVRELVEENNRVSKRLAEEVTRLVKENEDKVRELEKEVRDRAKELLDMKRRG

SEQ ID NO: 6827 - protein, 59 aa, Artificial Sequence
  Synthetic sequence.
ERLKKLVDELRETLERSLRENEKVADELRKRAEKSLEDVKRVVDELRKIVDDVLKRVED

SEQ ID NO: 6828 - protein, 60 aa, Artificial Sequence
  Synthetic sequence.
DDLEELFERVKRLLERNNEVSKKLEDDVRKLIEDNERRVERVHRENEKELRRIEDLKRRG

SEQ ID NO: 6829 - protein, 59 aa, Artificial Sequence
  Synthetic sequence.
ERVRRLVEELRKLLEDSLEKNKRLVDELRKRAERSLREVRKLVERSKREAERVLEEVRK

SEQ ID NO: 6830 - protein, 60 aa, Artificial Sequence
  Synthetic sequence.
SRVEEMFERIERLVRRNNEVSRRVHERNRELIKRNREKVKKVHDDNKKLIDDLRELKRRG

SEQ ID NO: 6831 - protein, 59 aa, Artificial Sequence
  Synthetic sequence.
ERVRRLVEEARRLLKKSKDDNRRVVKRSREEVTRSLREVEKLVDESRREAEKVLEEVKK

SEQ ID NO: 6832 - protein, 60 aa, Artificial Sequence
  Synthetic sequence.
KELEEAFDRVRRLLEENKRKAEEVHRTNEELVRRNNEKSERVHRENEKEIERLDRAKKRG

SEQ ID NO: 6833 - protein, 59 aa, Artificial Sequence
  Synthetic sequence.
ERVKTLLKELRDRLKESRETVKELVDRSREEVKKSKKRNKKVVTDSRRRIKDVLDKVRK

SEQ ID NO: 6834 - protein, 60 aa, Artificial Sequence
  Synthetic sequence.
KEAEDMLRKVRKLIKENEKHSREVADEVRKLVEDNDRKVDEVHERNRKLITDLRRLAEEG

SEQ ID NO: 6835 - protein, 59 aa, Artificial Sequence
  Synthetic sequence.
ERLKTVVTELEKRARDSLEKSKEINKRLREELKRSEERVERLVRKSEEEAKKVLDDVRR

SEQ ID NO: 6836 - protein, 60 aa, Artificial Sequence
  Synthetic sequence.
SEIEKLVEDVRKLVEDNLRHSEEVHRRNRRLIEENERKIDELEKRVRKLVEELRELAERG

SEQ ID NO: 6837 - protein, 59 aa, Artificial Sequence
  Synthetic sequence.
ERVRTLVDRLREELKRSLDESEKLNRESRKRVTRSLEKVDDLVRELEKLARKVLEEVKT

SEQ ID NO: 6838 - protein, 60 aa, Artificial Sequence
  Synthetic sequence.
SEVEEIFKRVTDLLKRNRDLVREILERSRRLVERNDREAKKILDDARRLIEELEDAVRKE

SEQ ID NO: 6839 - protein, 59 aa, Artificial Sequence
  Synthetic sequence.
ERVKKLLDELRERVKRSVEESRRVLDDSRRKSEDSLRRSEELLKRVEEIVERVAREVER

SEQ ID NO: 6840 - protein, 60 aa, Artificial Sequence
  Synthetic sequence.
SEVEEIARRVDKLLKDNKRTVDEILKESRRLVKENNELVDKILREVEELLRRLEDEVRKE

SEQ ID NO: 6841 - protein, 59 aa, Artificial Sequence
  Synthetic sequence.
ERVEKLLRELEKRVKESVDTSREVLKRSREDSKRSEDRTEKVLREARKRVEDVADKVRK

SEQ ID NO: 6842 - protein, 60 aa, Artificial Sequence
  Synthetic sequence.
REVEEIVKEVERLVRENDKVAKEIVDESKRLVEENRKRVEEIRREVEELIRRLEDAVRKE

SEQ ID NO: 6843 - protein, 59 aa, Artificial Sequence
  Synthetic sequence.
KRVKDLLEELRKRVKDSRKKSEELLEESERRSKKSLDDTRRVLKDARDIVEKVADEVRK

SEQ ID NO: 6844 - protein, 60 aa, Artificial Sequence
  Synthetic sequence.
SDVEEIKKRVKELLEENKRLVETIEREVRRLIEENRRLAKRILDEVRRLLEELKDRVDKD

SEQ ID NO: 6845 - protein, 59 aa, Artificial Sequence
  Synthetic sequence.
ERVKKLLTDARKEVERSLRESKKALDELRRIVEKSLRDTERLLRTAEKEVEDVLREVER

SEQ ID NO: 6846 - protein, 60 aa, Artificial Sequence
  Synthetic sequence.
SEVEKIFRDVEDLLRRNEETAKEILKTSEELVRRNEELVRRILEEVRDLIRKLREVVERS

SEQ ID NO: 6847 - protein, 59 aa, Artificial Sequence
  Synthetic sequence.
RRVEELLRRLAEAVKESLERSERLLRRSEEESRRSLKKTEDILREAREIVRKVAEEVKK

SEQ ID NO: 6848 - protein, 60 aa, Artificial Sequence
  Synthetic sequence.
REVEEIVKEVRRRLERNDEVAERIVRESERLVEENNRLVEEILRRVRKLIEELLDLVRKS

SEQ ID NO: 6849 - protein, 59 aa, Artificial Sequence
  Synthetic sequence.
ERVEKLLRDLEREVDESRKKSRKLLERSREESDRSLKTTEDILREAERIVEKVEEDVRR

SEQ ID NO: 6850 - protein, 60 aa, Artificial Sequence
  Synthetic sequence.
SDVEEIVRRAEKLVEDNDRVAEKIHEDNRRSNKRTLDEVRKILEEVRKLIKDLEDEVRRD

SEQ ID NO: 6851 - protein, 59 aa, Artificial Sequence
  Synthetic sequence.
ERVKRLLRRVEKSVRDSKRRSEKLLEDSERSSEKVEKDVRDVLKEAREIVRDVAEKVEK

SEQ ID NO: 6852 - protein, 60 aa, Artificial Sequence
  Synthetic sequence.
EEVERIVEDVRRLLEENRELVKRILDEVRKLIKENNRLAREILETVRTELEKLRDLVRKL

SEQ ID NO: 6853 - protein, 59 aa, Artificial Sequence
  Synthetic sequence.
ERVEKLLEELERRVEESVEESERVLREAEKIVRDSRKTTEELLEEAKRRVDEVAKEVKK

SEQ ID NO: 6854 - protein, 60 aa, Artificial Sequence
  Synthetic sequence.
SSVDEILKDVRRSNKENLDLVEKILRESKKLVEENRRLVKEILDRVRKLIKELLRLVRED

SEQ ID NO: 6855 - protein, 59 aa, Artificial Sequence
  Synthetic sequence.
EKVEDVLRRLKRTSERSLEESKKLLEESEKDSDRSRKESEEVLREAEEIVKRVLKEVER

SEQ ID NO: 6856 - protein, 60 aa, Artificial Sequence
  Synthetic sequence.
DDVETIVERVRELLEENNRLAREIVERVEKLLKDNDDLVKEILEEVDRRIRKLEEAVKRD

SEQ ID NO: 6857 - protein, 59 aa, Artificial Sequence
  Synthetic sequence.
RRVEELLRKLEEDVKRSLEDTKRLLDELKKKVDESRKRSKDVLDKAREIVDRVRRSVEK

SEQ ID NO: 6858 - protein, 60 aa, Artificial Sequence
  Synthetic sequence.
SEVEKIVRDVEESNKKTKKKVEDIEEEVKDLVRKNNELVKRILEEVKRLLEELKRVKKDD

SEQ ID NO: 6859 - protein, 59 aa, Artificial Sequence
  Synthetic sequence.
ERVKRLLDRLRRTSEEVLERVEEVLKKAEEIVRKSFEDSKRVLRKAEEDVKRVARDVEK

SEQ ID NO: 6860 - protein, 57 aa, Artificial Sequence
  Synthetic sequence.
SVDEAAKEAEEIVETVERESRKLLEDSRRIVEEVKKRSEEILEEVRRRVEEVVKESK

SEQ ID NO: 6861 - protein, 56 aa, Artificial Sequence
  Synthetic sequence.
LERLLEALRRVIDEDRKRSKKLHEENKRVIERDKEISDKLLDDLRKLVADLRRRAK

SEQ ID NO: 6862 - protein, 56 aa, Artificial Sequence
  Synthetic sequence.
REAEELEKEVKKVVDDSKKRLDELDEENRRVDETIKKISEDLTREVKDVIRRIRDG

SEQ ID NO: 6863 - protein, 59 aa, Artificial Sequence
  Synthetic sequence.
EELRELVERLRRRLETVNRELERRVRELKRSNDESHRENREVIEELIKELKKVLDDVRK

SEQ ID NO: 6864 - protein, 56 aa, Artificial Sequence
  Synthetic sequence.
DELREILRKVEKVVEDIERTSDKLRREVDKVVDDSRRKLEELEKEVKKVIEDIRDG

SEQ ID NO: 6865 - protein, 59 aa, Artificial Sequence
  Synthetic sequence.
DRLKEAVKELAKRLKDVHERNKRLIDTLREKLKRINDELERSVRELKKELEEVIDRVRK

SEQ ID NO: 6866 - protein, 56 aa, Artificial Sequence
  Synthetic sequence.
DEVEELKRRVDRLVEEIRKLSEELLKRNRDVDREIKKRVKDLEDKVRKVIRDIEEG

SEQ ID NO: 6867 - protein, 59 aa, Artificial Sequence
  Synthetic sequence.
RELDEVIKEIRRRLEKVHRDNRRVIDEVRRSNRDSERDIAEAVERLTRLLETVLEKVKT

SEQ ID NO: 6868 - protein, 61 aa, Artificial Sequence
  Synthetic sequence.
DELEELRTTVTKLLEDLKKISDDLREEVRRLLEEVEEISKRLEETVRRIIKRVEDIVRRDG

SEQ ID NO: 6869 - protein, 59 aa, Artificial Sequence
  Synthetic sequence.
KDVKEVVKKLRDELRRVLERNKEVIDRLREKAREVLEKDRKLVDDLREEAREVLERVKT

SEQ ID NO: 6870 - protein, 61 aa, Artificial Sequence
  Synthetic sequence.
DELEEIKKEVEELVKTNERIVDKLREDNKRLVEEVKRISEELEREVRRIIREVREIVKRDG

SEQ ID NO: 6871 - protein, 59 aa, Artificial Sequence
  Synthetic sequence.
KDVEKLLRELEEEAKRSLKRNRDVIEKLREENKRLLDDDRRVVEELRKEAKDVLDEVEK

SEQ ID NO: 6872 - protein, 61 aa, Artificial Sequence
  Synthetic sequence.
REVDELKKTAEKLIRDDERLVEEVLRTSKKLVREDEDMVRKLRKTIEDLIRRLTDVAREEL

SEQ ID NO: 6873 - protein, 59 aa, Artificial Sequence
  Synthetic sequence.
RDVKRVLDEVEKLVEDSKRETERVLRESEERSRRSLEETEKALKDLAKLAEDIKREVEK

SEQ ID NO: 6874 - protein, 61 aa, Artificial Sequence
  Synthetic sequence.
REVDELRKRIEDLVRRDEEVARKVLEDVRRLVRRNREKARELLERVEKLVRDLKRVADRDL

SEQ ID NO: 6875 - protein, 59 aa, Artificial Sequence
  Synthetic sequence.
EEVKRVLDELRKLVKDSERKTKEVVEKVREDVKDSLRRSEEVLKRVKELVDRVADEVRK

SEQ ID NO: 6876 - protein, 61 aa, Artificial Sequence
  Synthetic sequence.
SDLEKLKERVDELIRRDDELVKRVLEESRRLVDRNKKKVDELRRRARKLIEDLKRVADRDL

SEQ ID NO: 6877 - protein, 59 aa, Artificial Sequence
  Synthetic sequence.
ERVKELLDRLRKKVEDSREKTERVLKESRELSDRSLERSEEVLERVRREVREVVERLKK

SEQ ID NO: 6878 - protein, 61 aa, Artificial Sequence
  Synthetic sequence.
DSLREVEKRIRELIRENEELVKEVLERSKRLVDEDRETAERLRKTVEELLKRLREVADKEL

SEQ ID NO: 6879 - protein, 59 aa, Artificial Sequence
  Synthetic sequence.
DEVRKALEDLKRTVDESERRTEEVLKESEDLSRRSLKETEDLLRELEKRVKEVADRVED

SEQ ID NO: 6880 - protein, 61 aa, Artificial Sequence
  Synthetic sequence.
SDLDEVRKEVKRLIDENRTLVDEIRRRIEKLIRENKKKVEELRKRAEELIRRLKEVADRDL

SEQ ID NO: 6881 - protein, 59 aa, Artificial Sequence
  Synthetic sequence.
RDVKRLLDDLKRLVKESLDETERVLRELRKEVKDSLRDSERALREVEDLVRRIKKRVEK

SEQ ID NO: 6882 - protein, 61 aa, Artificial Sequence
  Synthetic sequence.
DEVKKLEEDVRRLIEENEELVRRVKKTSDDLVKRNKEKVEELRKRVEDLIRRLREVERRDL

SEQ ID NO: 6883 - protein, 59 aa, Artificial Sequence
  Synthetic sequence.
DEVRKALERLRDEVRRSVTDTDRVLKESEDRSRKSLEDSERVLRELEELVKRILDDLAR

SEQ ID NO: 6884 - protein, 61 aa, Artificial Sequence
  Synthetic sequence.
SEVDRLRETIKRLLEENKELVERLRERVRKLIRENEKKVEELRDRAKKLIDRLREVRTRDL

SEQ ID NO: 6885 - protein, 59 aa, Artificial Sequence
  Synthetic sequence.
RDVERALKELRDRIEESLRRSEEVLKELEERVKESRDESRRVLEEVRRLVEEIKRRAEK

SEQ ID NO: 6886 - protein, 61 aa, Artificial Sequence
  Synthetic sequence.
KDVEDLEREIDRLLDEDRKVVEDLERKIKKLIDDNKRLVDKLREDVERLIRRLREVTEKEL

SEQ ID NO: 6887 - protein, 59 aa, Artificial Sequence
  Synthetic sequence.
KKVKEVLDELRKRVDRSLEEAEKALRRLEKLVRDSLRRSEEALERLKRLVDDVKKKVED

SEQ ID NO: 6888 - protein, 61 aa, Artificial Sequence
  Synthetic sequence.
SELDEVKRRAKELVDRDKKLVKEVLDTSRELVRRNEELVRRILEEVRKLIEDLAEVTKRDL

SEQ ID NO: 6889 - protein, 59 aa, Artificial Sequence
  Synthetic sequence.
KEVKELLDEVRRLAEESRREVERVLRESEKRSRESLKKSEDALERAKKLVEDIKDEVER

SEQ ID NO: 6890 - protein, 60 aa, Artificial Sequence
  Synthetic sequence.
SEEDKIREIVDRVLKESEKLIEEIERRVDKVLKRIKELTDEIKKRAEDVIREIEDIVRKE

SEQ ID NO: 6891 - protein, 59 aa, Artificial Sequence
  Synthetic sequence.
DELRKVVEEIKRELEKIDKKLEEVVRRIEKKLEDILKENSKAVREIRELLKKVKRELEK

SEQ ID NO: 6892 - protein, 60 aa, Artificial Sequence
  Synthetic sequence.
DEVEELKRRVEKLLEEIERLTKTHEDRSRRLIEDIRDSNRKLKEDAERLIKEIEELKRKV

SEQ ID NO: 6893 - protein, 59 aa, Artificial Sequence
  Synthetic sequence.
EELKKVVDDLRREAERILRRDEEAVKRSEKLLRDILEHVKRVVDEIREELKRILDRVRE

SEQ ID NO: 6894 - protein, 60 aa, Artificial Sequence
  Synthetic sequence.
DEVREIEKRVRDLIREIEKSNRDLEREAKRLIDEIDDLSRKLKEDADKLIEEIKELKKKV

SEQ ID NO: 6895 - protein, 59 aa, Artificial Sequence
  Synthetic sequence.
EEVRRVVEKLRRLLKTITEHVKEVLDRLRREAEDALRRDKEVADRIREEARRILEDVKK

SEQ ID NO: 6896 - protein, 60 aa, Artificial Sequence
  Synthetic sequence.
DDVKRIEKEVRRLLREIERLTREHEKESRELVREIEELSRRLEEEIKRLIEEIEELRKRV

SEQ ID NO: 6897 - protein, 59 aa, Artificial Sequence
  Synthetic sequence.
KEVRDVVKRLEEEIREVLAKDEEVARRSVEALADILRRDKDVVDRIRKLLKEILDRVRK

SEQ ID NO: 6898 - protein, 56 aa, Artificial Sequence
  Synthetic sequence.
DREEVVKEIKKRLEDLNRRVREVVKKIDRELEKLLEESKRVVDDLRRRLEELKKRI

SEQ ID NO: 6899 - protein, 56 aa, Artificial Sequence
  Synthetic sequence.
ERELERLVKEVEKTNERLLDELRKAAEEVAKRSEDTLRELRDIIKKVEERATDIAR

SEQ ID NO: 6900 - protein, 56 aa, Artificial Sequence
  Synthetic sequence.
SKEDVVREIEKTLKDLLDDSRRVVRESEERLKELNRRLREVVKESKRRLDEALRRI

SEQ ID NO: 6901 - protein, 56 aa, Artificial Sequence
  Synthetic sequence.
TEELRRLVDKVREDSERTLERDRRLAKEVSDRNKRLVEENRKIVEEVLKTIEELRR

SEQ ID NO: 6902 - protein, 56 aa, Artificial Sequence
  Synthetic sequence.
EREKVVKKIKEDLDRLNEEVKRVVDESRKLLKRLNERVEEVIREIRKTLEELTRRI

SEQ ID NO: 6903 - protein, 56 aa, Artificial Sequence
  Synthetic sequence.
ERELERLVAEVAERNKKLLKDDKDLARKVAEDNEDLLRRLRDEVEKVRRTADEIRR

SEQ ID NO: 6904 - protein, 56 aa, Artificial Sequence
  Synthetic sequence.
SREEVVDELRKRLEELNKEVREVVRESERKAERALEEVEEMVKRVREELEKLKRDI

SEQ ID NO: 6905 - protein, 56 aa, Artificial Sequence
  Synthetic sequence.
KDDLRRLLKEVAERNRKLLEDDEELAERVLREVRRLLEELRRRLKEIKERLDEIRR

SEQ ID NO: 6906 - protein, 56 aa, Artificial Sequence
  Synthetic sequence.
SREEVVRRADKLLKDLNKRVKEVIERSERKLRELNERVRDVVRKIEKRLEELERRI

SEQ ID NO: 6907 - protein, 56 aa, Artificial Sequence
  Synthetic sequence.
EEELKRVITKVLRDNEELLKTDEELAEDVARKNKKLLDDLEKTVKEVMDRAEELRR

SEQ ID NO: 6908 - protein, 56 aa, Artificial Sequence
  Synthetic sequence.
SREEVVRDIERRLRELNKRVADVADESRRRLEELNEKLRRVVEESRRRLEELRKEI

SEQ ID NO: 6909 - protein, 56 aa, Artificial Sequence
  Synthetic sequence.
DDTLRREVKKVERENERLLEEDRRLVREVTRRNEKLVKDNREIVKEVLERAKELTR

SEQ ID NO: 6910 - protein, 56 aa, Artificial Sequence
  Synthetic sequence.
SREEVVKEIKDRLKKLNDDVKRVIKESEDLLRKLNEEVRDVVRKIEETLEELLRRI

SEQ ID NO: 6911 - protein, 56 aa, Artificial Sequence
  Synthetic sequence.
EERLKEVVAKVAKENKDLLRRDEELARRVAERNKKLVEDLRRLVEEVRRRAEELRR

SEQ ID NO: 6912 - protein, 56 aa, Artificial Sequence
  Synthetic sequence.
SESERVEELLKEVAKRVKEVSDRSKRLLEEIERRVKEVSDESEELLRRIIDEAKKV

SEQ ID NO: 6913 - protein, 56 aa, Artificial Sequence
  Synthetic sequence.
ERVVDRVRRELEKLIKDLEENSREVERSLRELIEHLKKNVEDVEREAKRVIDELKT

SEQ ID NO: 6914 - protein, 60 aa, Artificial Sequence
  Synthetic sequence.
SLEEKLRRVLDELRKTIETLLKTNKDVLKKLEEDVKRIIRRNEEVLRDLERKVRDLKKKG

SEQ ID NO: 6915 - protein, 59 aa, Artificial Sequence
  Synthetic sequence.
ERLKRVVDELRKRAKKLLEDVERVIRKSEEEARRLLREVEKVVRELDREAEKLVEEVRR

SEQ ID NO: 6916 - protein, 60 aa, Artificial Sequence
  Synthetic sequence.
SSEETLRDILKKVEERSEETLRHNERVLEEVRKEVERILRRNEEVLRRLEKEAKELKKRG

SEQ ID NO: 6917 - protein, 59 aa, Artificial Sequence
  Synthetic sequence.
ERLKRVVDDLERRIRELLERDERVIRRTEEEARRLLDDVRRVVEELDKRAEDVVKEVKD

SEQ ID NO: 6918 - protein, 60 aa, Artificial Sequence
  Synthetic sequence.
DEEETLKKILDDVRKVSRDTMEENKTFLEELSKVADKIIRDNEKVLDDHRKAAEELKKRG

SEQ ID NO: 6919 - protein, 59 aa, Artificial Sequence
  Synthetic sequence.
ERLKRVVDDIRRSLEELLKRDEEVVEESRKEVKRLEEEVREVVTRSDKLMDELLKKVKR

SEQ ID NO: 6920 - protein, 61 aa, Artificial Sequence
  Synthetic sequence.
SEKEEVLREAREEAKDIERRLERLLERDKEVIDRVEKDLERLLRENKKLIDDVRRRVEEEG

SEQ ID NO: 6921 - protein, 55 aa, Artificial Sequence
  Synthetic sequence.
EVMDEIRRLAERVERRLREVLERSKKLVDDLRERLKEVLKRIEDLYRRLEEEADR

SEQ ID NO: 6922 - protein, 60 aa, Artificial Sequence
  Synthetic sequence.
TAKEVLDEIRKVHEDLNRKIEEVLKHSEDVLREVEERNERSVRHSEDMLRRLEERIDRKG

SEQ ID NO: 6923 - protein, 59 aa, Artificial Sequence
  Synthetic sequence.
EEVLRKLLEENKKEIRRLEEELKRLNEEVKKRIKELEDSSRKENDRVRERIRELDERVK

SEQ ID NO: 6924 - protein, 60 aa, Artificial Sequence
  Synthetic sequence.
TLDEAARTIEELLREVEERARRVLRHSEKVLDKVRKENEDSLRHSDEVLRRVEREAEKKG

SEQ ID NO: 6925 - protein, 59 aa, Artificial Sequence
  Synthetic sequence.
EEVIEKTLRDVERRLRDLEDKLRKLNEEVEKTIRDLRRSSEALNKKVKDLIKKLLDEVK

SEQ ID NO: 6926 - protein, 60 aa, Artificial Sequence
  Synthetic sequence.
TLDEVAKEIEELLRRVEEENRKSLEHSERVLDEVRERNERSARHSEEVLRRLREEVRRKG

SEQ ID NO: 6927 - protein, 59 aa, Artificial Sequence
  Synthetic sequence.
EKVIKETLDRVRETIKRLIKSSRDLNEEVKRRIRELIESSRKKNEDVKKTIEELLRRVK

SEQ ID NO: 6928 - protein, 60 aa, Artificial Sequence
  Synthetic sequence.
TADEVLKEIEDVHRRVNTENRKSIEHSKKVLEEVRRTNEKSIEDIERLLREVEKRIRDKG

SEQ ID NO: 6929 - protein, 59 aa, Artificial Sequence
  Synthetic sequence.
EDVLRKALEENERLIRELEESSRRLNERVKELIRELEKSSKRLLDEVKKLIDELREEVR

SEQ ID NO: 6930 - protein, 60 aa, Artificial Sequence
  Synthetic sequence.
TLEEVVEEIRRRHEEVNRRNRESVENSREVLERVEEDNKDSLRRIRELLERVARKLDERG

SEQ ID NO: 6931 - protein, 59 aa, Artificial Sequence
  Synthetic sequence.
EDAIRDMLRRNEERLRRLIESSEKLNRESRDVIRKLIESSRDLLRKVKETIEKLEEEVR

SEQ ID NO: 6932 - protein, 60 aa, Artificial Sequence
  Synthetic sequence.
TLEEVVRDIERVHEEVNESLKRVNETTTDMHRRLNEEAKRVLEEIEKLLKDVEKKIRDKG

SEQ ID NO: 6933 - protein, 59 aa, Artificial Sequence
  Synthetic sequence.
EDAVKRELDRNREEIKKLEKRIRDVLKKNKDLIDKVREELKRLLDEVKKRIDKLAEEVK

SEQ ID NO: 6934 - protein, 59 aa, Artificial Sequence
  Synthetic sequence.
SLDEAAKEIEELLRRSHEELKRVVKEIRDLLRRSHEELRRALEEIERLLDEVRRKLEER

SEQ ID NO: 6935 - protein, 59 aa, Artificial Sequence
  Synthetic sequence.
DETVKELLRRVRKLVRESIEEVKTLLREAEEKVRRNERKVEEILRRVRETIRRLEERIK

SEQ ID NO: 6936 - protein, 59 aa, Artificial Sequence
  Synthetic sequence.
SLDEALERIRRMLKRSHDENRRVAEDIKRLLEESHRENERVVKEIRDVLDKLREDAERN

SEQ ID NO: 6937 - protein, 59 aa, Artificial Sequence
  Synthetic sequence.
DEDVKRLLDDVRRTVEENIRRSETELRDVKRRVTETIRESERLLEEVKRIIDKLREEAK

SEQ ID NO: 6938 - protein, 59 aa, Artificial Sequence
  Synthetic sequence.
GLDEVLKEIRELLKESHDRLRRVLEEIEKLLEDSHRRNEEVVRRIRKVLEEVREKAERD

SEQ ID NO: 6939 - protein, 59 aa, Artificial Sequence
  Synthetic sequence.
ERLVKELLDRARDKIRRNIEELERKLRAVEEKVRRTIRESEELLDRVRKIIEDLEREAT

SEQ ID NO: 6940 - protein, 59 aa, Artificial Sequence
  Synthetic sequence.
DLDEALKEIERLLEEVERRNKEVLERIRRLLKRSHEELKRVLEEIEKLLRDLKKRVDDG

SEQ ID NO: 6941 - protein, 59 aa, Artificial Sequence
  Synthetic sequence.
RDSVRDLLRRAKERLDELIKTSKELLDRARKKVKENEEELRELLKDVRRIIKKLTEEVR

SEQ ID NO: 6942 - protein, 60 aa, Artificial Sequence
  Synthetic sequence.
SELEDLLREVKELIDRLIDDSRRLVKTAEELIREAIKRSEDLLEEVKRLIDRVTEMVERG

SEQ ID NO: 6943 - protein, 59 aa, Artificial Sequence
  Synthetic sequence.
ERVREVLERIKRLLEELKKRDEDSVREIERLLEELKRRNDRVVDEIRKLLKELAERVKK

SEQ ID NO: 6944 - protein, 59 aa, Artificial Sequence
  Synthetic sequence.
DLDEVIRELEKLLKESHEAVKRVIKKSEDLLRDSHKKVKDVIRRSEDLLRKLEEEVRKN

SEQ ID NO: 6945 - protein, 59 aa, Artificial Sequence
  Synthetic sequence.
RTLLEELRRRIEELLKENRELLKRHEDKSKKLLEDNERLLREHAKKSDEIRRELRERVR

SEQ ID NO: 6946 - protein, 59 aa, Artificial Sequence
  Synthetic sequence.
DEVERAKDVLDELRRRVEEELRRWKETSERLREESERALEKSEARLREAAEKLERVKRN

SEQ ID NO: 6947 - protein, 56 aa, Artificial Sequence
  Synthetic sequence.
EEVLRDIREKLRELAERLKRLLDDDKRVLDEVRKANEDLLRKIKEDIEELRKELEK

SEQ ID NO: 6948 - protein, 60 aa, Artificial Sequence
  Synthetic sequence.
DEDEEVKRTIEELRKEVEKTLREIEKSLKESEDKSRKHLEEVKKSLKETEEEVDELKKRN

SEQ ID NO: 6949 - protein, 56 aa, Artificial Sequence
  Synthetic sequence.
EKVLRELEERVRRLKKELKRVLDDYKRKLEEAERRNRKVLKEYEDSLRELADRLRR

SEQ ID NO: 6950 - protein, 59 aa, Artificial Sequence
  Synthetic sequence.
DEDREVRKTIEKLKRDSERHLEEMKRSAEESRKEVDKLLKKIKDSLRRTEERVRRLKKN

SEQ ID NO: 6951 - protein, 56 aa, Artificial Sequence
  Synthetic sequence.
EEVLRELRKIVEELRKRNEDVLEEYERILRELKERLDRVLKEYEDRLRELEKELRD

SEQ ID NO: 6952 - protein, 59 aa, Artificial Sequence
  Synthetic sequence.
SEAEKAKETIDRLADRVRKLLEEIKRSLDDSRRKSKETVEENEKTLDRMRKEVDAAKER

SEQ ID NO: 6953 - protein, 56 aa, Artificial Sequence
  Synthetic sequence.
EEVLRTLEEIIRRLTKELEDVLREYERELRRLEEENKRVIDKTEEEIRRLADRLRR

SEQ ID NO: 6954 - protein, 59 aa, Artificial Sequence
  Synthetic sequence.
EEDERADETLKRIKRESDETVKKNERTITELLKRVKRLVDEIRKSLEETARRVDSAKKR

SEQ ID NO: 6955 - protein, 56 aa, Artificial Sequence
  Synthetic sequence.
EEVLRKFRKILEEAAELNKEVIDRSRKIIEDASRLLREVLEDYETKLRELKDKLDT

SEQ ID NO: 6956 - protein, 56 aa, Artificial Sequence
  Synthetic sequence.
SLKEVIDDLERIIRELEKRNREVIKRVRKIVREAEEKNEDVIRKLKETIERLEREL

SEQ ID NO: 6957 - protein, 56 aa, Artificial Sequence
  Synthetic sequence.
SRELRDEIRKIKKKNDEHLKRLEDELRKLLEKSDRHVKELEDRIRKAAKEVKDAKD

SEQ ID NO: 6958 - protein, 56 aa, Artificial Sequence
  Synthetic sequence.
SLEDVIRDLARIIEEAERRNKTVLDELRKTIKELVEENEKVLDEDDKKSRELEKRL

SEQ ID NO: 6959 - protein, 56 aa, Artificial Sequence
  Synthetic sequence.
SRRLREEIKRLLRESEKHVEDLRREIERIKRENEEHLKKWRRDSERLEKEVEDAKR

SEQ ID NO: 6960 - protein, 56 aa, Artificial Sequence
  Synthetic sequence.
DELEKLRDDARRIEEKHRRTVEKDKDVVRRMDKEVKDHVRRLKELAKKLEDDVRKR

SEQ ID NO: 6961 - protein, 60 aa, Artificial Sequence
  Synthetic sequence.
KRSVDEVLREITEIVERVMELNDKSVEETRRIVERLKEEIDTVNDEIAKIVRKVIEEIKR

SEQ ID NO: 6962 - protein, 56 aa, Artificial Sequence
  Synthetic sequence.
DELERLKEAAKRLADEVKEHVDRSRENAKRLKEEVEEHVKRLEDVARTMDEEVKRR

SEQ ID NO: 6963 - protein, 60 aa, Artificial Sequence
  Synthetic sequence.
KESVDRVLKEIEDIVRRLEERLDESNKELKEIVDDVTEKLERVNRKIAEIVKRLSDEIRK

SEQ ID NO: 6964 - protein, 56 aa, Artificial Sequence
  Synthetic sequence.
DELEELRRAAEEMEKEVREHVKRSEKNAKDLEKEVREHVKKLREVLRRLTEKVKRR

SEQ ID NO: 6965 - protein, 60 aa, Artificial Sequence
  Synthetic sequence.
KEKVDRVLEEITREVERLKKELDESNERLERIVRKVIEELRKVDEDAEERVRRLEEEIRR

SEQ ID NO: 6966 - protein, 56 aa, Artificial Sequence
  Synthetic sequence.
DDLDRLREAAERMAREVEDHVRKLKDLIRRVRERVERHVKKLEDDLKRVKEEVDRR

SEQ ID NO: 6967 - protein, 60 aa, Artificial Sequence
  Synthetic sequence.
KDKVRKVLEDIKRIVDRLEERIREVDKDLERIVRELMKRLDEVNKRLEDTVRRLSEEIRR

SEQ ID NO: 6968 - protein, 60 aa, Artificial Sequence
  Synthetic sequence.
DLIEEIKKLAEDHHRRVKEVLDRNREVAERLKKRVRRIVEENKRLAEDVTRKIKELKRRV

SEQ ID NO: 6969 - protein, 59 aa, Artificial Sequence
  Synthetic sequence.
EDLRRVLEELREIVTRNEKEIRDTIRELEEIVKRLKEDNDRSVRELERILEELREELER

SEQ ID NO: 6970 - protein, 57 aa, Artificial Sequence
  Synthetic sequence.
DSDEEVRRVLEKVEEDVRRLAKDIRDSVRRSEERIDELVKKLEKSIDESRRRVETTA

SEQ ID NO: 6971 - protein, 55 aa, Artificial Sequence
  Synthetic sequence.
ERLLEEIEKVVEDLRRKAEELIEKNERLLRRLEEVAKELDKRNKELLEELIRRNE

SEQ ID NO: 6972 - protein, 57 aa, Artificial Sequence
  Synthetic sequence.
SEADKVREVLKRVKEEIDRLVEEIEKVNRDSRREVEKLVEKLRKSLKESKDRIARDL

SEQ ID NO: 6973 - protein, 55 aa, Artificial Sequence
  Synthetic sequence.
EELLRKIEEVLRRLTEDAKRLIRRNREILKELRELAKRLDEENKELLDELIKKAR

SEQ ID NO: 6974 - protein, 57 aa, Artificial Sequence
  Synthetic sequence.
SMIEKVREVLKEVADRVRRLLEENKKSIDDSARALEELIKRIRESLRKSEEDLKREV

SEQ ID NO: 6975 - protein, 59 aa, Artificial Sequence
  Synthetic sequence.
SEFVKRILDEVDEILKRLERRVKEHSRKNREELEKIRKEAEEILRENEELLEKIVRDAR

SEQ ID NO: 6976 - protein, 57 aa, Artificial Sequence
  Synthetic sequence.
EMVERLEESIDRSRKELDRLIEENKKVLEEVEERVRRLIEKLKRSIEESEERLRRKV

SEQ ID NO: 6977 - protein, 59 aa, Artificial Sequence
  Synthetic sequence.
DEVVRRLNEENKKLLEDIRRRAKDHSRRVREILEDLEREVEKMNEENKDLLERIVRRAK

SEQ ID NO: 6978 - protein, 57 aa, Artificial Sequence
  Synthetic sequence.
SMIEALKENIRRSEEEIRRLIEEWRKVSEDIEREVKKLIKELEESIDESAKRLREKV

SEQ ID NO: 6979 - protein, 59 aa, Artificial Sequence
  Synthetic sequence.
SDFVRKLLEENNELLKEIKKRVEKVLEESKELLKELREKIRRLNEKNKKLLEEIVRRAK

SEQ ID NO: 6980 - protein, 56 aa, Artificial Sequence
  Synthetic sequence.
SEIEKVVKDLRERLKELRESVKRLDDKNRELLERLEREVEEMDRRNEKLLRDLKRQ

SEQ ID NO: 6981 - protein, 59 aa, Artificial Sequence
  Synthetic sequence.
EELLRTLEKVLREIAEELERLNRKVRESIRESARRLKRLIEKLERSIRRSAEELRKRAK

SEQ ID NO: 6982 - protein, 56 aa, Artificial Sequence
  Synthetic sequence.
DEIDKIVKKLRDILREIEKRAKEVNKRNKELLDELRERVKDLDRTNEELLRELKDS

SEQ ID NO: 6983 - protein, 59 aa, Artificial Sequence
  Synthetic sequence.
DKLLKKLKDVLDEIAERIKELIRELRESIKKSAEELKRLIDRVRRSIEESAKRLEDRAR

SEQ ID NO: 6984 - protein, 56 aa, Artificial Sequence
  Synthetic sequence.
SELEKILEKLRRIVEELAKSVRKLNEENKELLKRLADSVKKLDDDNKRLLTDLRRR

SEQ ID NO: 6985 - protein, 59 aa, Artificial Sequence
  Synthetic sequence.
EELLRTLEDVLRKIAEDLERMNRELKRSIKKSADDLKRLNEKVKRSIERSAEELRKRRT

SEQ ID NO: 6986 - protein, 56 aa, Artificial Sequence
  Synthetic sequence.
DEIKKIVEEIKKTLEEIDKSVRELIRRAREILRELEESVRELIRRNSKLLEDLRRQ

SEQ ID NO: 6987 - protein, 59 aa, Artificial Sequence
  Synthetic sequence.
DELLKELEDVLKEVAEEIKRLNERLKKVLEEIERTLRELNRRLEENIRRSARALEETRR

SEQ ID NO: 6988 - protein, 56 aa, Artificial Sequence
  Synthetic sequence.
SEVEDLLRRIEKILEDLRRSVEELLKRIEDALRRLEEEIRKVTEESKRLLEDLTRR

SEQ ID NO: 6989 - protein, 59 aa, Artificial Sequence
  Synthetic sequence.
RELIEEVEKVVKRVEEALKRLNDRVRETLDEVRKRLEDAIRRWREESERIARELEKRTT

SEQ ID NO: 6990 - protein, 56 aa, Artificial Sequence
  Synthetic sequence.
SEADEIVRRIEELLKELEREIRKVIRDSERLLKELEDSVRELLKKIRDVLDELTKS

SEQ ID NO: 6991 - protein, 59 aa, Artificial Sequence
  Synthetic sequence.
EELLRKLEAVLDKVKKDLKKMIDDWRRVSERIARELEKLNRRVKEELDRVKEALDERTR

SEQ ID NO: 6992 - protein, 57 aa, Artificial Sequence
  Synthetic sequence.
SEIDEVVERIKRTLEEAEKRVKKASEDHKRRLDELRKKVEKLIEDNERTLEAVARRK

SEQ ID NO: 6993 - protein, 59 aa, Artificial Sequence
  Synthetic sequence.
ERLLRKLRKVVKDVDDRLKELLEENRDVVRRIKEELEKLLEKVRRSIEESRRRMRETRR

SEQ ID NO: 6994 - protein, 57 aa, Artificial Sequence
  Synthetic sequence.
SEVDEVLKDIRRILEEARKRVEELDRENKRILDEVREKVKELNERNKEILRAAEERK

SEQ ID NO: 6995 - protein, 59 aa, Artificial Sequence
  Synthetic sequence.
EKLLRDAKRVVEEVSKALKDLLKEVEDSVRRSKREMEKLLEELRESVKRSEEELRRTSK

SEQ ID NO: 6996 - protein, 60 aa, Artificial Sequence
  Synthetic sequence.
DEVEDLLRRNEELLKRLLEEIKKLTDEHREELKRLAEDVKKVVEDVRRLLKELEEMVRRG

SEQ ID NO: 6997 - protein, 59 aa, Artificial Sequence
  Synthetic sequence.
EKLVRKLEESVRRSTEELEKALKRNNDVIRRIAEALDDLLRRLEKVIREIEKKLRDDTR

SEQ ID NO: 6998 - protein, 60 aa, Artificial Sequence
  Synthetic sequence.
DRVEEAVKDIERLLRELKRDVERLVRENEKILKDAKREVDELTKDHRRKVEELDEMVKRG

SEQ ID NO: 6999 - protein, 59 aa, Artificial Sequence
  Synthetic sequence.
EDLLRKLEKVVRDVEKKLRKLLEDLKRSIDRSTRELEKLNEKNNEVIRDIERRLDEAET

SEQ ID NO: 7000 - protein, 56 aa, Artificial Sequence
  Synthetic sequence.
SEIEKLIEEIRRVVKEIKREVERAIRENEKLLRESKRRNDELIKEIERVVEELKKR

SEQ ID NO: 7001 - protein, 58 aa, Artificial Sequence
  Synthetic sequence.
RLIEELEKVLRDVEKVARDVLRKLRRSIEESRRRSEELNKTVKKVLEDVARTATERSR

SEQ ID NO: 7002 - protein, 57 aa, Artificial Sequence
  Synthetic sequence.
REIEEAIKDVERVLRESEERNRRLIERIKRMLKKSEDENRKFIEDNKRLADDLRRRN

SEQ ID NO: 7003 - protein, 58 aa, Artificial Sequence
  Synthetic sequence.
EDVERLRKVIEEVKRRMKELNERLKEELREVAKRSRDLNKELRESIEESADRARRRRK

SEQ ID NO: 7004 - protein, 57 aa, Artificial Sequence
  Synthetic sequence.
DEIERLREDIKRVLEESTRRNKKLLDEIRKALDESRRKNEEAIRRNEEVVRDLKDRK

SEQ ID NO: 7005 - protein, 58 aa, Artificial Sequence
  Synthetic sequence.
DKVRTLRRELEEVARALEELNRRVEEELDEVRKESERLNKELEDSIRKSAEDAKRTTK

SEQ ID NO: 7006 - protein, 60 aa, Artificial Sequence
  Synthetic sequence.
DEKDKAIEDVRDLLRRNEEVARRMDKRLKDLLDTIRKKAEDLDRELKRLLEEAERLVREG

SEQ ID NO: 7007 - protein, 55 aa, Artificial Sequence
  Synthetic sequence.
KELEKVLEEIRRRSEELLKHHAEVIERIERDVERLRRHHEDTIRKIKEKVDRDRK

SEQ ID NO: 7008 - protein, 60 aa, Artificial Sequence
  Synthetic sequence.
DEDREAIKEVEKLLRDNERVARRLDEEVKELLDEMRRRSEEMDRELERLLEEAKRLADKG

SEQ ID NO: 7009 - protein, 55 aa, Artificial Sequence
  Synthetic sequence.
EELKEVLREVDKRSKELLKHHKRRIEEVRKRVRELNKHHEDVIRKIKKKVREDRK

SEQ ID NO: 7010 - protein, 60 aa, Artificial Sequence
  Synthetic sequence.
KEAEEAIKRVEDLLRRNKEVAERIIREIRRLLREADETSKRMDEDLRRLLREAEDLVRRG

SEQ ID NO: 7011 - protein, 55 aa, Artificial Sequence
  Synthetic sequence.
RELDKVLERVKRESDRLLKEIEKVVREVEERLRRLNEHHEKVIREIEKKLEDDRR

SEQ ID NO: 7012 - protein, 60 aa, Artificial Sequence
  Synthetic sequence.
DEDREAIERVRRLLDENRKVVEELDERLKELLRDAEEKSRRVIKTLRELLKEIEDLARRG

SEQ ID NO: 7013 - protein, 55 aa, Artificial Sequence
  Synthetic sequence.
DELRKVLEDVERASKELLDHHRDVIRRIEEELKRLNKELEKVIREIERAVEELER

SEQ ID NO: 7014 - protein, 60 aa, Artificial Sequence
  Synthetic sequence.
DEDRDAIRKVEDLLRRIEEIVRRLIEEVKRLLEDNRRKSKRFIERVDELLKEMEKLVREG

SEQ ID NO: 7015 - protein, 55 aa, Artificial Sequence
  Synthetic sequence.
KELEELLRRVEREVEKLLTDLRRLLREVKETSKRLNEELKRRADEVEKKADEDRK

SEQ ID NO: 7016 - protein, 61 aa, Artificial Sequence
  Synthetic sequence.
SSKDRIRKVLEEVRETLDRLAKRIEKSLRDSAKRVEDLAEENRTSLKETKERIDELIKRRK

SEQ ID NO: 7017 - protein, 55 aa, Artificial Sequence
  Synthetic sequence.
EELIRRIEEELKRIEDTVEKIIRKDEKLLEDIERESERHIREDKELLKELEKEER

SEQ ID NO: 7018 - protein, 61 aa, Artificial Sequence
  Synthetic sequence.
SSDKEIEDVLRKVKDELDKLARALDESLKRSEKDIDRLEEELKESHDRTREEIRKLIEERN

SEQ ID NO: 7019 - protein, 55 aa, Artificial Sequence
  Synthetic sequence.
DELIREIKKVLDRIREEIERLLREDEELLERLREDAKRILDKNKELLDELRRRVK

SEQ ID NO: 7020 - protein, 56 aa, Artificial Sequence
  Synthetic sequence.
SADRKLEEVLKKVEDDIRDLERRLKRSLDESKREVERLERENRRVLEEVEKKVRAD

SEQ ID NO: 7021 - protein, 59 aa, Artificial Sequence
  Synthetic sequence.
EETVKRIIEKIERILRKLKRDAERILDKDRKLLKKLEEESRKHIEDVKRLLEELERRTR

SEQ ID NO: 7022 - protein, 56 aa, Artificial Sequence
  Synthetic sequence.
ELEEKLKRSLEDSRRRVEELRRTNEEVLREVEEEIRRLIKENEDSLRESKKRVDDR

SEQ ID NO: 7023 - protein, 59 aa, Artificial Sequence
  Synthetic sequence.
KETVDKILEDDKELLRRLEEESKRHIDEVRKILEDLERRSRRHIEEDKKLITELEKETK

SEQ ID NO: 7024 - protein, 56 aa, Artificial Sequence
  Synthetic sequence.
DLDERLRRSLKRSKEEVERLRKENEEVLRRSKETTKELIKTNEKVLEDVERLVRES

SEQ ID NO: 7025 - protein, 59 aa, Artificial Sequence
  Synthetic sequence.
RETVEKIIKEDEDLLRKLKEESDRHIKDVERVARENERESKRHIEEVRKVLDELREETR

SEQ ID NO: 7026 - protein, 56 aa, Artificial Sequence
  Synthetic sequence.
SAEEKLEEVLKRVAERIEELIRRNRRVLDRVREEIKRLVEENRKSLDESERRVRER

SEQ ID NO: 7027 - protein, 59 aa, Artificial Sequence
  Synthetic sequence.
EETIERIIKKIEDILRKLEEESERHIRRVEEELKEMEKRSREHIEEDKRLLEELERRTK

SEQ ID NO: 7028 - protein, 56 aa, Artificial Sequence
  Synthetic sequence.
SAEDELRKVLEKVREDIDRLADENRKVLKRSKDETKRLIKENREVLERVEEIIRRD

SEQ ID NO: 7029 - protein, 59 aa, Artificial Sequence
  Synthetic sequence.
EEAIERIIRRIREILERLRKKSEEHIRRVEDVARRNEEESREHIKTVEKILEELKRKAD

SEQ ID NO: 7030 - protein, 56 aa, Artificial Sequence
  Synthetic sequence.
SEVEELIKRLKKVLKELVDKVRKVIEDTKELLERLKRRSEDHIRKLREVLKEAKDQ

SEQ ID NO: 7031 - protein, 59 aa, Artificial Sequence
  Synthetic sequence.
EELDRRIEKVLKEIEEKIREVIKEWERVHREVNELLKRLIDENRKVLDEIRKLLEEKSK

SEQ ID NO: 7032 - protein, 56 aa, Artificial Sequence
  Synthetic sequence.
SEAEDLIRRLKEVLDELKKKADDLIRDTKRLLDEIRKKSEDHIKRDKELLKDLKRR

SEQ ID NO: 7033 - protein, 59 aa, Artificial Sequence
  Synthetic sequence.
DRALREIEKVLKEIKELIEKVIRDWKRVHDEVNEELRRLIEKNRKSLKETADELDRKRK

SEQ ID NO: 7034 - protein, 56 aa, Artificial Sequence
  Synthetic sequence.
SEVEKLIKEDKELLERLKRDVERLIEELRRTLKELKKESEKHIEDDKRLLDDLRDR

SEQ ID NO: 7035 - protein, 59 aa, Artificial Sequence
  Synthetic sequence.
DKLITDIRRSLDETRRRIEKLIREIEKVLREIEETLRELEKRNRESLERTRETLERKSK

SEQ ID NO: 7036 - protein, 60 aa, Artificial Sequence
  Synthetic sequence.
SEVDELIERDKKLLRDVERDVRRLNKEVRDILDEIRKDVEDALKENKELLDRLREMVKRG

SEQ ID NO: 7037 - protein, 59 aa, Artificial Sequence
  Synthetic sequence.
REVLKRLEDSSKDTTDKLRELLRSHKKVIDEVREKLKELLDRYRKVSDEIREEIDRARK

SEQ ID NO: 7038 - protein, 60 aa, Artificial Sequence
  Synthetic sequence.
SEVEKLIEDDRKLLEDAEEEVRRNNREIERILDKAREDVKRIIKEIEDLLREADEAAKRG

SEQ ID NO: 7039 - protein, 59 aa, Artificial Sequence
  Synthetic sequence.
EEAKRRIKKSIDDSRRELKRLLESNRKVIEEVKKTLEELIRTLEEVVRRVEDRLKKLAD

SEQ ID NO: 7040 - protein, 61 aa, Artificial Sequence
  Synthetic sequence.
DSVEELLKRLRDLLEESKRRAERLIREIERLLRESEKRVRELNRRLEELLREAEDRVRKEG

SEQ ID NO: 7041 - protein, 59 aa, Artificial Sequence
  Synthetic sequence.
EDALRKLEKVIREIEREHRRLLEEIRRVLKEVDKRHDEVRKSHEDVIRRIEERLERLKK

SEQ ID NO: 7042 - protein, 61 aa, Artificial Sequence
  Synthetic sequence.
DSVERLIEEIRRLLKRSEEIARKLIRDAEKLLEEHRRRVEELNREIERKLEELDEKARRRG

SEQ ID NO: 7043 - protein, 59 aa, Artificial Sequence
  Synthetic sequence.
REALEKIRKVIKEVKDTHRDLLRRVRDVIRRIREASKETERSHREVIERVRKRLDELTK

SEQ ID NO: 7044 - protein, 61 aa, Artificial Sequence
  Synthetic sequence.
KSVDDIIREIRKLLEDHKRRVDELLERLKKLLEDHRRTVDKLIKDLERLLEELARRVKREG

SEQ ID NO: 7045 - protein, 59 aa, Artificial Sequence
  Synthetic sequence.
REALERIREEVRRVEEASERTLRELEKVVRRIERESEKLKRELEKVVEDAKRTLEKLIE

SEQ ID NO: 7046 - protein, 61 aa, Artificial Sequence
  Synthetic sequence.
SSIEKLLEELKELAKRHEDEVKKLIRELEDLARKHKERSEKLNEEIKKLLKELADRVRERG

SEQ ID NO: 7047 - protein, 59 aa, Artificial Sequence
  Synthetic sequence.
ERVRRRLRKVVEEIKERSDRTIREMEKVIREIKEESRRLNKSHEEVIRDVKRRADELRK

SEQ ID NO: 7048 - protein, 61 aa, Artificial Sequence
  Synthetic sequence.
SEVEDLLRDLERLLEEHRERVERLIKRLRELLERHKRTVEKLNRDVKEKLRKLKKEAEDKG

SEQ ID NO: 7049 - protein, 59 aa, Artificial Sequence
  Synthetic sequence.
EEALRRLKRVVEEIKRRSDRLIEKAEEVIRDIEEKSEETLKSHREVLERVKKILTDLRK

SEQ ID NO: 7050 - protein, 61 aa, Artificial Sequence
  Synthetic sequence.
DEIDRLLEDLRRLLEEAERRVTEIIKRIKKLLEEHERRVRELNKDLRRLLEEAEDVVRRKG

SEQ ID NO: 7051 - protein, 59 aa, Artificial Sequence
  Synthetic sequence.
EKARRDLERVVTEIDRELKRLEEDIRRVLEEVKRRSEDLRRSHRRVIEDIKRRLEELRR

SEQ ID NO: 7052 - protein, 61 aa, Artificial Sequence
  Synthetic sequence.
KEVEDIIREIRKLLEDHERKVKELIDEIRRLLEEHERTVRDLNRRIKKLLEEAKEFADRKG

SEQ ID NO: 7053 - protein, 59 aa, Artificial Sequence
  Synthetic sequence.
KEMIDRVRKVVEEVKKRSRETLERIRKVIEEVKARSKELIESHEEVIKRVEETLKRLKD

SEQ ID NO: 7054 - protein, 56 aa, Artificial Sequence
  Synthetic sequence.
SLEEEIKKLLKEVRDVNDRLKETIEDLAEKIERLAKRMIERIEEILREVDRLVKEV

SEQ ID NO: 7055 - protein, 59 aa, Artificial Sequence
  Synthetic sequence.
EDVIREILKEIRKHLRDSEEENKKTLDTLRKILEDLTKAAEDILEEIRRELDRLRKEAT

SEQ ID NO: 7056 - protein, 60 aa, Artificial Sequence
  Synthetic sequence.
SELEDILRRLREEVKRLREESRKLLEDNRRLVEEVKRESDKVLKRLKDKADRLKELAERG

SEQ ID NO: 7057 - protein, 55 aa, Artificial Sequence
  Synthetic sequence.
REIKTVIDELTRELERLNREHEDLTRKLREELKKLNKRIKDLIDTLKKLLEDLKK

SEQ ID NO: 7058 - protein, 56 aa, Artificial Sequence
  Synthetic sequence.
SEEEKLRELVKEVEKRTRELNENLRRSIEEVERDTEELDKNLEKSIREVKKVLDDL

SEQ ID NO: 7059 - protein, 56 aa, Artificial Sequence
  Synthetic sequence.
AEDVLRRIRELLERNEEVNRRLDEASKRLLEENRRKNKKLDDDSKELLKRLTERAK

SEQ ID NO: 7060 - protein, 56 aa, Artificial Sequence
  Synthetic sequence.
REKERLEKVIRELETKARELNKNLKKSIDDVRRETERLNENLKRSVDELRKRLKDL

SEQ ID NO: 7061 - protein, 56 aa, Artificial Sequence
  Synthetic sequence.
AEEVLKELRKLVEELERRNRELDKRSKDLLRENRELNKDLDRKSRELMERVERKTR

SEQ ID NO: 7062 - protein, 56 aa, Artificial Sequence
  Synthetic sequence.
SEEEKLERLIEDLERKLKELNDNLKESIDRVRKRTEELNRNLRESIKRVKEELERQ

SEQ ID NO: 7063 - protein, 56 aa, Artificial Sequence
  Synthetic sequence.
AEEVLRELEKLVEDLERENRRLDKESKDLLEENKKVNKDLDDESKRLLEEVSKEAK

SEQ ID NO: 7064 - protein, 61 aa, Artificial Sequence
  Synthetic sequence.
SDKEDVTRLLEEVSRASERSRKRWKDSSDEVKRTSEESIRRLRELLERLRERIERVIREKK

SEQ ID NO: 7065 - protein, 56 aa, Artificial Sequence
  Synthetic sequence.
VDELRKKIEEIVKRDEDLVRRLLEDSKRLAEEDRRLLEEVKREIDEIRKRIDEEVK

SEQ ID NO: 7066 - protein, 61 aa, Artificial Sequence
  Synthetic sequence.
DEIDELVRRIEELAERHHRRVDEIVKRNEEVLKELDERARRLVRENEEVLKRLEETVRREG

SEQ ID NO: 7067 - protein, 59 aa, Artificial Sequence
  Synthetic sequence.
ERAEKRLRDVLEKLRRDVERNREEIKKSAEDVRREVKRVTDELKESIERVRKRVKELKD

SEQ ID NO: 7068 - protein, 59 aa, Artificial Sequence
  Synthetic sequence.
EAERKVKTVVDELRRIVDELAKELEESLKRTDETIKRLARELERVDRELEEIIKELERK

SEQ ID NO: 7069 - protein, 55 aa, Artificial Sequence
  Synthetic sequence.
DEVVRKVEEEAERIKKRIKDLVRRDEKLVEDMRRRIKRLVEKNRKVAEKMRTDTD

SEQ ID NO: 7070 - protein, 60 aa, Artificial Sequence
  Synthetic sequence.
DLEELLRKVLEELRKIVEDARRENEKSLRESEKIVREVEELNKKVLEEVEKKIREVIEEK

SEQ ID NO: 7071 - protein, 59 aa, Artificial Sequence
  Synthetic sequence.
EETIKRIVDEIRKEAERLLRRHRKSVKEDKDLAKKIREDHKKSVEDIERTLEELEKRAK

SEQ ID NO: 7072 - protein, 56 aa, Artificial Sequence
  Synthetic sequence.
SEIEELVKEIKKVADEVRRRHEKSVREIERKLEELDKKVKDLVDEDKKLADELRRR

SEQ ID NO: 7073 - protein, 59 aa, Artificial Sequence
  Synthetic sequence.
DRVRRELERVLRDVERIIRDVKRTNKRVDDDVERRIRELRKELEDSLRRSKRIVDEVRR

SEQ ID NO: 7074 - protein, 57 aa, Artificial Sequence
  Synthetic sequence.
SEIERLVEEIEKLLRKMAEEHKRSVERDERLARKLKRENEEHIKTDEELVDRLRRRN

SEQ ID NO: 7075 - protein, 59 aa, Artificial Sequence
  Synthetic sequence.
DRVLRELKRVLDEVKKIIEDVAKENEDSDRRSKKIIEDVVRENKESLDRSREEIERVRK

SEQ ID NO: 7076 - protein, 56 aa, Artificial Sequence
  Synthetic sequence.
KEIEELVKRIEDEARRLKEEHKKSVREIEELLKRLTEEVRKLVERDKKLAEDLKDR

SEQ ID NO: 7077 - protein, 59 aa, Artificial Sequence
  Synthetic sequence.
DEMLRLLEKVLRDWEEIVRRVKEANDDVNRRVEETLRDLKRKLDRSLEDSERIIREVAT

SEQ ID NO: 7078 - protein, 59 aa, Artificial Sequence
  Synthetic sequence.
SVEDELRKVIKENEDVLREVEERVETVIKRNREVIEEVAREVERVIEETRRLLKEIEKA

SEQ ID NO: 7079 - protein, 59 aa, Artificial Sequence
  Synthetic sequence.
EESIKRLLEKIRKHSEEVKETIRRLLEKIEEHTERVKREIDKMLRSNEDLMRRIKEEAE

SEQ ID NO: 7080 - protein, 59 aa, Artificial Sequence
  Synthetic sequence.
SIKEKLDEAIERNERVLRRVEEEVRKSNEKNKEVLRRVSEEVRKVIEELEDLLRKIAEK

SEQ ID NO: 7081 - protein, 59 aa, Artificial Sequence
  Synthetic sequence.
DETAERLLRKIEKHSREVDETIRRMLEEDERHIKEVEDTIREMLERLKRLIDEAEKDAK

SEQ ID NO: 7082 - protein, 60 aa, Artificial Sequence
  Synthetic sequence.
DEVREVLKKIRELIKTNREHVTRLLRTIEELSRRSEEMIRRILEEIEKLIKDVRRLTEEG

SEQ ID NO: 7083 - protein, 59 aa, Artificial Sequence
  Synthetic sequence.
EEMEKLLEEAIKEAREDSRRSDREVEEVLRKHKKVNDRVREEIERVLRKLEELLKKDRT

SEQ ID NO: 7084 - protein, 59 aa, Artificial Sequence
  Synthetic sequence.
SEVDEIVRRLEELIRRNTEKVERLLERHERLIRELKERVKELLRKHEELAKEITELTKR

SEQ ID NO: 7085 - protein, 59 aa, Artificial Sequence
  Synthetic sequence.
KEARDRIRKVLEELKKKNKELEERIRKVSKELEKVLEDVKRESEKVSKELRERLERSKT

SEQ ID NO: 7086 - protein, 59 aa, Artificial Sequence
  Synthetic sequence.
SELERLEKEARDIVENLKRVLEELAKDVKRLLKESDELLKDLREKVREILERIEELARR

SEQ ID NO: 7087 - protein, 59 aa, Artificial Sequence
  Synthetic sequence.
ETAKRELERLVKELRDVHREVEKRLKELAKELREVNKRIKDDLDRLVEALEEVLDRVRR

SEQ ID NO: 7088 - protein, 59 aa, Artificial Sequence
  Synthetic sequence.
SELEELKRRIDELLKENEEILRELEERVRRLNKENRDLLRKLEEEAKRLVEEVRRVAEE

SEQ ID NO: 7089 - protein, 58 aa, Artificial Sequence
  Synthetic sequence.
EVKERIEKVLKDLERRNRESEKEVRRLLKELKESIDDSRRRVDELVKRLRKVLEDIRR

SEQ ID NO: 7090 - protein, 61 aa, Artificial Sequence
  Synthetic sequence.
SAEETLEKLIRDLEKSIRKSAEDLERLIRELEKSVRDSAKLLRDLIREVRDVVRDVVRAKG

SEQ ID NO: 7091 - protein, 55 aa, Artificial Sequence
  Synthetic sequence.
KDVAERVKELDKRNKDLLKRLEEEVRRLIKENERLLRELAKEVKELLERIKRAAG

SEQ ID NO: 7092 - protein, 61 aa, Artificial Sequence
  Synthetic sequence.
SAEDKLRELEKKLRKSIKESADRLRKLNEELRRSVRESAERLKELIREVEEVLRDVVRKRG

SEQ ID NO: 7093 - protein, 55 aa, Artificial Sequence
  Synthetic sequence.
EEVEDEVRRLDEENKKLLEDLKRSVDELIERNKRLLEELTKRVKELLDKIRKTAE

SEQ ID NO: 7094 - protein, 61 aa, Artificial Sequence
  Synthetic sequence.
SMEDSLRELIRKLRESVKRSAEELRRLNKRVEDSIRDSARKLRELIRRVEEVVKEVVETRG

SEQ ID NO: 7095 - protein, 55 aa, Artificial Sequence
  Synthetic sequence.
ERVEDDVRRIDDENRRLLEELKKSVDELDKRNEELLRRAEKEVRDLLREIREAMR

SEQ ID NO: 7096 - protein, 60 aa, Artificial Sequence
  Synthetic sequence.
DAEEELERLLRESERVSRDSARRLRELLKKLRRSVERSRREIDRLLKELEDVIREVIKRK

SEQ ID NO: 7097 - protein, 55 aa, Artificial Sequence
  Synthetic sequence.
KDLAREVEKVVKEDEDILRRAEEEVERLIETNRDLLRKVEREVKELVEKVEEDER

SEQ ID NO: 7098 - protein, 59 aa, Artificial Sequence
  Synthetic sequence.
SELEELKREVDELTEEHKELLKRLTERVKELSERHKELLERLRERSERLVRRIRELAKR

SEQ ID NO: 7099 - protein, 59 aa, Artificial Sequence
  Synthetic sequence.
DEVLRKAEELLRRNNRVIEEIEKRLRELLKENNDVIKEIRERLEKSNKELRDVAREVAK

SEQ ID NO: 7100 - protein, 59 aa, Artificial Sequence
  Synthetic sequence.
SELEELKKKVDDSIRENERLLRELTEDVKRLSKEHKDLLKRLEDKVEELIRRARELAKR

SEQ ID NO: 7101 - protein, 59 aa, Artificial Sequence
  Synthetic sequence.
DDMLEKAKKVHDEHRKSVEESTERLKELLRRNNEVIKDIARRLDELLRKLEKVVKEIAK

SEQ ID NO: 7102 - protein, 59 aa, Artificial Sequence
  Synthetic sequence.
DELRELEEEVRKSIETNRELLERARERVERLSEEHRKLLEKVKEDSDRLVEEVKDLERR

SEQ ID NO: 7103 - protein, 59 aa, Artificial Sequence
  Synthetic sequence.
DEVLRRARTLHDEHRRSVEESERRLKELLERNNEVIKDIERKLDKSNKELKDEAEKVKK

SEQ ID NO: 7104 - protein, 59 aa, Artificial Sequence
  Synthetic sequence.
SELEEIEKKVRELTKRHRELVERVRKTVKELIETNRRLLETLTERIKRVLEEVRDLERR

SEQ ID NO: 7105 - protein, 59 aa, Artificial Sequence
  Synthetic sequence.
DKALEEAKRVLRENNEVIKDIKRRLDELLKELEKSVRESEERLRRLLEEVKRVIEEVAT

SEQ ID NO: 7106 - protein, 59 aa, Artificial Sequence
  Synthetic sequence.
SSDREVEERVKRLTDRHRELLKRVEEEVKRSIKRNKDLLDELRKESEKLVKEARDLARK

SEQ ID NO: 7107 - protein, 59 aa, Artificial Sequence
  Synthetic sequence.
EDVLRLAEKLLKDNNKVIDEIRRRLDRLHEEHKKSVDDSREELKKSNKKLEEVVREIEK

SEQ ID NO: 7108 - protein, 59 aa, Artificial Sequence
  Synthetic sequence.
DDLREVEKEIRRIAEESKKLLEEIERAVEKILRDSRRVLEELARRAKRLLEELDKLKKN

SEQ ID NO: 7109 - protein, 59 aa, Artificial Sequence
  Synthetic sequence.
EDVRREVKRLVDELREVDRKIEEDLRELVRELEKVNREIRKRIEELVRRIKEVADEVRR

SEQ ID NO: 7110 - protein, 60 aa, Artificial Sequence
  Synthetic sequence.
DMEEKMRRITEEWRRVTEEIERRHREVIKKWRDVSREIAETHRRVIDELRRVLERIAERN

SEQ ID NO: 7111 - protein, 59 aa, Artificial Sequence
  Synthetic sequence.
KDIVDKELERLREEIRTSKKESDEVVKENEELIRDSKRKSEKVVRDNKRVIKEAEEKAK

SEQ ID NO: 7112 - protein, 59 aa, Artificial Sequence
  Synthetic sequence.
DEIEELLKEIKKLVDELRKRIEELAREHKRLADELRKKIKKLKDEHDRLVRELEKLAEK

SEQ ID NO: 7113 - protein, 59 aa, Artificial Sequence
  Synthetic sequence.
KEVKDKLDKLREELKRVADKLRDDLRELHKRLKEVADRLRKLLEDANRTLREVLKETKR

SEQ ID NO: 7114 - protein, 61 aa, Artificial Sequence
  Synthetic sequence.
SAEESAKRLKEELKKSLDRSREELDKLRKDNEKVLRDVEERLRRLIEELKKVLEDIKKDKG

SEQ ID NO: 7115 - protein, 55 aa, Artificial Sequence
  Synthetic sequence.
EELEKRVEKLLRDDKRRLDELRKESEDHIREIEDTLRRIEEEVKRLLKEMRDKLK

SEQ ID NO: 7116 - protein, 59 aa, Artificial Sequence
  Synthetic sequence.
SELETIARRVEKLNEDVERLLREAKKEADRLIKENEDLLREAERKVREIIERIRRLAER

SEQ ID NO: 7117 - protein, 59 aa, Artificial Sequence
  Synthetic sequence.
KEVKEKLTRLLKSHEDVIREVSRRLKELLDRYREVSDRIRKTLEELLKELRRVVEEVRK

SEQ ID NO: 7118 - protein, 59 aa, Artificial Sequence
  Synthetic sequence.
KDLEEIERKVRKLNEDDKKLLDDLRKEVEKALRRNEESLRKSREDAKKIIKEIEDLARR

SEQ ID NO: 7119 - protein, 59 aa, Artificial Sequence
  Synthetic sequence.
KEMKDALRELLRSHRKSSEDTKRELERLLREYEKVSRDVKRDHEKLLREIREVIEEVKK

SEQ ID NO: 7120 - protein, 59 aa, Artificial Sequence
  Synthetic sequence.
SELDEIRRRVEELIETDKDILRRIAEEVRKALEDNKKSLRESEEEVRRLLEEIKKLADR

SEQ ID NO: 7121 - protein, 59 aa, Artificial Sequence
  Synthetic sequence.
EEMKKLLEDLLRKSEDSTRETRKRLKELLDRYEEVSKKIKKRHKELIEELRKVIDDVRR

SEQ ID NO: 7122 - protein, 59 aa, Artificial Sequence
  Synthetic sequence.
RVEETLTRALKEIEEVIRRVDEESKRTIRSHREVIREVDEIHTRLLERLKKVIDDIRRR

SEQ ID NO: 7123 - protein, 59 aa, Artificial Sequence
  Synthetic sequence.
DRLLKEARDEVRKIIEEIRRLLEEHERTVKKLNEDIRKRLEESERTVEELLKRLRDRAR

SEQ ID NO: 7124 - protein, 59 aa, Artificial Sequence
  Synthetic sequence.
SMEEELKRLLESHEKVIREVRKTSEDTLRSHRKVIEEAKEEHKKLLEEIKRVVERVRKR

SEQ ID NO: 7125 - protein, 59 aa, Artificial Sequence
  Synthetic sequence.
ETVLREARKEVEKLNEDIRRLLEEHKRVVDELNKELRRLLEESRRRVKELIRRIEEEAR

SEQ ID NO: 7126 - protein, 59 aa, Artificial Sequence
  Synthetic sequence.
SVEERLRELIESHRRVIEKVERDSRRTIRSHEEVIKEVKKISEDTLREIRKVIEEAKKR

SEQ ID NO: 7127 - protein, 59 aa, Artificial Sequence
  Synthetic sequence.
ETLLRDAERRVEELNEEIRRLLEKHVRDVDRLNKEIRDLAREHKERAEEIIKRIEEKAR

SEQ ID NO: 7128 - protein, 59 aa, Artificial Sequence
  Synthetic sequence.
SEMERLERRARELLRRNEELMDDLRRKAEELLKRNDRLVKEIEKKVREVLRRIEELKRR

SEQ ID NO: 7129 - protein, 59 aa, Artificial Sequence
  Synthetic sequence.
KRLEELLRRLNEEHKRISDELRKLLDEALERHRELSRRLEEELERLLREIERLVEEVTR

SEQ ID NO: 7130 - protein, 60 aa, Artificial Sequence
  Synthetic sequence.
DDMERLEEEIKEILDRLRRLLERNRRVNKEIDERSKELVKRLEEKARRLLEELRRLKDRV

SEQ ID NO: 7131 - protein, 59 aa, Artificial Sequence
  Synthetic sequence.
KELEKKAEDVLREVKKVIDEVRTDSKRLNENLRESIKDVKREAERVLREVEEAIREVER

SEQ ID NO: 7132 - protein, 60 aa, Artificial Sequence
  Synthetic sequence.
REAEELKKEVDRILEELKKLLKENEDLNRDLDRKSKELLKENREKVERLRKELRELKDKV

SEQ ID NO: 7133 - protein, 59 aa, Artificial Sequence
  Synthetic sequence.
KELEDEAKRLKDEVEKLIEEIKRKSDELNKNLRDSIRRVEETTRDLLRKIKKLIDEIKK

SEQ ID NO: 7134 - protein, 57 aa, Artificial Sequence
  Synthetic sequence.
SIEEALEDLARRIKKILDDLRREAERLLREVEELLKRVEEANRRLRRTIEEALKRLA

SEQ ID NO: 7135 - protein, 56 aa, Artificial Sequence
  Synthetic sequence.
VETAEREIRRILEEIRRLAEEARRRIEEVLKRIKKHLEESKRRNEESLERIEREAR

SEQ ID NO: 7136 - protein, 60 aa, Artificial Sequence
  Synthetic sequence.
SVEETVDELKKRIEKILREIKRVNEELAKRNEDVNEEWRREVDKMIKDIERILRDVLRKE

SEQ ID NO: 7137 - protein, 56 aa, Artificial Sequence
  Synthetic sequence.
IEKLKRDAERILEEIKRAVDTSREESERTLKELRDMVKESRKDAEEVLERIDRDKR

SEQ ID NO: 7138 - protein, 60 aa, Artificial Sequence
  Synthetic sequence.
SVKETLEDLIKKIRDLLKRVRDENKRLAEDNERLNREVEKRNRELIKRIEDELEEVRKRE

SEQ ID NO: 7139 - protein, 56 aa, Artificial Sequence
  Synthetic sequence.
IRDLKREIEKILREIKKALEDSRRKSKETLDRIREVLKTSEEDIKRILKEIREAAR

SEQ ID NO: 7140 - protein, 61 aa, Artificial Sequence
  Synthetic sequence.
SREEVVKEIEKRVEELNRRLEETVRRVIEEMKRLNKESKEVSKKIVDEVRKLLDDVRREKG

SEQ ID NO: 7141 - protein, 56 aa, Artificial Sequence
  Synthetic sequence.
EDELRRLLERIEKTVRELKREIEKILEDATRTVEDLKRKNEELLRRLKKLADDVKK

SEQ ID NO: 7142 - protein, 59 aa, Artificial Sequence
  Synthetic sequence.
RVEEILRKASKENKEVIDRDRRLAEEATELNKRVVEEDRKVMKEVTKELEDVLRRAREE

SEQ ID NO: 7143 - protein, 59 aa, Artificial Sequence
  Synthetic sequence.
DKLLRELEERSKKVLEESKKTSEDLLRESEKHVRDWREKSRKLEEKVKRLVKKVKDTTD

SEQ ID NO: 7144 - protein, 60 aa, Artificial Sequence
  Synthetic sequence.
RAEDIIRELKRRNEEVLERDRELMERAARELREVLERLKDIAREASKELKRVLDELRKRG

SEQ ID NO: 7145 - protein, 59 aa, Artificial Sequence
  Synthetic sequence.
DEVVERLARESERVLRESEETSKDLKRKVDEELRRIEDTIRRLLKRVKDLVKKIEDTSR

SEQ ID NO: 7146 - protein, 60 aa, Artificial Sequence
  Synthetic sequence.
RLREIIEKLRRDNEKVIEEDRRVAEEVRKALEKVLREDRKMADEVTKELERALKELEDRG

SEQ ID NO: 7147 - protein, 59 aa, Artificial Sequence
  Synthetic sequence.
DEVIKELEKRSKDVLDESRDESRKLLERVERLLKKIREDSERLLERVEELLREAEETAR

SEQ ID NO: 7148 - protein, 60 aa, Artificial Sequence
  Synthetic sequence.
SVEEIIRKLEEDNRDVLRRDREVAKKVEDENRKVAEEDDRIVRRVAEELKRVLKELEDKG

SEQ ID NO: 7149 - protein, 59 aa, Artificial Sequence
  Synthetic sequence.
EKVIEELKDESRKHLEELEKDSKRLEDESKKHLDDWRRTSEKLLEDVERRVREIEEESR

SEQ ID NO: 7150 - protein, 60 aa, Artificial Sequence
  Synthetic sequence.
SSEEVVRELDKEIRKSIEDLKRIVRENEEENKRSVEDVREKAKRNEERLRKVLKEADERK

SEQ ID NO: 7151 - protein, 56 aa, Artificial Sequence
  Synthetic sequence.
IRELAKRVKRIVDENKRVAEEHHRKVERIVRENEKLLKEHHDRVEELVRRIKEEVE

SEQ ID NO: 7152 - protein, 57 aa, Artificial Sequence
  Synthetic sequence.
SEEEEVRRVLEELEKKVKRLTEEHRRRLDELRKKVKDHSRKNKELLERLREEIKRIK

SEQ ID NO: 7153 - protein, 59 aa, Artificial Sequence
  Synthetic sequence.
EEAKRVLEEVEKRVRELVKTNEDVLREIEEDVRRLVKENEDSIKESKDRLRELLERLKQ

SEQ ID NO: 7154 - protein, 59 aa, Artificial Sequence
  Synthetic sequence.
DEVEEIRKILEELAREAEKVVRETRKLLEDIRKEVEELNDRNRRLLEELERRVRDIKRR

SEQ ID NO: 7155 - protein, 59 aa, Artificial Sequence
  Synthetic sequence.
DEIRRVVEDVERRLRELLDRWRKVSEEVEKRLKELIDELRESIERSADRLRKLIEELKR

SEQ ID NO: 7156 - protein, 59 aa, Artificial Sequence
  Synthetic sequence.
REVEEIKKTLEDIRREAKELLDRTRELLDRLRKSVEELNRDNERLLREAKDEVEKVKRD

SEQ ID NO: 7157 - protein, 59 aa, Artificial Sequence
  Synthetic sequence.
EEIKKVVERVEREIEDLIRRWEEVSRDVEEKLKDLNKKVEESIRRSAKDLRELLREVEE

SEQ ID NO: 7158 - protein, 61 aa, Artificial Sequence
  Synthetic sequence.
SRAEKVLKRVTDLIRELLRTVTELVRRNREVIEELLRRVAKLHRDNRELNKKVLEDVRRDG

SEQ ID NO: 7159 - protein, 55 aa, Artificial Sequence
  Synthetic sequence.
EVVDELRRRIREVEKTLDRLLEESEERARRVLKELDRLLEESRKSSREVIEEAKR

SEQ ID NO: 7160 - protein, 56 aa, Artificial Sequence
  Synthetic sequence.
SVEELLKKLEKENRDVIREMKKLLDELEEENRRVIEEWRRITKELEDRNRRVREEI

SEQ ID NO: 7161 - protein, 59 aa, Artificial Sequence
  Synthetic sequence.
EEIIRRLVKHNKELVDEIRKTIERLREHNRKLVEKVREDVKRSTKHNRDLVKEVRDRAK

SEQ ID NO: 7162 - protein, 56 aa, Artificial Sequence
  Synthetic sequence.
SLEELLDRLRKLNETVIRDMERVLKELEERNRKVIKEDRDVLEELARRNEKVKRDI

SEQ ID NO: 7163 - protein, 59 aa, Artificial Sequence
  Synthetic sequence.
EEIAKELVKHNEKKVREIKKTIDDLRKHNEELVKEIRETSERLREHNERLLREALRRAK

SEQ ID NO: 7164 - protein, 60 aa, Artificial Sequence
  Synthetic sequence.
DLEEVVKDLERKLRDVARKDRKLVEDSRKILKDVVDKDRELVERSRRILEEVLERIRRRG

SEQ ID NO: 7165 - protein, 59 aa, Artificial Sequence
  Synthetic sequence.
RDTARKLLEDVADELRRWLEDSERLHKENKDTIEKWLRRSRKLHEENRKLIEDLLRTVT

SEQ ID NO: 7166 - protein, 59 aa, Artificial Sequence
  Synthetic sequence.
SLEDVLRELKERLERSHRKLRELVRRLEEDLKRVLRELEKIVDEVRKINEDVRREVERR

SEQ ID NO: 7167 - protein, 59 aa, Artificial Sequence
  Synthetic sequence.
EDIVRKLLEDVRKLVEELDRRAKELEERVKKVVDELLEKARRLLEKNRRTVEKILRDVK

SEQ ID NO: 7168 - protein, 60 aa, Artificial Sequence
  Synthetic sequence.
SEVEKLLREVEDRDRRILKKVKELLDEVRRLIEDHLRRSEDALRRVRKRIEELKELVERG

SEQ ID NO: 7169 - protein, 59 aa, Artificial Sequence
  Synthetic sequence.
ERLEEMLRRLKKSIEDSVREVRKVLKEAKDIARKVIEDTKRLLEELKRIMKKVLDELRK

SEQ ID NO: 7170 - protein, 60 aa, Artificial Sequence
  Synthetic sequence.
SEIEELVERVKARDEKHLRDSEKLLEEVKRRDRKLEEDSKKLLKDVKDLLRELEEVAKRG

SEQ ID NO: 7171 - protein, 59 aa, Artificial Sequence
  Synthetic sequence.
ERLRKLLDDLRKSIEESRKRSEEILREAEDTMRKSVETNERLLEELERELRRVVEELRR

SEQ ID NO: 7172 - protein, 60 aa, Artificial Sequence
  Synthetic sequence.
DEIERVLEEVERIDRELLKRSEDLLREVRERDKELEERSKRLLEKARRLIETLRDMARKG

SEQ ID NO: 7173 - protein, 59 aa, Artificial Sequence
  Synthetic sequence.
ERVKTIIDEARKSIDDSVRENKKVLDELKETIERSKKKNEDILREIEKILEEVREELRK

SEQ ID NO: 7174 - protein, 60 aa, Artificial Sequence
  Synthetic sequence.
KDVDELLERVKRRDEELERKVEKLLKRVRDLIREHDEKVKELEDEVRDRIKKLLEMAERG

SEQ ID NO: 7175 - protein, 59 aa, Artificial Sequence
  Synthetic sequence.
EELERVLRELKRSIETSTRRLRKILEELRRILEESERKVEEVLKELERIAREVEERLRT

SEQ ID NO: 7176 - protein, 60 aa, Artificial Sequence
  Synthetic sequence.
SDIEDVVRKVEEEVRDHNRRVEELLKRVERRDRRLEETVEELLKEIEDKLRRLKEMAERG

SEQ ID NO: 7177 - protein, 59 aa, Artificial Sequence
  Synthetic sequence.
ERLEKLLRELEETLRRSKERVKEVLEDLKRTITESKRRLKKILDEIRKRLEEVERDLKR

SEQ ID NO: 7178 - protein, 60 aa, Artificial Sequence
  Synthetic sequence.
SLEEVVDKLRRDSEESLKKNETVLRRVTKELTELLKRWREASERLKEELREVLERVRKKG

SEQ ID NO: 7179 - protein, 59 aa, Artificial Sequence
  Synthetic sequence.
EDTLRKLAEEVKRVVRDDEEKVKRLEEEVKEEVKKLEDDLRRSEERVERTIREIEKRAK

SEQ ID NO: 7180 - protein, 60 aa, Artificial Sequence
  Synthetic sequence.
SVEDLVREVERRLKTVLDEDEEVLKRVEDESRESIKENEEVLREVSERLDKVLKDVRRRG

SEQ ID NO: 7181 - protein, 59 aa, Artificial Sequence
  Synthetic sequence.
EEDLKRLEDRVEEEVRRAKRESDELLKRVRRTVEDDKRRLRELREEVKDLLERIREAEK

SEQ ID NO: 7182 - protein, 60 aa, Artificial Sequence
  Synthetic sequence.
SEVDEVRKRSEKVVEENERRIEESERRIAKLVKEVRDVIEDAKRRVEEILRRLEEEMRKG

SEQ ID NO: 7183 - protein, 56 aa, Artificial Sequence
  Synthetic sequence.
KDVLEEMRKTHERVIKEWERAHKEVNEKLEKIIRELEKVLEEVEDEAREVIRRLET

SEQ ID NO: 7184 - protein, 59 aa, Artificial Sequence
  Synthetic sequence.
SASEDLERVLRELAKEVEKLLRESEKLLKELEDLARELLERDRKLLKELEEKVKRLKER

SEQ ID NO: 7185 - protein, 56 aa, Artificial Sequence
  Synthetic sequence.
ERVLDDVRKRIEDLVRELKKVNEDIEKKVRELIERLRRSLEKSKEDIRRLVEELRR

SEQ ID NO: 7186 - protein, 60 aa, Artificial Sequence
  Synthetic sequence.
DMSEELEEILRRLEEESRRHLRTDEELLRELEEKIRRLLREIEEILERLKKRIDEVKTRN

SEQ ID NO: 7187 - protein, 56 aa, Artificial Sequence
  Synthetic sequence.
ERVLKRVKDRIDELIRRNEESLERTRDEIRKLIEELKKVLDRVKEEIEKLVEALKK

SEQ ID NO: 7188 - protein, 59 aa, Artificial Sequence
  Synthetic sequence.
EMTERLERVLEELKRKSDEHIKTDEELLRRLEKKSRDHLRELEEILRRLEREAREVKRN

SEQ ID NO: 7189 - protein, 56 aa, Artificial Sequence
  Synthetic sequence.
REALKKVEDAIDKLRRDNERSLERTKREIERLIRENKDVLDKIEKRIRELIEELER

SEQ ID NO: 7190 - protein, 59 aa, Artificial Sequence
  Synthetic sequence.
SADEKLDKILREMKKRSDDHIREVEKILRDLDREVKEILKKDEKLLRDLDRRVKDVKRR

SEQ ID NO: 7191 - protein, 56 aa, Artificial Sequence
  Synthetic sequence.
DEVLKRVEETVRRLVEENKKVLDRVREEIRKLIEELRDSLRRSEKRIRELADELRR

SEQ ID NO: 7192 - protein, 59 aa, Artificial Sequence
  Synthetic sequence.
DLEDILREIARLIERLIDENRKVLEEIARRLKELIEELKKSLKRSEELLRRLEKELKDS

SEQ ID NO: 7193 - protein, 59 aa, Artificial Sequence
  Synthetic sequence.
KDLLRTLEKVAEDLKRRSERHIRELRRTLEDLERDVRRLLREDEEKLKRAAEEVKEAIK

SEQ ID NO: 7194 - protein, 59 aa, Artificial Sequence
  Synthetic sequence.
DLEDVLRDIERLLRDLIRRNKEVLDRIRELIKKLIDENRKSLKRSKEELERLIRELAKS

SEQ ID NO: 7195 - protein, 59 aa, Artificial Sequence
  Synthetic sequence.
EELLRRLREVLERLKRESEKHLEELKKILEDLERESRRHIEEDKRLLKELKEEVDERIR

SEQ ID NO: 7196 - protein, 59 aa, Artificial Sequence
  Synthetic sequence.
SLEEVLKRIEDELRRLIEENKESLERSERLIRELKKRLEEVLRRIKKLLEELIRRLEES

SEQ ID NO: 7197 - protein, 59 aa, Artificial Sequence
  Synthetic sequence.
KKLLEDLKRTLDELRRESEEHIRRDERLAEELAREVEKLLKDMERILRELAKEVEDRIK

SEQ ID NO: 7198 - protein, 55 aa, Artificial Sequence
  Synthetic sequence.
DASRRVEEKLKEVEERVRKLLEEDRKRLKDSKRKVEELIERDKTELKKVKDRADG

SEQ ID NO: 7199 - protein, 56 aa, Artificial Sequence
  Synthetic sequence.
KKVIDTVRKRLKELLDELKKSVEDTHRENRRVLKELEESHKRTNERLDDLLRELER

SEQ ID NO: 7200 - protein, 59 aa, Artificial Sequence
  Synthetic sequence.
SLEDVVRRVREELERLLRTHEEVIRRVEEELRRLLEEYRKVSKEIEEDLRRLLKEVRDR

SEQ ID NO: 7201 - protein, 60 aa, Artificial Sequence
  Synthetic sequence.
VEDLLREIKKELEDVKRKVDKLNEEVERILKKAKDEVKEAIKENRDRLRRLRDEVRRLKK

SEQ ID NO: 7202 - protein, 59 aa, Artificial Sequence
  Synthetic sequence.
GLEDVVRRVEKRLEDLLRRYKKVSERLEREHRRVLDEYRKVSEEIDKILRDLLKEVRDS

SEQ ID NO: 7203 - protein, 60 aa, Artificial Sequence
  Synthetic sequence.
VEELLKEIEKLLKDIERTVEKALKENKDSIRRSKEKVDRMIKRNRELAKELEDKVRELKR

SEQ ID NO: 7204 - protein, 60 aa, Artificial Sequence
  Synthetic sequence.
SIEDILRELADTIRRLTEESEKILRKAEELLRRLTEEWRKSLKDLEDLIRKLIEEIRRRG

SEQ ID NO: 7205 - protein, 55 aa, Artificial Sequence
  Synthetic sequence.
EEIKKLMDEIRKKVEKHLREVEKVLREVEEEVKRELRKSEELARRIEEKIRREKK

SEQ ID NO: 7206 - protein, 61 aa, Artificial Sequence
  Synthetic sequence.
SEVEEALRRMEETIRRVREKLKKSLEDMRREIERIRRELEKSLEEFERDIERITRDIRRRG

SEQ ID NO: 7207 - protein, 56 aa, Artificial Sequence
  Synthetic sequence.
DDALRKIEELVKRLDRELREVNKEIEKVVRELKEELKRVDDEIERLVRELRKEAER

SEQ ID NO: 7208 - protein, 59 aa, Artificial Sequence
  Synthetic sequence.
DEIDEIRKVAERLEKEARELVKENEDDLKRHKERVDEIVKKIEEKVRRLEETARKLKEE

SEQ ID NO: 7209 - protein, 59 aa, Artificial Sequence
  Synthetic sequence.
EELKKVLEDLRRVLEKVHKLNREVLDKHREIVKRLSDKIKTVLRKLEEILKRAEEELRR

SEQ ID NO: 7210 - protein, 56 aa, Artificial Sequence
  Synthetic sequence.
SIEELLEEVERVVREVERRLDELLERNRRVIEEVRRRDDKLTKENEDVIRDVRRAG

SEQ ID NO: 7211 - protein, 60 aa, Artificial Sequence
  Synthetic sequence.
EEDLIREVEKRLEDIKDLLRRMKEEVERHSREVEDRLRRSEERWRDHSKKVKERLDRATT

SEQ ID NO: 7212 - protein, 59 aa, Artificial Sequence
  Synthetic sequence.
SLEEEVRRLLEEIKRLADENRDYVRRSLETNKKTNKDNRDEIRKALERIKRLAREIERI

SEQ ID NO: 7213 - protein, 56 aa, Artificial Sequence
  Synthetic sequence.
EKLLREVEELLRRVEEEHERLHRENRKLNDKDRETLERLIREVDDLLRKLEEEARR

SEQ ID NO: 7214 - protein, 57 aa, Artificial Sequence
  Synthetic sequence.
RVDELLEEVRKLVKDVHDTTEELLKEVERRLDEVKKRVDRSNEEVKELVKEAVKRSG

SEQ ID NO: 7215 - protein, 56 aa, Artificial Sequence
  Synthetic sequence.
DTKIEELLRRIEKYMRESKERIDRLLERIDEVLEKNERDVRKLLEDIRRMIEKDDT

SEQ ID NO: 7216 - protein, 59 aa, Artificial Sequence
  Synthetic sequence.
DTIERLLEDIKRILDKNRRDARRVLEEIKRSNEKNREDIKRIEEEIDRLLKEIKKKAEE

SEQ ID NO: 7217 - protein, 59 aa, Artificial Sequence
  Synthetic sequence.
KDVVKEVEELLKRVEETHRKLNKEVEELLERDERDLRRLIDDVRRLLEEVRKTLEDLRR

SEQ ID NO: 7218 - protein, 59 aa, Artificial Sequence
  Synthetic sequence.
RELEEARERIKELLEEIKDEVRRWREKIKRLLEDSRRKAERLKEDIKRLLEEIKKLSDD

SEQ ID NO: 7219 - protein, 59 aa, Artificial Sequence
  Synthetic sequence.
EDALRDIERLLREVDDAFRRLVEELRRLNEEVHRTTDELIREVEDMLRKVEEALKREKD

SEQ ID NO: 7220 - protein, 57 aa, Artificial Sequence
  Synthetic sequence.
EEIERVLEEIKRTADEIRKEIERVLEKSKKLLDDHHEEVKRMLERIRDKAKKVTDRG

SEQ ID NO: 7221 - protein, 58 aa, Artificial Sequence
  Synthetic sequence.
KVVEELRKILERLKDLVRDLERKLDELNKRVRDRVEENRKELEKLLREARDRIRELER

SEQ ID NO: 7222 - protein, 60 aa, Artificial Sequence
  Synthetic sequence.
SLEDRLREVLKRYEDRSRDLERELKRVLDEYDDSSRKVAEELKKVLDEIRETVERIKKDV

SEQ ID NO: 7223 - protein, 59 aa, Artificial Sequence
  Synthetic sequence.
EKEVADLVKKLEDDLRRTSDKVRRVVEEIKRRLEELERRYKALVKKLRDKLREIKEEVR

SEQ ID NO: 7224 - protein, 61 aa, Artificial Sequence
  Synthetic sequence.
DVEEELKKVDDKVEELVRKVIEDIRRALERVRELVERVRRKLEETNKKLKKLVEDIVRKKG

SEQ ID NO: 7225 - protein, 58 aa, Artificial Sequence
  Synthetic sequence.
EKVEELLRKSEELAKRIEDDVRRVLRKLEDTVRRIKEEIDRLLKDNERIIEEVKRRAD

SEQ ID NO: 7226 - protein, 61 aa, Artificial Sequence
  Synthetic sequence.
SVEEIIEDMLRKVRELVRRVRELLREVDEKLKKLVEDVRRRLEKTNKELKDLVEDIVRRSG

SEQ ID NO: 7227 - protein, 58 aa, Artificial Sequence
  Synthetic sequence.
EEAKRVLDKLRKTAEDIKRTIDELLKRSEETIKKIEDKIDKLVKKNKELVKRIEDEAR

SEQ ID NO: 7228 - protein, 60 aa, Artificial Sequence
  Synthetic sequence.
SLRELLDEVRRAVEESNRELERLLEEVDRSNRESHRELKRLLEKIKKLAEEVERELERKG

SEQ ID NO: 7229 - protein, 60 aa, Artificial Sequence
  Synthetic sequence.
EEEVKKAVEDLKRLVDTHKKRVEEVIDELRKHSEKHSEEVRRVITELARRLEELLDEIRR

SEQ ID NO: 7230 - protein, 59 aa, Artificial Sequence
  Synthetic sequence.
SAEEKVEDELRKHHEEVKRLLEEIEKTMRDHHREVEETLKDSRRELKRIEEEARKVKER

SEQ ID NO: 7231 - protein, 56 aa, Artificial Sequence
  Synthetic sequence.
EDILRKLEEEVRRNDKELRDLLEELKDLVRRNDEELRKLNEEVRKRVEELIEELRR

SEQ ID NO: 7232 - protein, 57 aa, Artificial Sequence
  Synthetic sequence.
SIEEMLKRVKEESKRSNDKIRDVLRKVEETSRRSKERIDKLLRDVERTVEEVIRDVK

SEQ ID NO: 7233 - protein, 60 aa, Artificial Sequence
  Synthetic sequence.
EKDVLDRLRRYVEENRRRVEKLIRDLEDAVRRNEDDARRVAKEIEDVVREIKDRVDKTRT

SEQ ID NO: 7234 - protein, 57 aa, Artificial Sequence
  Synthetic sequence.
SEVDKKLEDIRRRLEKLERETEESLDRVRKELEDLEKESRESLKRLREDLERVKKTK

SEQ ID NO: 7235 - protein, 59 aa, Artificial Sequence
  Synthetic sequence.
KKKADELRRVIEEIIRRLRELDEKHRRLVEEIIRRLEELNREHSKVVEEIARELKKTAK

SEQ ID NO: 7236 - protein, 56 aa, Artificial Sequence
  Synthetic sequence.
SLLEELKRSIEESIRTLKELLDRLEELIRRIAEEIRRLLEEHSRKTEEVIRRAEKA

SEQ ID NO: 7237 - protein, 59 aa, Artificial Sequence
  Synthetic sequence.
EKVIEELKRKLEEENKRLKKVVEEIAKTLKDLLDEVRRRIEDSLRKLEELLERVERKTR

SEQ ID NO: 7238 - protein, 57 aa, Artificial Sequence
  Synthetic sequence.
SLLEKLEKLIRDIKRTVDKLLEDNEETIRRIIRDIERLLKRHSDETREVVRTLKERG

SEQ ID NO: 7239 - protein, 59 aa, Artificial Sequence
  Synthetic sequence.
KDVIERIERELRELLKKLKEDADRHNEDAERKLRRLRDTIRRSLKKLEEDLRRLSKEAE

SEQ ID NO: 7240 - protein, 60 aa, Artificial Sequence
  Synthetic sequence.
SRVEETLKRLEDELKRIEEEVRKLLDELRRHLEENRRRTEKLLRELREELERVRERVEKG

SEQ ID NO: 7241 - protein, 59 aa, Artificial Sequence
  Synthetic sequence.
EKLLRRLERLVREIKRRLEELLKRLADLVRELKKEHERLNRELEELVRRIKERLKEAEK

SEQ ID NO: 7242 - protein, 56 aa, Artificial Sequence
  Synthetic sequence.
EEEERIKERLDRSVEELKKSADKMREEIERSEKKLKESADRVRKEIEDALRRIREE

SEQ ID NO: 7243 - protein, 59 aa, Artificial Sequence
  Synthetic sequence.
EDVVRRVEELLRRHEEVTKTINREIEELIKTHERSTRELNKEIKELIERLEETIKERTR

SEQ ID NO: 7244 - protein, 56 aa, Artificial Sequence
  Synthetic sequence.
KDAEELERRLRKSAEDLKRSAEEMKKRLDKSREDVKRKVEEAKKIVEDLEEDLKKR

SEQ ID NO: 7245 - protein, 59 aa, Artificial Sequence
  Synthetic sequence.
EEMVKRLRELLRTHEEITERINRKIEKLLREHEEETKRLLDDLRRLLEELRKKIEEEKR

SEQ ID NO: 7246 - protein, 56 aa, Artificial Sequence
  Synthetic sequence.
DEEERIEEELRKSTEKLKESLDRMRRDIEKSAEDLRKSVEDVERDMRRLLEDIEKR

SEQ ID NO: 7247 - protein, 59 aa, Artificial Sequence
  Synthetic sequence.
KDALERVRRLLERHERETRRINEEIERLIRRHVEETKRVNKRIKRLLDELKRRIEEKSK

SEQ ID NO: 7248 - protein, 56 aa, Artificial Sequence
  Synthetic sequence.
SEEEEIKKRIDDARKELEESTREVRERLRDSMRRLDESLKRVEEEIRKLADDIRRR

SEQ ID NO: 7249 - protein, 59 aa, Artificial Sequence
  Synthetic sequence.
EEVVRRVRELLKRLKEEVDRINDEIRKLLEDHKKRTEEVNETIKRLIDRLEEELRRRRE

SEQ ID NO: 7250 - protein, 60 aa, Artificial Sequence
  Synthetic sequence.
SEVEKIIEKIRREEDRNRREVEEKLKRIREHVRRNEEDTRRIIRELRELLKEALDRLRRG

SEQ ID NO: 7251 - protein, 59 aa, Artificial Sequence
  Synthetic sequence.
EKLLRELEELIRRVKKRHDELLKEVADLVKEVEDRHRKLNEELERVAREIEETLKRELD

SEQ ID NO: 7252 - protein, 57 aa, Artificial Sequence
  Synthetic sequence.
SEVETLLDKIRRDNEDLNRRVREELERIRKADEDVNREIEKVLRDIEEAIRKLKRDR

SEQ ID NO: 7253 - protein, 59 aa, Artificial Sequence
  Synthetic sequence.
DELVRRLEKILREHEENIKRIVEELERLLEEHKKNLEDLKRRLRDILRKVEEELDRTRK

SEQ ID NO: 7254 - protein, 57 aa, Artificial Sequence
  Synthetic sequence.
SETEELVKKIDKRDKEVKERAKRVVDEIKERDKRVNEEIEKVLRDIERTIKKVREDR

SEQ ID NO: 7255 - protein, 59 aa, Artificial Sequence
  Synthetic sequence.
KEMVDRLRELLERHEKTIRDLVRTLEELLERHRKNIEDLVRELRELLDRAREELKRTAD

SEQ ID NO: 7256 - protein, 57 aa, Artificial Sequence
  Synthetic sequence.
SDIEEALKKIKKMTRELREEIKKTEEESERRAKELEKEVRDYLRKVEEEAKRLKDTK

SEQ ID NO: 7257 - protein, 62 aa, Artificial Sequence
  Synthetic sequence.
EDIRRVLEELKKVLEENNRVIEELARRLDELNKKLRELLERIKKTLDDLNKRLEKLIRDTEK

SEQ ID NO: 7258 - protein, 57 aa, Artificial Sequence
  Synthetic sequence.
SKIEKMLRDIEKKTKELEDEIREALKRLREIAEKLKDEVEKYIRELRELLKRLAETK

SEQ ID NO: 7259 - protein, 62 aa, Artificial Sequence
  Synthetic sequence.
EKIREALERLRKILRENNEVIRELVERLRKVLEDLKRTVKTIEDRLRKVNEDLKRLIEELER

SEQ ID NO: 7260 - protein, 57 aa, Artificial Sequence
  Synthetic sequence.
SEAEKLIEDIKKLIEDHKKRTKELIDEIEEDIKKHREDVERLLRDIERLIEELEREN

SEQ ID NO: 7261 - protein, 59 aa, Artificial Sequence
  Synthetic sequence.
EEVERKVREAVKDVRRVLDESRRRLDTAIRKVEEDLRKSREDLERAVKKLRDVLEELKR

SEQ ID NO: 7262 - protein, 60 aa, Artificial Sequence
  Synthetic sequence.
SEVEKLERKTEKILKDLKDEVKRAEEETRRILEELKKMLEDMEKRTREILKRIRDLARDG

SEQ ID NO: 7263 - protein, 56 aa, Artificial Sequence
  Synthetic sequence.
EKKLRELNTELTRLIDEIRKRLEELNERLRKLVEEIEERLRRLNEELKRLVEEIRR

SEQ ID NO: 7264 - protein, 57 aa, Artificial Sequence
  Synthetic sequence.
KELEDTAEESKRELEKIRDEVRKEEEESEKLLRKIEKELREYAEKTRRILEKLRRDQ

SEQ ID NO: 7265 - protein, 59 aa, Artificial Sequence
  Synthetic sequence.
EEVARLLKKLNDELRRLIREIEERLRKLNDDLRELIERVEERLRRLNEELEKVIRELET

SEQ ID NO: 7266 - protein, 57 aa, Artificial Sequence
  Synthetic sequence.
DEVEDTERRSKKKLEELEEELRRTATESKRTLEELKRRLEDEERRSRDALRRLKEAN

SEQ ID NO: 7267 - protein, 59 aa, Artificial Sequence
  Synthetic sequence.
EEVKRRLERLNEEIEKLIRDIERTNRELNKELEDLIKEIEDRNRKLNEDLRRLIDELRK

SEQ ID NO: 7268 - protein, 61 aa, Artificial Sequence
  Synthetic sequence.
SELEEIAREVKETSKRHEEHVRRSEEEVKKTLKRLKEHVDKSSEDAERTLEELERRLRRDG

SEQ ID NO: 7269 - protein, 55 aa, Artificial Sequence
  Synthetic sequence.
DELRRLKEELKENIERAEESHKELADRLRELIKRIKERHEELLRRLRKLLEEIRK

SEQ ID NO: 7270 - protein, 60 aa, Artificial Sequence
  Synthetic sequence.
SAEEDLERLIRALKKVLDDHERLLRELLRRLEEVVRRHKELLKKLNRDLEEVLKDIKEKK

SEQ ID NO: 7271 - protein, 55 aa, Artificial Sequence
  Synthetic sequence.
DETDKEVRDTIRRIRKHSREVAEEVRKIIEELRRHSKKMADDSKRTIDELRERAK

SEQ ID NO: 7272 - protein, 60 aa, Artificial Sequence
  Synthetic sequence.
KVEEELDRLLKEIEKIIEEHRKKNKKLNDDIRRLIEEHERDLRELLKELEKLIRDLKKDL

SEQ ID NO: 7273 - protein, 59 aa, Artificial Sequence
  Synthetic sequence.
DRAVEEVRKRIEEILKRIRDNSKRVEEETRELLERIRRNSERLRRDVERLARELEEKKR

SEQ ID NO: 7274 - protein, 57 aa, Artificial Sequence
  Synthetic sequence.
SDEERLEEKLRRVEREVEKKLKRLKEELEEYARRVKEMSDRHREEVERFEEEVRRRG

SEQ ID NO: 7275 - protein, 59 aa, Artificial Sequence
  Synthetic sequence.
DTLRKLMEKIKRALEELLKRLEDLVRRIEEELRRLNEELRKNIREAEERLRKLKEDAER

SEQ ID NO: 7276 - protein, 60 aa, Artificial Sequence
  Synthetic sequence.
SADEILKEIEDTIRKLIEDNKRTLEEHERRTRKLIRELRELLKRHKTESRRLAEELKKDG

SEQ ID NO: 7277 - protein, 56 aa, Artificial Sequence
  Synthetic sequence.
GEEVRKRLEELKKKVERENRRHREHLKKVAKEVKRTLDEIRRHLEEVKERVKRARD

SEQ ID NO: 7278 - protein, 56 aa, Artificial Sequence
  Synthetic sequence.
SEEEELKRRVDEVRKRTKEIIEELKRHVDRNERTVREIIKRLEEEVRRVAEKVKRG

SEQ ID NO: 7279 - protein, 56 aa, Artificial Sequence
  Synthetic sequence.
SKVVEDVRRTLKRLNDELRKVVKDARELHERLLRDLKRVIDRIRERLKRLLDEAEK

SEQ ID NO: 7280 - protein, 57 aa, Artificial Sequence
  Synthetic sequence.
DEVETLAREVKKSNDDDRRKTKKTADDVEKKLEDLKRRDEEVRERVEEDLKRLREKV

SEQ ID NO: 7281 - protein, 59 aa, Artificial Sequence
  Synthetic sequence.
KEVLDRVADEIRRLNKETNDVDRDVRRRIDKLVEDVKRVTEEVSKEIKRLAEEVDRRIT

SEQ ID NO: 7282 - protein, 57 aa, Artificial Sequence
  Synthetic sequence.
DEVEELKRKVRESNKRDEDETRRTEERVEREVRRLEEEVKDVKRKVERELERIAREI

SEQ ID NO: 7283 - protein, 59 aa, Artificial Sequence
  Synthetic sequence.
REVVKEVEDRIRKLNRETNEVDKEVRKRVDDLIRDLERVLREVKEEVDRLVRKVEEDAK

SEQ ID NO: 7284 - protein, 61 aa, Artificial Sequence
  Synthetic sequence.
DEVEELVKRAEDILERLKREVDRLIKESEDLNRRIRKHVEDTIKEVRKRLEELRKEVEDRA

SEQ ID NO: 7285 - protein, 60 aa, Artificial Sequence
  Synthetic sequence.
AKDLLKEVVERVTRVAKAVKEKLDEVVRESREVIKRVEEKNRRVLEEVERVARELKKAID

SEQ ID NO: 7286 - protein, 61 aa, Artificial Sequence
  Synthetic sequence.
DEVEELVRRAEEELKRLRKHVEETVERSKKLNDEIKKHVDRTVKEAKDELRRLREEVKKRG

SEQ ID NO: 7287 - protein, 62 aa, Artificial Sequence
  Synthetic sequence.
EEAKKLLEDVARRVRKVAEELKKKNKELLETSDRVIEKVRKKNEDLKRTVDEVARRLEEAIK

SEQ ID NO: 7288 - protein, 60 aa, Artificial Sequence
  Synthetic sequence.
SEVDEVVERLRRISEELDRRVKKLVKDARRISKELEEAVRRVVKTAKDANKELRKEVRER

SEQ ID NO: 7289 - protein, 56 aa, Artificial Sequence
  Synthetic sequence.
VDTLAEDAKRSARETEEILRRLVKKLEESARDTKRIIDELDKELKDSNEEVRRRLK

SEQ ID NO: 7290 - protein, 57 aa, Artificial Sequence
  Synthetic sequence.
DEAEEVVKDVEREVRRLEKENRDLVERSKRLVERLEKESRDLVRKSREDVKRLREKG

SEQ ID NO: 7291 - protein, 56 aa, Artificial Sequence
  Synthetic sequence.
EEELRKDVERVVKKDEDITDEVRKENDEVVKKNEDIIDELRKKNEEVLRRVDEEAR

SEQ ID NO: 7292 - protein, 56 aa, Artificial Sequence
  Synthetic sequence.
SEVEDVVRKVRELVKRLRDESRRLVEESRRLVEELEKRSRDLVKTAEDIVRELKEA

SEQ ID NO: 7293 - protein, 56 aa, Artificial Sequence
  Synthetic sequence.
KDELDKEVKEAVKKNREIIRRLEKRNRDVVEENRKIIEDIEKKVRDVVREVRREAK

SEQ ID NO: 7294 - protein, 60 aa, Artificial Sequence
  Synthetic sequence.
SSLEEVAERVKKLVRELEESTKTVEELVRRLVTELRKSTEKVRRDVDKLVKELEEIIRDV

SEQ ID NO: 7295 - protein, 58 aa, Artificial Sequence
  Synthetic sequence.
REVKRLVEEVEKLIERLRRESRRLIERVRREARELKEESRRLEEEVRKKIEELARRVK

SEQ ID NO: 7296 - protein, 60 aa, Artificial Sequence
  Synthetic sequence.
RDLEEVKKKVDKLVRELEESSKKVRKDVEDLVKELEDTTRDVKRLVEELVTRLKRIIEKV

SEQ ID NO: 7297 - protein, 58 aa, Artificial Sequence
  Synthetic sequence.
REVKKIIEDVEREMERLERDSRRIVKEVREEADRLRKESKRLEEDVKRKLKELRERVN

SEQ ID NO: 7298 - protein, 60 aa, Artificial Sequence
  Synthetic sequence.
DELERVKEKVDKLVAELEKSTDDVKKKVEDLVRELERSSEKVKKDVDRLVKELEDIIRRV

SEQ ID NO: 7299 - protein, 58 aa, Artificial Sequence
  Synthetic sequence.
REVKKVVEDVRREAKRLKERSKKLEDEVRDLLRELEKRSDEITKRVREEMKRLEDEVK

SEQ ID NO: 7300 - protein, 60 aa, Artificial Sequence
  Synthetic sequence.
DELEDVKRRVEKLVRELEESSKEVRKRVEDLVRELERTTEEVEKLVRDLVRRLEDIIRRV

SEQ ID NO: 7301 - protein, 58 aa, Artificial Sequence
  Synthetic sequence.
EDIKRLEEDVERKLRRLEEESRRIVEEVKKEAERLKERSERLTKEVRELADRLAREVD

SEQ ID NO: 7302 - protein, 60 aa, Artificial Sequence
  Synthetic sequence.
RELEEVKRRVERLVRELEESLRRVRKEVEDLVRDLERVSKEVEDTVRELVRRLDEVIRRV

SEQ ID NO: 7303 - protein, 58 aa, Artificial Sequence
  Synthetic sequence.
REVKTLVEEVRRLLEELERRSRKLVKEVRDEAERLKREDEEIIREVRELLKELERKVR

SEQ ID NO: 7304 - protein, 55 aa, Artificial Sequence
  Synthetic sequence.
DELEEVKRTVEELLERLERVNKDVKRKVKELLDRLREVDDRVKKEVKRLIEEVKN

SEQ ID NO: 7305 - protein, 58 aa, Artificial Sequence
  Synthetic sequence.
EEIKKLADRVRRELKRSEDHTKRLAEEVRKDLEESRKHTKELEKEVEEELRRLKKEVR

SEQ ID NO: 7306 - protein, 55 aa, Artificial Sequence
  Synthetic sequence.
SELEEAAKAVEKLAREAEKSSEDARRAVERLAREAKRANDEAEKAVRELAERARR

SEQ ID NO: 7307 - protein, 58 aa, Artificial Sequence
  Synthetic sequence.
KEAKKLAKEAREIADRLRRESEEIAREAEKIAKELADHTRELAERARRIADKLKKDVK

SEQ ID NO: 7308 - protein, 60 aa, Artificial Sequence
  Synthetic sequence.
SAEDLIREVRRRVKELERKLEEILKRSEDLTRRLREEAERILKESRDRVRKLEEDARREA

SEQ ID NO: 7309 - protein, 55 aa, Artificial Sequence
  Synthetic sequence.
KEVIKKIRDILRRLSEELEKVLEDSERILRRLEDELRESLKRTEEILRELRRELK

SEQ ID NO: 7310 - protein, 56 aa, Artificial Sequence
  Synthetic sequence.
SVDEVLKEIEDALRRLKEEVERVLKENEDELRRLEEEVRRVLKEDEELLEELKRKV

SEQ ID NO: 7311 - protein, 59 aa, Artificial Sequence
  Synthetic sequence.
EKKIRDVAKEIRDRLKELEEEIEEVTRRNKKLLDDVEEEIRRVHEKTRRLLETVLRRAT

SEQ ID NO: 7312 - protein, 56 aa, Artificial Sequence
  Synthetic sequence.
RLEEVVEEMERLIRDLEKKVEDARERNERLVRESRKKAEELIKELRKLLRELEEEI

SEQ ID NO: 7313 - protein, 56 aa, Artificial Sequence
  Synthetic sequence.
VETVLKRVREVIRRVEETIKRLDDRNKESSEDVERRLRELLREVREIIKRVREKTR

SEQ ID NO: 7314 - protein, 56 aa, Artificial Sequence
  Synthetic sequence.
RLEDVVRESKKLVEESERRVREAIRRNEELVKDSEREAREVIEELKELLRRLEEEL

SEQ ID NO: 7315 - protein, 56 aa, Artificial Sequence
  Synthetic sequence.
VEDLLREVRRVDKEANEKIEELDRRNKKSSDDVKKKIRDLKREVKKVIDEVRERTR

SEQ ID NO: 7316 - protein, 57 aa, Artificial Sequence
  Synthetic sequence.
SELEKVLTESRDVVRRATKRLREVHKKTKEVVDRLREKLKRVEDEVRKAVRELEEKV

SEQ ID NO: 7317 - protein, 59 aa, Artificial Sequence
  Synthetic sequence.
KRLEDVLKESKKLTDDLRKDAKRVLDEDRRLVEELKKELDEARKRVEDLVREVKDRARR

SEQ ID NO: 7318 - protein, 60 aa, Artificial Sequence
  Synthetic sequence.
DEVEEVRKRVEEVIRRNEERIEDVRKKVEDVIRRNEKLVDDVRREVKEVLDKLRELLERR

SEQ ID NO: 7319 - protein, 60 aa, Artificial Sequence
  Synthetic sequence.
KETVDEVAERLKKLLEESERRVKRVLDEARKLVKRSEDRSKKVLDELEELLRRVRKEADK

SEQ ID NO: 7320 - protein, 61 aa, Artificial Sequence
  Synthetic sequence.
RELEELLEEARRSSEEVKKILKKLKKEVDESSERLERIIEKLLRDAKRVADEVRDILEKKR

SEQ ID NO: 7321 - protein, 60 aa, Artificial Sequence
  Synthetic sequence.
EERVKRVIDELRELLRRSREEVKRVVEELKKELERSKREVERVIDELRRLLETVEKEIRD

SEQ ID NO: 7322 - protein, 61 aa, Artificial Sequence
  Synthetic sequence.
SELEDLKRRIRKSSEDSKKSLEDSDRTIEESSRDSSRTARESERKLEKVLREVDDILKKVK

SEQ ID NO: 7323 - protein, 60 aa, Artificial Sequence
  Synthetic sequence.
EEDVERIVRELEELVRKSREDHKRVIDALREKLKKSREEHRRVIDKLRRELKRVEDEIRR

SEQ ID NO: 7324 - protein, 61 aa, Artificial Sequence
  Synthetic sequence.
SILEKLEREVRKSSRESRESAKKSLREIEESSRRVEEELERLLREVRRVAEEVLDILRRKK

SEQ ID NO: 7325 - protein, 60 aa, Artificial Sequence
  Synthetic sequence.
REEVKRIIERLRKLLEDSKRDHEEVIKELRKLVEDSRRRVEEVIRRLRELLKRVADELRR

SEQ ID NO: 7326 - protein, 61 aa, Artificial Sequence
  Synthetic sequence.
DELEEALRRLKKIVEDLARRNEELLKELRRDSKRLKDEIKRVVDELRDIVRRLKEELDRVK

SEQ ID NO: 7327 - protein, 62 aa, Artificial Sequence
  Synthetic sequence.
ERLERRVREIIRRAEELLERSRKRSEEIAREAEKSNRELEDAVRRIIRELEELLEKLERDAR

SEQ ID NO: 7328 - protein, 60 aa, Artificial Sequence
  Synthetic sequence.
DEVDKVTRELREIMRKLKEDDKEVLDRLREDSERVERTNREVEKRLEAIIRDLEEKLRRK

SEQ ID NO: 7329 - protein, 62 aa, Artificial Sequence
  Synthetic sequence.
ERLKEKVDRIREEAKRLLEELEKHVRDSEREAEDSNRRSRETSEEIIRRLRKKVKELEDKVR

SEQ ID NO: 7330 - protein, 60 aa, Artificial Sequence
  Synthetic sequence.
SEVDKVEEELERIVKELKDRDREVLKRLRDDSERLVRELKKVAEELRKIAKDIDERLKEK

SEQ ID NO: 7331 - protein, 62 aa, Artificial Sequence
  Synthetic sequence.
ERLKDRVDKIREKARKLLEELKKHVDDSIEEAKRSNEELRKTVEKIIREAEKLLRDLKEAVK

SEQ ID NO: 7332 - protein, 60 aa, Artificial Sequence
  Synthetic sequence.
SEAEKVERELDKIIRELKETDKKVLEDNRRVVEKIEREMERVLRELERIMKELKEELDRK

SEQ ID NO: 7333 - protein, 62 aa, Artificial Sequence
  Synthetic sequence.
ERLKEKVDEIRKRAEELVKELARHVEKSIRESRELDKRLEEKVKEIIRRARELLEDLRRKAE

SEQ ID NO: 7334 - protein, 57 aa, Artificial Sequence
  Synthetic sequence.
SEAEKVRREVEDLIRTLEEVVRKSSEEIKELLRRLREVVERIRDTTRRLIEEIEKKV

SEQ ID NO: 7335 - protein, 59 aa, Artificial Sequence
  Synthetic sequence.
REDLERVLKEVREIVKRLLKRLEESLRDVRRIAEELREMLKRSLKRSEEIIRKLLEDVR

SEQ ID NO: 7336 - protein, 57 aa, Artificial Sequence
  Synthetic sequence.
DEVDTVDEKVKRLAEELRKRVRESKERTKKLARDLREAVKESLKDSERLAEDLRRKV

SEQ ID NO: 7337 - protein, 59 aa, Artificial Sequence
  Synthetic sequence.
REKLERVEREIEKLVREVEKILRDIHRDNERVVREVERRLEEITRRSRELAKRVEDETR

SEQ ID NO: 7338 - protein, 57 aa, Artificial Sequence
  Synthetic sequence.
DEVDEVARKVERDAERLEDLNRRSEETSRRLAEELRRLNERSERETERLAEELRREV

SEQ ID NO: 7339 - protein, 59 aa, Artificial Sequence
  Synthetic sequence.
KKKLEDILREIEKLIRRVEEISRRILEESKRLADEVRKITKKLHDDNKRLADRVKEETR

SEQ ID NO: 7340 - protein, 57 aa, Artificial Sequence
  Synthetic sequence.
REIDEIKERVDRLAEKLRRDMERSTRESRKLVEELKERAKRSKEETTKLAEELRRRV

SEQ ID NO: 7341 - protein, 59 aa, Artificial Sequence
  Synthetic sequence.
KEELERILREIKRLMDEVKRILEELLKTNKKLIDEVRKRLEELHKRNRELVEEVARRAN

SEQ ID NO: 7342 - protein, 61 aa, Artificial Sequence
  Synthetic sequence.
SEVEAVEKEARELVREDERRDDEIEEDLRRLLEENRRKDDKVEKEVRELLKRLRDKVDDRA

SEQ ID NO: 7343 - protein, 59 aa, Artificial Sequence
  Synthetic sequence.
KRDVKRVRDTVRDISRKNNRTTEELLKRVRDISRRNKEITEELLRRIREIAEDLARKLD

SEQ ID NO: 7344 - protein, 61 aa, Artificial Sequence
  Synthetic sequence.
SEVEKVEEEVKRLVEENERRVRESSREVEKLLREDAERDERASRELKKLLEKLKRAVDKRA

SEQ ID NO: 7345 - protein, 58 aa, Artificial Sequence
  Synthetic sequence.
RAVEKVLRTARKISEDNKRKNDEISERLRRISERNNRESEKLLRDLEKIIEDVERKLE

SEQ ID NO: 7346 - protein, 61 aa, Artificial Sequence
  Synthetic sequence.
REVEEVEKKARELVERDERTDERIRKELEDLVRENKKEVKRVRETIERLLRDLKKAVDERG

SEQ ID NO: 7347 - protein, 59 aa, Artificial Sequence
  Synthetic sequence.
EEDVKRVEKTVEDISRKNNEITKRLRDTVRRLSEKNRRDLEKALEDLKRIVDDVRRKIT

SEQ ID NO: 7348 - protein, 61 aa, Artificial Sequence
  Synthetic sequence.
SEVEEVEKEARELVKRDEDRDKEIEDKLRELVERNRRLVRKSSEELKKEIKRLKDEVDRRA

SEQ ID NO: 7349 - protein, 59 aa, Artificial Sequence
  Synthetic sequence.
KEKVEKVLKEVRDISRENNKTTDTLEKEVRRLSEENKRRNEEVTRRVRKILEDVERKAR

SEQ ID NO: 7350 - protein, 61 aa, Artificial Sequence
  Synthetic sequence.
KEVEDVEEEVKKLVEENKKAVDDSREEVRKLLEENKKAVDDSRKEVEKLAKKLKEAVDRRA

SEQ ID NO: 7351 - protein, 59 aa, Artificial Sequence
  Synthetic sequence.
KEKVKRVLDEAKKISDDNKRKNEEVSKELEKISRDNLKLNEDITREIREIVERVDERLE

SEQ ID NO: 7352 - protein, 61 aa, Artificial Sequence
  Synthetic sequence.
SEVEKVEKDLRKLIKDNRDSVRRVKEEAEKLVEENRRSVEEVRRTIKELLERLEKLVRDRG

SEQ ID NO: 7353 - protein, 59 aa, Artificial Sequence
  Synthetic sequence.
KRLVDKVRRELEKILRDDNRIIKEVLDTVRRLSEDNLKKVKDVLEELTRIAEEVRERAR

SEQ ID NO: 7354 - protein, 56 aa, Artificial Sequence
  Synthetic sequence.
SKVEDLLEKLERELEKNRKRTKELLKRAEESSEDIREKVRELRERLERLIEELERR

SEQ ID NO: 7355 - protein, 59 aa, Artificial Sequence
  Synthetic sequence.
DKLLEDLERLVRRVLDEARKINEELDKRVKDSVREVEKRLRELEEEVKRIIEEVEKKAQ

SEQ ID NO: 7356 - protein, 56 aa, Artificial Sequence
  Synthetic sequence.
EELERLARIVDEAHKRSRDLLETSKREVEDAIDEIRARLEDSRRLVEEVTDEIRRI

SEQ ID NO: 7357 - protein, 58 aa, Artificial Sequence
  Synthetic sequence.
ERLKELKKRLRDLIEENDRRAKESTKKIRDLAKELRERARRTEEEIKTLMKELEDRMK

SEQ ID NO: 7358 - protein, 56 aa, Artificial Sequence
  Synthetic sequence.
KELEDLRREVEEIHKTSERLLRESDKLVEEAIRRIEELLERSKDTVTKAADEVRKA

SEQ ID NO: 7359 - protein, 58 aa, Artificial Sequence
  Synthetic sequence.
ERLKKLKEDVKRLIEENRKRAEDTKRKIEEEIRRLKEEADRTSEEIKKRADDLRRRAD

SEQ ID NO: 7360 - protein, 60 aa, Artificial Sequence
  Synthetic sequence.
DELEEVDKLVKKVHEDSRKLIEDVDRKVREVVERSDRIIETVEELVERVITEVEDMLRKG

SEQ ID NO: 7361 - protein, 58 aa, Artificial Sequence
  Synthetic sequence.
DRLRKVEKRIEDLARENEKRNRDLERKIEKLADESRKKNEDLKKRIEDLAKRLKDEAD

SEQ ID NO: 7362 - protein, 60 aa, Artificial Sequence
  Synthetic sequence.
SSLETVREEVRRVKEESDRIIKEVRDRVEEVHKTSKRIIEEVEERVERVIREVREMLRRG

SEQ ID NO: 7363 - protein, 58 aa, Artificial Sequence
  Synthetic sequence.
ERLDRVVEDIRRLAEESRRKNEELRKEVEELVKRNKELNEKLKKKVKELAKELRDEAK

SEQ ID NO: 7364 - protein, 60 aa, Artificial Sequence
  Synthetic sequence.
DDLETVKRLVDEVIRTSEELIDTVRRLVEEVHRESERILKEVKKEVERVIREVEKLRRKG

SEQ ID NO: 7365 - protein, 58 aa, Artificial Sequence
  Synthetic sequence.
KDLERVRKRIEDLAKELERRNRELEEDIKRLAKENEELARELKKEIETLAKRLEDEDR

SEQ ID NO: 7366 - protein, 60 aa, Artificial Sequence
  Synthetic sequence.
SSLEEVDRRVKEVHKESDKIIREVDKRNKEVNRRSEEIIEEVEKTVEEVAKTVDDMLRRG

SEQ ID NO: 7367 - protein, 58 aa, Artificial Sequence
  Synthetic sequence.
RELKRVKEEIDRLVEEDKEKNERSDKRAKETVDKNKKLNDDLEEKIRRLAEELRRRKK

SEQ ID NO: 7368 - protein, 60 aa, Artificial Sequence
  Synthetic sequence.
SSLKEVERLAKELHEKSERIIREVEKLSRELHKTSEKIIRDVARRVKKLIDDVREVITRS

SEQ ID NO: 7369 - protein, 58 aa, Artificial Sequence
  Synthetic sequence.
EELEKLRKRVEDLVRRNEEENKRTLRESEELVKENRKRNKELRDRVEKLVEELRRELK

SEQ ID NO: 7370 - protein, 60 aa, Artificial Sequence
  Synthetic sequence.
KKLEDVKELVERLHRESEEIIRDVERRSRELAETVKKILEEVRRLSKKLVDEVREVIKRS

SEQ ID NO: 7371 - protein, 58 aa, Artificial Sequence
  Synthetic sequence.
KDVDRVDREVEELVKENRERNKDTKRESERLAEKLRRDVEKSLRDSERLVKELRDRLR

SEQ ID NO: 7372 - protein, 60 aa, Artificial Sequence
  Synthetic sequence.
KKLEDVKRLVDKLVTESEDIIRRVTEESRRLVEESRRVIEEVKKLSEELVRRVEKVIREK

SEQ ID NO: 7373 - protein, 58 aa, Artificial Sequence
  Synthetic sequence.
ERVKKVKRDVEKLVRDSRELNKRTREESERLVEESERLNEESRKESERLVRELREKLR

SEQ ID NO: 7374 - protein, 60 aa, Artificial Sequence
  Synthetic sequence.
SKLEDVERKVRELVRRSKRVIKEVERLVRELHKRSEDVLRKVKKDSRDLAREVKDVIRRK

SEQ ID NO: 7375 - protein, 58 aa, Artificial Sequence
  Synthetic sequence.
KDVDKVRRDVEDLVRESRELNKRLKREVEELAKENRRRVEESRRESEELAKELRERLK

SEQ ID NO: 7376 - protein, 60 aa, Artificial Sequence
  Synthetic sequence.
SSIEKVLRELEDIVRKIEERNKKSHDEVRRVVEEIKRRVKKSHEDVRRVVEKIDEDIKRK

SEQ ID NO: 7377 - protein, 58 aa, Artificial Sequence
  Synthetic sequence.
DEIRRVKERLDELIRRLEELIRRNVTELKRLIDDLRRLVEENVRRLKELIDKLREDVK

SEQ ID NO: 7378 - protein, 60 aa, Artificial Sequence
  Synthetic sequence.
SEIERVLEELKKIVRRIKEKLKESHERVREVVERLKRRNEKSHRDVRRVAERIRREIEKK

SEQ ID NO: 7379 - protein, 58 aa, Artificial Sequence
  Synthetic sequence.
KDIREVKKEADRLIKELRDLIETNEREMKKLIDELEELIRDNARRLEELIKRLEEEVR

SEQ ID NO: 7380 - protein, 61 aa, Artificial Sequence
  Synthetic sequence.
SELEKVLEEAKRVVDEIKKKLEESHKDNRRTVEEIKRRNKESHERLKEAVDKLKAEIEKKR

SEQ ID NO: 7381 - protein, 58 aa, Artificial Sequence
  Synthetic sequence.
DRIREIAEELDKLIRELEKLVKRNADESDKLLDELRKLVEDNEREAERLIKELEDEAR

SEQ ID NO: 7382 - protein, 61 aa, Artificial Sequence
  Synthetic sequence.
SEIERVLRELEKIVEELKRENEDVHRRVREVVKKLKDENRKSHEEVKRMVDKIREEIKRIR

SEQ ID NO: 7383 - protein, 58 aa, Artificial Sequence
  Synthetic sequence.
DDIRRAAEKVDKLIKELEDLIRRNAEELRKLIEELEELIRRNRERLKRLIEDLKRAVE

SEQ ID NO: 7384 - protein, 57 aa, Artificial Sequence
  Synthetic sequence.
SEMERVEEEIRRLLKELDKKARDVHEADKELVKENRKLADEVERDLRRLLEELRRDV

SEQ ID NO: 7385 - protein, 59 aa, Artificial Sequence
  Synthetic sequence.
KKAIEDVLRKIKKLVEDLKRRIEEVLRESEALNEDTKRLIEEVLRDVRRTIDRLKKEAK

SEQ ID NO: 7386 - protein, 57 aa, Artificial Sequence
  Synthetic sequence.
SDMDRVEKELEELLRENEELAKDIHRRDKELLEENRELVRRAEEELRRLLEELARDV

SEQ ID NO: 7387 - protein, 59 aa, Artificial Sequence
  Synthetic sequence.
KEVIKDVLRKVRKINKETKELLRTVLEKSEKLNRDTKKRIKDVLEKIKRLIDELRERAR

SEQ ID NO: 7388 - protein, 57 aa, Artificial Sequence
  Synthetic sequence.
KEREDIEDRVRKLIEELEESVRRSNETVKKLLRELEKLLEDSNRSVEELARDLRRKV

SEQ ID NO: 7389 - protein, 55 aa, Artificial Sequence
  Synthetic sequence.
EKVLRKVEKVVEDLKRHNRKVNEEIKRVAEKLKRELEEVNKDIRRMARKLEEEVR

SEQ ID NO: 7390 - protein, 57 aa, Artificial Sequence
  Synthetic sequence.
SEAEKIAEDVERLARDLERLLKESNDTVRTLIEDLRRSVEETAKEVRDLIEDLRRRV

SEQ ID NO: 7391 - protein, 55 aa, Artificial Sequence
  Synthetic sequence.
EEVLKELKKVADELRRILEDVNRRIRKVVDDAREHNKKVVEDVRRVAKEARDRVR

SEQ ID NO: 7392 - protein, 59 aa, Artificial Sequence
  Synthetic sequence.
DEVEELERRIEKLAREVKKEIKDALRRNKRLIDEVKKIIEDVNRENRRLMEEVKRLIDA

SEQ ID NO: 7393 - protein, 58 aa, Artificial Sequence
  Synthetic sequence.
DELRRIAKRVEDLAEELKRLLDKSRETSERLVDELRKLLRESNETSKELVKRLDDRRK

SEQ ID NO: 7394 - protein, 59 aa, Artificial Sequence
  Synthetic sequence.
SEAEKLLKEAKRLADEAKKIIKRAHEENKRAADEAKKIIEEANRENEKLAREAKKLIDA

SEQ ID NO: 7395 - protein, 58 aa, Artificial Sequence
  Synthetic sequence.
DEAREIEKRVRELAEELKKLARESNEASKELAKELKELAERSNKTSEDLAKELEDRAR

SEQ ID NO: 7396 - protein, 59 aa, Artificial Sequence
  Synthetic sequence.
SEVERLLEEIKELAKRVKDIIKEVNKENKRLVDEVKDRIRKINEDNNRLVETVKELIRK

SEQ ID NO: 7397 - protein, 58 aa, Artificial Sequence
  Synthetic sequence.
KELERIEREVERLADELRKLLEESNESTERLAEELERLVRESERDSRRLAEELKRRLD

SEQ ID NO: 7398 - protein, 60 aa, Artificial Sequence
  Synthetic sequence.
SELEKLKEEIKKLADDVKRIIKKVLDENRKLVDDVKKIIKKVTEENRKLVREVAELIKAG

SEQ ID NO: 7399 - protein, 58 aa, Artificial Sequence
  Synthetic sequence.
KELEEIDKDVDRLIEELKRLLEDSNRDTERLAKELKDLLDESNKDSRRLAEELKRRTD

SEQ ID NO: 7400 - protein, 59 aa, Artificial Sequence
  Synthetic sequence.
REVDELRKEIRRLAKEVKDIIKKATERNEELVRRVKEIIKEVNRRNRKAAEEVKELIRA

SEQ ID NO: 7401 - protein, 58 aa, Artificial Sequence
  Synthetic sequence.
EDLERIRKEVEELARELEKLLEESNRETKRLARELEKLLEDSRRSTEELAKELEEAER

SEQ ID NO: 7402 - protein, 57 aa, Artificial Sequence
  Synthetic sequence.
REAEEVDKEIKKIVRDVRERIRKLNEDNRRIAEKVKREIEELNKRNRDTAKEIEKRG

SEQ ID NO: 7403 - protein, 58 aa, Artificial Sequence
  Synthetic sequence.
DELREIERDVDRLVEELRKLVEDSRRTTKRLVEELDELVETSDRETEKLVRKLRERER

SEQ ID NO: 7404 - protein, 57 aa, Artificial Sequence
  Synthetic sequence.
SDLERVLREIKKEVDDVKRLIRELNERNRTIVEEVKKLIEKLNRDNERIVREVKKRG

SEQ ID NO: 7405 - protein, 58 aa, Artificial Sequence
  Synthetic sequence.
EEVKRIEDEVRKLVRELEELLKRSDDDTERLVEELKELLKRSEKKTRELAKELRDRRR

SEQ ID NO: 7406 - protein, 57 aa, Artificial Sequence
  Synthetic sequence.
SEVDEVLKRIKEEVDRVKEEIKRLNKENNDIVRKVKKEDRDIVETIRKIAEDVKRRG

SEQ ID NO: 7407 - protein, 58 aa, Artificial Sequence
  Synthetic sequence.
DELREIDERVEKLVKELEETLRESEKDTKRLVEELEKSLKETEDDVRRLVKELKDRDD

SEQ ID NO: 7408 - protein, 57 aa, Artificial Sequence
  Synthetic sequence.
SKLEEVLRDIRRIVEEVKDEDRRIVEEIRKIAKDVKEKIKELNRENNRIVREVKERG

SEQ ID NO: 7409 - protein, 58 aa, Artificial Sequence
  Synthetic sequence.
DELRRIDEEVEKLVKELEKSVEDTKREVDRLAKELEDLVRDSKRDTDRLVKELKDRTD

SEQ ID NO: 7410 - protein, 57 aa, Artificial Sequence
  Synthetic sequence.
REVEEAADDLRRLIEENERSVRESKRTLEELIKENEDSVRRSEKSLRDLIRELEEEG

SEQ ID NO: 7411 - protein, 56 aa, Artificial Sequence
  Synthetic sequence.
VEELLKRVRDVSEESKRLDRKLNEDVKEVSKDSKRRDRELNERVRKVAEDVKETER

SEQ ID NO: 7412 - protein, 57 aa, Artificial Sequence
  Synthetic sequence.
SEVEEAAERAKRLIDKLKESADRSEKTARDLIRDLNRSTEEIAREARKLIEELKKAG

SEQ ID NO: 7413 - protein, 56 aa, Artificial Sequence
  Synthetic sequence.
VKKALEEVRRAAEEAEKADRKLNKEVKEAADRARELNKKLADEVRKAAKEAKEKAD

SEQ ID NO: 7414 - protein, 57 aa, Artificial Sequence
  Synthetic sequence.
SEVEEAAKEAKRLIEELNRSTEKIARDAKKLIEELRKSAKESADSARKLIEELKKRG

SEQ ID NO: 7415 - protein, 56 aa, Artificial Sequence
  Synthetic sequence.
VKKALEDVKRAADKAKEDNKKLLKEVEDAAREAKRADRELNKRVKEAADKAKEEAN

SEQ ID NO: 7416 - protein, 61 aa, Artificial Sequence
  Synthetic sequence.
DELEEVRERIERLIRRSEELNKKVEKENKELVDRSREINRRVLDEIRRLIREVERILEEEG

SEQ ID NO: 7417 - protein, 59 aa, Artificial Sequence
  Synthetic sequence.
EEEVRKLEEEVRELIKKLERSNRELNKETEKLVEDLKRSNKELEEDVERLARKLEEELR

SEQ ID NO: 7418 - protein, 61 aa, Artificial Sequence
  Synthetic sequence.
KELEEVEKRIEELARRVEERIKKVIEDNRRLVEESEKINEEVRREVKRLIDEVKEIIRRKG

SEQ ID NO: 7419 - protein, 59 aa, Artificial Sequence
  Synthetic sequence.
EREVRRLEERVEELARRLEELLKESNTRSEKLARDLEKSNEDLEREVEELAKRLEEELK

SEQ ID NO: 7420 - protein, 61 aa, Artificial Sequence
  Synthetic sequence.
DSVREVAERIDRLVKESERINREVIETNRRLFKESEKINDKVRKEIEDLIRRVKEIIDRDG

SEQ ID NO: 7421 - protein, 59 aa, Artificial Sequence
  Synthetic sequence.
EEDLRRLKKKVDDLARKLEESNRRSNEDSKRLARELEESNKDLKRRVDELARELEERLK

SEQ ID NO: 7422 - protein, 61 aa, Artificial Sequence
  Synthetic sequence.
DELKEVEERIERLIRESKRVNEEVKETNRRLVRESKEINKRVHDTVRRLVEEVRRIIDERG

SEQ ID NO: 7423 - protein, 59 aa, Artificial Sequence
  Synthetic sequence.
EKEVRRLREEVEKLAKELKRSNDESNKESERLVEDLKRSNTENSKAVEDLARELKERLK

SEQ ID NO: 7424 - protein, 60 aa, Artificial Sequence
  Synthetic sequence.
RSVEELKKKVEDLVRKLEELVKDSKRESKELVDDSERLVKELEDDVRRLVRELRERVRRR

SEQ ID NO: 7425 - protein, 59 aa, Artificial Sequence
  Synthetic sequence.
ERIIKRIEEEIEELIRRVEEIIRKVIKENRELVERDREIIKTVLERIRELIKEVTDRIE

SEQ ID NO: 7426 - protein, 60 aa, Artificial Sequence
  Synthetic sequence.
SEVEKLEEEVERLVRDSERLNKRLEDRVKKLVEDSERLVRELEKTVRDLVKKLKDDVRRR

SEQ ID NO: 7427 - protein, 59 aa, Artificial Sequence
  Synthetic sequence.
ERIIRRIRKEIKDLFDDDKRISEEVERRIERLFKEDKKIIEDVEREIRRLIKEVEDRIR

SEQ ID NO: 7428 - protein, 60 aa, Artificial Sequence
  Synthetic sequence.
DDVERLERRVRELIKESEKLVDDLRKDVERLVKKSRDLNERLREDVERLVKELEDRVRKR

SEQ ID NO: 7429 - protein, 59 aa, Artificial Sequence
  Synthetic sequence.
KEIIDKVRKEIEDLVRKDKEIIDEIRKEIRRLVEEDEEISRRVEETIRRLIREVAERIR

SEQ ID NO: 7430 - protein, 57 aa, Artificial Sequence
  Synthetic sequence.
SEVDELRKRVEELVRRSRKLVEEHRRKVRELVEESRRLVEELRRDVERLVKKLRDEL

SEQ ID NO: 7431 - protein, 60 aa, Artificial Sequence
  Synthetic sequence.
ARDLIEEVRERADRVAKKDEDVIRKSEEDTERVVREDKKIIDRVRKDVEEVIRRVEEETR

SEQ ID NO: 7432 - protein, 61 aa, Artificial Sequence
  Synthetic sequence.
STLERLTEDVKRVIREVEEVIKKLKEEVDKSLEDVRRKIEESRKETKRVIDEVKRRIKDKR

SEQ ID NO: 7433 - protein, 56 aa, Artificial Sequence
  Synthetic sequence.
VEELAKRLEELIRRLEELVDRLRKELKESIEEIRKRVRDHKEESKRLIRELDEEVK

SEQ ID NO: 7434 - protein, 61 aa, Artificial Sequence
  Synthetic sequence.
STLERLDEDVKRVAREDTELIKESEERTKKSADDVRKKIEDSRRTTDKVVTDVEDIIEKKR

SEQ ID NO: 7435 - protein, 56 aa, Artificial Sequence
  Synthetic sequence.
VEELAEKLKELLKDSERRVDEHRRKSEESTREIEELVKRHEDRSRELIKRLDEEVR

SEQ ID NO: 7436 - protein, 60 aa, Artificial Sequence
  Synthetic sequence.
SLLEKLRRRVDEVIKRDDELIEESKRRTDEALKRVEERIRKSLEETKEAVDRVRDIIRRV

SEQ ID NO: 7437 - protein, 56 aa, Artificial Sequence
  Synthetic sequence.
VDELRERLRKLLEDSEEKVKRHKDESDKLIKDIEDKVKRHEDESRRLIRELREELK

SEQ ID NO: 7438 - protein, 56 aa, Artificial Sequence
  Synthetic sequence.
SEADELRKKLEETNKDIKRRVEELKRRLEESNERIEELVRRNEKKSKDLLDDVRRR

SEQ ID NO: 7439 - protein, 59 aa, Artificial Sequence
  Synthetic sequence.
EEVLKRLDKKLEDSRRDVERVEKEVEELLRESEERVKRVVETVDKTDEEVKKDVDDKRR

SEQ ID NO: 7440 - protein, 56 aa, Artificial Sequence
  Synthetic sequence.
SEAEDLEKKAEDTNREIKKIAEELKKHAEDTNREIEKKVEDLRREAERILREVARK

SEQ ID NO: 7441 - protein, 59 aa, Artificial Sequence
  Synthetic sequence.
EEVLERLERKLRESKREVDRLAEKIKKLNDDSRKRVDEVVERVRRLLEDVKRKVDEARR

SEQ ID NO: 7442 - protein, 58 aa, Artificial Sequence
  Synthetic sequence.
DEVERLEEDVERSIRDSEKVVRDSERRVRESNEEIRRLIEESDKDVKRLIDEATKKSG

SEQ ID NO: 7443 - protein, 59 aa, Artificial Sequence
  Synthetic sequence.
REVIRELKERLKEISDRLKKRSEKSVRDLDDISRKIVRRSEDTVRKLREIARRLDERTK

SEQ ID NO: 7444 - protein, 58 aa, Artificial Sequence
  Synthetic sequence.
REKDELEEAVRRSNKRLKDILEKSRKDVEESIKRSEELLKRSDDEARKLIEEMTRKSG

SEQ ID NO: 7445 - protein, 59 aa, Artificial Sequence
  Synthetic sequence.
RKVIEDVLRELKKITDEIEKESRRSLDELRRISKELEDDSRRTLEELKKIVKELKDRET

SEQ ID NO: 7446 - protein, 58 aa, Artificial Sequence
  Synthetic sequence.
DEDRRLEEEVRKSIEESERVIERSEEEVRRLIEEARTLLEDSRRKVEDLLREMTRRAG

SEQ ID NO: 7447 - protein, 59 aa, Artificial Sequence
  Synthetic sequence.
REVIEKVLRELREISERLKRESERSLRELEEIARDLLRRSRRTVEELRRIAEELVKRAK

SEQ ID NO: 7448 - protein, 60 aa, Artificial Sequence
  Synthetic sequence.
DELEEVLERIEREIRRVSERSEELSRRNEKIIREVEEESRRILEEIKREIDEVKKRAERV

SEQ ID NO: 7449 - protein, 62 aa, Artificial Sequence
  Synthetic sequence.
EEAKKLVREVEETVRKLVEELREMNKRHEDKNRELSDRLREIDKRLEDEVRKLVEELRKKVE

SEQ ID NO: 7450 - protein, 60 aa, Artificial Sequence
  Synthetic sequence.
DELEEVEKEMERIIREVERKLREVNERIKEIIERVIRESKEILDELKRIIDEVKKRAERV

SEQ ID NO: 7451 - protein, 62 aa, Artificial Sequence
  Synthetic sequence.
EDAERLVRELRKKVEELKRRLEELNRDDKRTIDELVKTLDKIDRELRKTVEDLVRDLERDVK

SEQ ID NO: 7452 - protein, 57 aa, Artificial Sequence
  Synthetic sequence.
SKVDEVLKDVRRISEESERRIRELNDRSRKISKESEDRIRELLRRLEEIVERLKRTN

SEQ ID NO: 7453 - protein, 56 aa, Artificial Sequence
  Synthetic sequence.
AEELRKEVERLIRENEELVERHRKTVEELRRRNEELVKRLEDTVRKLEKELKEEAD

SEQ ID NO: 7454 - protein, 57 aa, Artificial Sequence
  Synthetic sequence.
SELDRAADRLRKISKRSEEEIRKLNEEVKKISKESEEKIRRLNEEVKRIVEEVKRRN

SEQ ID NO: 7455 - protein, 56 aa, Artificial Sequence
  Synthetic sequence.
AKELAEIVEKLIRDNRRLVEEHEESVRRLEDRNRKLVEDHERTVRKLIKELRETRR

SEQ ID NO: 7456 - protein, 57 aa, Artificial Sequence
  Synthetic sequence.
SELEKLLRDLEEIARKVEEEIRTLNEDVKRISKESKERIDRLKEELKKIVDDLKKRR

SEQ ID NO: 7457 - protein, 56 aa, Artificial Sequence
  Synthetic sequence.
AEDLRREVERLIRELRKLVREHERSVRKLIEENRRIVRELEELVKKLRKELEDTLR

SEQ ID NO: 7458 - protein, 57 aa, Artificial Sequence
  Synthetic sequence.
SELEEAERRLREIVRKVEEDSRKLNEELKREVDEVRRRSEELNKRVRDEAERVRKEN

SEQ ID NO: 7459 - protein, 58 aa, Artificial Sequence
  Synthetic sequence.
EKAEDLARIVKKLVEDLKRLNKRHKESVDELVRRLEELDREHERTIRRMIEELRETER

SEQ ID NO: 7460 - protein, 60 aa, Artificial Sequence
  Synthetic sequence.
KEVEKLLEDLKEVARRVSEEIKRLLKELKEVSKRSEDRIRTSLERVKKVVEDVLREADEF

SEQ ID NO: 7461 - protein, 55 aa, Artificial Sequence
  Synthetic sequence.
RELKEEIEKLLRRLRKLVKELKEEIKKIVDRNRKLVREHEARSEELKEEIRREVE

SEQ ID NO: 7462 - protein, 60 aa, Artificial Sequence
  Synthetic sequence.
SEKEELLKRVAEVSKKSKDRARELNERLKKVVDEVLETIRKLNEDLKRVVERVKEKIKDK

SEQ ID NO: 7463 - protein, 55 aa, Artificial Sequence
  Synthetic sequence.
KELRKEAKRNVDENREVVKENKRTTEKLLRDLDRILKENKRTVEKLVRELREEVR

SEQ ID NO: 7464 - protein, 60 aa, Artificial Sequence
  Synthetic sequence.
DEKERLLEDVKRASEDSERRIRELNDRVRRVSEESERRIRKLNKELRDEVEKVLREIDRI

SEQ ID NO: 7465 - protein, 55 aa, Artificial Sequence
  Synthetic sequence.
DELREEIEKNLRRNEELVKKNKKDSEDNKRDNDRLVKENEKTTEDLLRRAKEEVD

SEQ ID NO: 7466 - protein, 60 aa, Artificial Sequence
  Synthetic sequence.
DETETVEKKLRDVLERVKKDSEDSREELKRVHKRSEELSRRSNKELDDVLDEVRRIIERS

SEQ ID NO: 7467 - protein, 55 aa, Artificial Sequence
  Synthetic sequence.
EELKKRLDEMRKTIEKLLEDTKEELRELIERNKKLLDDTARRAEEIIKEIEDRSK

SEQ ID NO: 7468 - protein, 60 aa, Artificial Sequence
  Synthetic sequence.
SREEKVLEDLDRVLKRVTDLSKESLDEVERVHEESERLIRDSNRVLRDVLEKVREIITKS

SEQ ID NO: 7469 - protein, 55 aa, Artificial Sequence
  Synthetic sequence.
KELKDRAREVIRRIEKLVEDTERALRDLIRKNEELLKRTEEELKRAEEDIRRKSK

SEQ ID NO: 7470 - protein, 61 aa, Artificial Sequence
  Synthetic sequence.
SDAERVLREIERLLEELKELVERVVRKSEELLRRAKRVNEEVNREIKKLADELEEVIRRKG

SEQ ID NO: 7471 - protein, 59 aa, Artificial Sequence
  Synthetic sequence.
KEVVDTLRRVVEEITRELEELLERLRRVSEEIRRTLEELLERTRRLVEEIERKLREALK

SEQ ID NO: 7472 - protein, 61 aa, Artificial Sequence
  Synthetic sequence.
SELDDVRRKIKRLIDELKRVNEKVNKDSEDLVREVERVNRDVNRRVKELLEELKRVIDERG

SEQ ID NO: 7473 - protein, 59 aa, Artificial Sequence
  Synthetic sequence.
EEMVERLRREVEKLERELRELLRRTEENSRRAKERLEDLLRRTRELVKRIEERLREELR

SEQ ID NO: 7474 - protein, 60 aa, Artificial Sequence
  Synthetic sequence.
SDVERLKKRVDELAERLKRLDEELKKEVDRIETELRELLKRHEDRNRDISRRLAELLKDA

SEQ ID NO: 7475 - protein, 59 aa, Artificial Sequence
  Synthetic sequence.
KEIVERILEELDRLMEKVERVSREILKTIEKLARDIKKRIEEVTRESERLAREVEEALR

SEQ ID NO: 7476 - protein, 60 aa, Artificial Sequence
  Synthetic sequence.
DEVETLEKRVRELERRLEELNKELREEVRKIVERAKELDKRHKDDNERIEKELRELLRDV

SEQ ID NO: 7477 - protein, 59 aa, Artificial Sequence
  Synthetic sequence.
DEIAKRILDEIDRLMEEAEKVTRDILRKVEELLRRVEDASRRVTKKSRELLKKVKEDLR

SEQ ID NO: 7478 - protein, 60 aa, Artificial Sequence
  Synthetic sequence.
SEVETLEKAVRDIVERLKDLNRRLEKEVRDAVKRLRDLLREHEKRNREIAKDLTDKLRKA

SEQ ID NO: 7479 - protein, 59 aa, Artificial Sequence
  Synthetic sequence.
KEAATDILRKAEELADEVRRATEEIAKEIRRLVKEVEEVIKDVTRKSDELLKRVADAAK

SEQ ID NO: 7480 - protein, 60 aa, Artificial Sequence
  Synthetic sequence.
DELETLADVVRKLIERSRDLLRRHEKRNDEIKKRLDELDRELKERAEEIKKRLEELLRRR

SEQ ID NO: 7481 - protein, 60 aa, Artificial Sequence
  Synthetic sequence.
AEDVVRDVLRKAEKVVEEDERLIRRVTEESDRVLDRVEKETKKIVDEAKRMLREVEERIR

SEQ ID NO: 7482 - protein, 60 aa, Artificial Sequence
  Synthetic sequence.
SLIDELRERVKEIKKRSEELLKRHEDENRRIVKRSRELLKKLRDVVRDIIRELRKELEDD

SEQ ID NO: 7483 - protein, 60 aa, Artificial Sequence
  Synthetic sequence.
AEEVVRRVLKEAEDLLRKDEKILRDVTRRSEKALREDEELAKRVLDEMRKVLEDVKRKSK

SEQ ID NO: 7484 - protein, 60 aa, Artificial Sequence
  Synthetic sequence.
EELERLAESVRRIKERLKKLDREHEERNKRIVETSRKLLEELEREVRKIEEDLKRLLDER

SEQ ID NO: 7485 - protein, 60 aa, Artificial Sequence
  Synthetic sequence.
AEEVVRDILRRLEELMRRAEEVTKKLTDDSRRLLKEDEDLVREIEERLRRLLKEVKERVD

SEQ ID NO: 7486 - protein, 60 aa, Artificial Sequence
  Synthetic sequence.
DEDRDVKREVKKVHEDSARTVEKLDREVEKVHEESERTVRKSEKEAKEVLDRVKDIVKKK

SEQ ID NO: 7487 - protein, 55 aa, Artificial Sequence
  Synthetic sequence.
EELKEDLKRILKENEDLVRELEKKLDDIMRENEELVREHEEKSKRIVRELEEEVR

SEQ ID NO: 7488 - protein, 60 aa, Artificial Sequence
  Synthetic sequence.
EEKERADRKLEEVHKESKKTVEDSDEALERVHRESKRTVEESRKTLEDVVREVKRIVEEK

SEQ ID NO: 7489 - protein, 55 aa, Artificial Sequence
  Synthetic sequence.
KELRRKVEEILKRNEEEVRKHKEKSKKIVEDNRRLVKRHKEESEEVVRDAAREVK

SEQ ID NO: 7490 - protein, 61 aa, Artificial Sequence
  Synthetic sequence.
DEDREALKEVEDVHRRSEEKVRESRRRAEEVHKESKKIVDELRRRSEESLKRVEDEVRKKR

SEQ ID NO: 7491 - protein, 55 aa, Artificial Sequence
  Synthetic sequence.
EELKDELRKIVETNRELVRRHHETVKKIMEENERLVRELEKRLEEADRKLEEEVR

SEQ ID NO: 7492 - protein, 61 aa, Artificial Sequence
  Synthetic sequence.
SLEEEVRRIVDDIRRTNKELLDRSARRAEEIERRLEELLRRSRERADRIREEMRRMLEKAG

SEQ ID NO: 7493 - protein, 59 aa, Artificial Sequence
  Synthetic sequence.
KKTVDDVLKRLKEENDRSREEIKRSNEESDRVLDEVRKRSEDSNRRLDKIVDEAKKELK

SEQ ID NO: 7494 - protein, 57 aa, Artificial Sequence
  Synthetic sequence.
DELEEVLERLREIAERVIKESKEINDELKRSSERSKRESDKVNKRMREIMKELKDRG

SEQ ID NO: 7495 - protein, 59 aa, Artificial Sequence
  Synthetic sequence.
EEDVRRIRKLVEDIARRLKEIIERNRESVRKSREENKKSIEENRRSVKKIADEAREDAR

SEQ ID NO: 7496 - protein, 57 aa, Artificial Sequence
  Synthetic sequence.
EETERLIEAVKRIAEEVRKTIERLMERVEKTTRESEELNRRLNRELDREVEEVERAN

SEQ ID NO: 7497 - protein, 55 aa, Artificial Sequence
  Synthetic sequence.
EELEKVVREVAERLDRLLKALRDLVEESARRNKRLIEETDRRIKEIAERLKRTSD

SEQ ID NO: 7498 - protein, 60 aa, Artificial Sequence
  Synthetic sequence.
SEAERLLEELERSTRESAKRIRDLADKLRRSSEESVKDIERLTKELEEAVRRVLDKIRKK

SEQ ID NO: 7499 - protein, 59 aa, Artificial Sequence
  Synthetic sequence.
EEVVRRLAKVVEESRRTNEKLLRDLEKLVEDSKRRNDELLEKNARRIKEVEDELKRETK

SEQ ID NO: 7500 - protein, 60 aa, Artificial Sequence
  Synthetic sequence.
KDAEDLLRRLRESTKRSEDLVRKLLEELERSSRESEKLIRELTDRLDKVVKDVERRIREK

SEQ ID NO: 7501 - protein, 59 aa, Artificial Sequence
  Synthetic sequence.
EEVVKRLEKAVKESEDRNKELLDRLRKRVEDSKRRNDKLLKENRKRIEEIKRRLDELLR

SEQ ID NO: 7502 - protein, 60 aa, Artificial Sequence
  Synthetic sequence.
SKAEKLLRDLEKSTEDSERRIRELLERLRESSRTSEELAKRLEEEVERATREVADKIRKK

SEQ ID NO: 7503 - protein, 59 aa, Artificial Sequence
  Synthetic sequence.
KEVVDRLREIVERSREKNRKLLEDLRRAVEESKKRNEEVLRKLKKKVEEIEEELKERLR

SEQ ID NO: 7504 - protein, 60 aa, Artificial Sequence
  Synthetic sequence.
SEIEELLKTLKRSTEKSEEDARRLLEELTRSSEESVKRLRDLTERLKEVAKEVIERIRRR

SEQ ID NO: 7505 - protein, 59 aa, Artificial Sequence
  Synthetic sequence.
KKVVDRLKRMVDESRKRNEELLKRLEKRVRESRKRNDELLEENKRVIDKIREELERLRK

SEQ ID NO: 7506 - protein, 60 aa, Artificial Sequence
  Synthetic sequence.
SLLEEIEELVRRAIDTVRRSSEELKRLVDRVNETNKRSTEELRELAERVDRRLDKLLKEI

SEQ ID NO: 7507 - protein, 59 aa, Artificial Sequence
  Synthetic sequence.
RELVEKLKRELRRILEEVRRLNEELMKEIRDTNRKSEKLNRDLKEEIKKILEDVEREVR

SEQ ID NO: 7508 - protein, 60 aa, Artificial Sequence
  Synthetic sequence.
DEAEKLKERLKRVLRRVREINRKLLDELRKSNEKVRRINKRLKEELKRVLDEVEKRVRED

SEQ ID NO: 7509 - protein, 59 aa, Artificial Sequence
  Synthetic sequence.
EKLVREIEEMVRRLKEEAEKLSEEIRKIVRESRETLKKLSDEVRRLVERAEEKARKDTK

SEQ ID NO: 7510 - protein, 61 aa, Artificial Sequence
  Synthetic sequence.
KEDDDLRREIERLLRELEKMNRKVLEDARRLLEELRRVNKEVAERIKDLERRLKDVVEKKG

SEQ ID NO: 7511 - protein, 55 aa, Artificial Sequence
  Synthetic sequence.
ERVKEEVDEIRDRLRKSNETLREIVRRIEEDLRKSDRELEELVERIEKRLRELVR

SEQ ID NO: 7512 - protein, 60 aa, Artificial Sequence
  Synthetic sequence.
KLVEEVKRLIEESARKNEELIKEVEKEIRRSRKRDKELIEEIERLIREVKKRLEELLTEK

SEQ ID NO: 7513 - protein, 62 aa, Artificial Sequence
  Synthetic sequence.
EEAEELVRRVKEEIKRSTTESEKLVKEVKDRARKSHEDSERLAREVLKEIRRLLEEVEKDVR

SEQ ID NO: 7514 - protein, 60 aa, Artificial Sequence
  Synthetic sequence.
KEVEDVKELIKKVNEEIKKIHERSNEEIKRVNEELRKIIKKVKDDLRRVLEEIERLSREG

SEQ ID NO: 7515 - protein, 59 aa, Artificial Sequence
  Synthetic sequence.
EDLLREAEKLVEDSRRSSEELVRRDKKLVKESRETSERLVRDLERLLREIEKRVREEAT

SEQ ID NO: 7516 - protein, 60 aa, Artificial Sequence
  Synthetic sequence.
SEVETVAELIKDVNRRIREEVEEVKRRIEELNDRNRKIAEEVKERIRRVEDEIREARKRG

SEQ ID NO: 7517 - protein, 59 aa, Artificial Sequence
  Synthetic sequence.
DELLTRIDRLVKDSERSSRKLVRELEELVRRSEEETEKLVRELERLVTEVARKVDEEAT

SEQ ID NO: 7518 - protein, 60 aa, Artificial Sequence
  Synthetic sequence.
KDVEEALETLKRILDRVAKDNEDLIRELRDINRKITKENEDLIRDLERILREVEEEVKRR

SEQ ID NO: 7519 - protein, 59 aa, Artificial Sequence
  Synthetic sequence.
DELRRRLEALVEDVRRTLKELIEKTEKVVKEVEDNLRRLLKRTEEVVREVEKKLEEDRR

SEQ ID NO: 7520 - protein, 60 aa, Artificial Sequence
  Synthetic sequence.
SEVEKVLEDLKRILEEIARRNEELNERLERINEEITRRNEKSNEETKRVLDKLADDVRKR

SEQ ID NO: 7521 - protein, 59 aa, Artificial Sequence
  Synthetic sequence.
EELERTLEKLVDEVRKRLKELLDRSRELVKRVRENLERLEEDTRRLVERVRRELEKLRK

SEQ ID NO: 7522 - protein, 60 aa, Artificial Sequence
  Synthetic sequence.
DEAEKVKRDIEEILKRVAEELKRVLEEIRRSSEEVERRNKEVLETLKRILEEVKERLKRI

SEQ ID NO: 7523 - protein, 58 aa, Artificial Sequence
  Synthetic sequence.
ELVRELRELVRRIEEELRKLTEEARKLLEDNRRRLEELDRELKELVDRIREELERARK

SEQ ID NO: 7524 - protein, 60 aa, Artificial Sequence
  Synthetic sequence.
DEAEKVLEDIKRSSEEVTRRNEKVARDSRKLSEDVEKKNRDVAERIKEIVDKVRRDLSRI

SEQ ID NO: 7525 - protein, 58 aa, Artificial Sequence
  Synthetic sequence.
ELVERARELVETNKKRLEDLDRELEELVKENEERLKRLDERLKELVDDIRRRAEEARK

SEQ ID NO: 7526 - protein, 60 aa, Artificial Sequence
  Synthetic sequence.
REAEELLKDLERSSEEVDRRVKESNKESEKVSRDVEKKVKDSNKELREITREVAERAKRT

SEQ ID NO: 7527 - protein, 59 aa, Artificial Sequence
  Synthetic sequence.
EKMIKRAAELLKTSEDRLRKLIKESEDSIRENEKKLRELIRESEETLREIRKRLEDLER

SEQ ID NO: 7528 - protein, 60 aa, Artificial Sequence
  Synthetic sequence.
KEAEDLMEELKKSSEDVERRVRESNKRSKEVSDRVAEEVKKLLERLKKILEEAARKRDRV

SEQ ID NO: 7529 - protein, 59 aa, Artificial Sequence
  Synthetic sequence.
EKVIRTIERLVRTSEKKLRKLLDDSRKSVEENRKRVTDLKKEARDLVEDIKRRLEEERR

SEQ ID NO: 7530 - protein, 61 aa, Artificial Sequence
  Synthetic sequence.
REEEKVLKDLDDVLKEVTERVREDLRTNEDVVRRAEEEVTRLHEELKRSNDRAKEEVDRKK

SEQ ID NO: 7531 - protein, 55 aa, Artificial Sequence
  Synthetic sequence.
EEVRKLVRELKEMLKRLEEDARRLVETTKKRLEDLKRTTDKLVKELEKTLEELRR

SEQ ID NO: 7532 - protein, 60 aa, Artificial Sequence
  Synthetic sequence.
SDRERVAKKLRDVLKEVDEEAKKDHDTNKTVVKKVREDIERILRRLKEVLRKVKEEAERK

SEQ ID NO: 7533 - protein, 55 aa, Artificial Sequence
  Synthetic sequence.
EELRKLVKELRDRLRELEESSRKLVEDTRRDLERLREEIDRLVEELERRLEELRR

SEQ ID NO: 7534 - protein, 61 aa, Artificial Sequence
  Synthetic sequence.
SDAETVLREIRKLNKEVNDASRETLERIEELNRRVERIVREVLKDIERLAREVEEVVRREG

SEQ ID NO: 7535 - protein, 59 aa, Artificial Sequence
  Synthetic sequence.
EELIRRLEEIVKESEDNSKENVDRNDRIVRESERSSKELEDELRRIVKKLAREVDELIR

SEQ ID NO: 7536 - protein, 61 aa, Artificial Sequence
  Synthetic sequence.
DDVERVLERIKELNRRVEEIVRRVLKTSRDLNKELNDISREVLKRIKDLMREVEEVVRRDG

SEQ ID NO: 7537 - protein, 59 aa, Artificial Sequence
  Synthetic sequence.
EELIRELERIVEESKRTSDKLAKELDKLNEDSERNSRKNIEDLRRLVEELARKAEELIK

SEQ ID NO: 7538 - protein, 60 aa, Artificial Sequence
  Synthetic sequence.
SLVEELEKLVEENERNMRELDKENRDIVEKNRENVERNERELRKLVERLERRIREVVRTK

SEQ ID NO: 7539 - protein, 60 aa, Artificial Sequence
  Synthetic sequence.
LEEIVREVKERIKRSNDEANKENKRTLDEIRDSNRDVNRVSKEVLDEIRRLLKELEDAAK

SEQ ID NO: 7540 - protein, 60 aa, Artificial Sequence
  Synthetic sequence.
SLIETLEELVDRNRRNLEKLDEENKDMLRKNEEDVEKNERDLRKLVKELRDEIRKLIEEK

SEQ ID NO: 7541 - protein, 60 aa, Artificial Sequence
  Synthetic sequence.
LEDIVREVIKRIEESNRRVNKRNRETLERSKKSNKDVNEASERVLRRIKELLDELRERAK

SEQ ID NO: 7542 - protein, 60 aa, Artificial Sequence
  Synthetic sequence.
SLEEELRRLVEELEKRLRELDKRNKDLLRENERNVEKLARDLEELVKKVRRVVEDVVTKK

SEQ ID NO: 7543 - protein, 60 aa, Artificial Sequence
  Synthetic sequence.
LEDIVREVLKRVKDLLERAEEENKKTLDDSRKSNEEVNREVEKVIRRIEELVKRLEEAAK

SEQ ID NO: 7544 - protein, 60 aa, Artificial Sequence
  Synthetic sequence.
DLVERLEELLKKIKRELEENIKRNRELLKKLEENLRRNEEKNRKLLEEIRKRLEDLLREK

SEQ ID NO: 7545 - protein, 62 aa, Artificial Sequence
  Synthetic sequence.
EEAEELVRRVEERMKEMVKRVHEVSEKNLRDIKKWLEDVNRISKETLDRLRELLKEAERRVR

SEQ ID NO: 7546 - protein, 60 aa, Artificial Sequence
  Synthetic sequence.
SLREELEELLKRIKERLKRLIEENRRLLEDLRRNLEENIRRNERTVEELKRDVKRLLDEK

SEQ ID NO: 7547 - protein, 60 aa, Artificial Sequence
  Synthetic sequence.
AEELVRRVKEEMERAVEEVKKTSEENLKAIKTWLEEVNRISEETLRRMREVLKELREDAK

SEQ ID NO: 7548 - protein, 60 aa, Artificial Sequence
  Synthetic sequence.
RLVEELEKLLKDSHDKDRKLIRENEELLKELKRNLDENIKTNEELVDRIRKRVEDLLREK

SEQ ID NO: 7549 - protein, 60 aa, Artificial Sequence
  Synthetic sequence.
AEDLVRRVEKEARDSSDESRRISEENLKEIKKWLDEVNEISKRTLEDAKRLLEDLERKAT

SEQ ID NO: 7550 - protein, 60 aa, Artificial Sequence
  Synthetic sequence.
DLEEELKTVLDRARKDVKRLKEELERILEEVKRMVEELDKRLEDLDEEVREKVKRLIDEK

SEQ ID NO: 7551 - protein, 59 aa, Artificial Sequence
  Synthetic sequence.
ERDVKRVLREAEELLKRVRDLVEKVLREIKRILEEVEELNRRIIRTSREILKRVEEEVK

SEQ ID NO: 7552 - protein, 60 aa, Artificial Sequence
  Synthetic sequence.
SLEERLDKVRRRVEEEIKRLEDRLEELDRRVAETVKRLDDEARKLDEELRERVKDIIRKK

SEQ ID NO: 7553 - protein, 59 aa, Artificial Sequence
  Synthetic sequence.
EEKVKRVIEEMEEIVKEVRKRVDEVIKTSEEILRRVRELNKEILKESEDLAEEVRKKAT

SEQ ID NO: 7554 - protein, 60 aa, Artificial Sequence
  Synthetic sequence.
KLEDELRKILEENRRIVKELEERMKRLDEAVRKAVEDLARSNEESNKRVKEVVDDLIRKK

SEQ ID NO: 7555 - protein, 59 aa, Artificial Sequence
  Synthetic sequence.
EEDVKKVLDDIKESSDRVRREIEEVLKESEERLRRVEKKNEDIDRRSEEILDDVRRKAK

SEQ ID NO: 7556 - protein, 60 aa, Artificial Sequence
  Synthetic sequence.
SLEEKARDVLRRSKELNDENRERAERMLDTNRRIADKLREEVERILREVEETVRRLIDEK

SEQ ID NO: 7557 - protein, 59 aa, Artificial Sequence
  Synthetic sequence.
EDVVERLLKEVEDSSRRVHKRSEELLRESREISERVRETVKKLLEDVERLLRKVTKEVK

SEQ ID NO: 7558 - protein, 60 aa, Artificial Sequence
  Synthetic sequence.
SLEDELREVLERSREKNERLRREAKKLLDTDRERVREILREAEKVLEEVKRTVEDLVREK

SEQ ID NO: 7559 - protein, 59 aa, Artificial Sequence
  Synthetic sequence.
EKVVEELLKRVEDSSKKVEDDVRRLLKEVEKISTELEELAKELVEEVRRIVKEVADRVK

SEQ ID NO: 7560 - protein, 60 aa, Artificial Sequence
  Synthetic sequence.
SLEERAEKILRDSKRTNEKNEEDVRRLLERNERRVRKIEEEAKKVLEDVRREVERLIREK

SEQ ID NO: 7561 - protein, 59 aa, Artificial Sequence
  Synthetic sequence.
EDVVRKLLDEVRESSERVHRKSEELLRRVEEISRTVEREVKKLLDRVRRVLEEAEKEVR

SEQ ID NO: 7562 - protein, 60 aa, Artificial Sequence
  Synthetic sequence.
DESRELVERVERVVRKVEKDHERLDRANKESTDRVREAVRRLDEENREVVRKVEDEVKKV

SEQ ID NO: 7563 - protein, 55 aa, Artificial Sequence
  Synthetic sequence.
KEAERLLDDVRRKLEELVRNAERSLEESRKTNEELEKRVRESLKEVERVLRELEK

SEQ ID NO: 7564 - protein, 60 aa, Artificial Sequence
  Synthetic sequence.
RETEEVIKTLEEVVKEVEERVRRLDEENKESTERVKKTVDDLDEENKRVVREVERRVKEV

SEQ ID NO: 7565 - protein, 55 aa, Artificial Sequence
  Synthetic sequence.
KRMEEVLKRVDERLKELERKVTDSLRRSREVNKRLRDKVEKSLREVEKVLEDLKR

SEQ ID NO: 7566 - protein, 60 aa, Artificial Sequence
  Synthetic sequence.
SLEERLREILKRNKEDVEDIRRRLEEILKRNKEEIDRLREELRRILEEVKREVKELIKRK

SEQ ID NO: 7567 - protein, 59 aa, Artificial Sequence
  Synthetic sequence.
EKTAEEVIERIKKLTEDVRRDVERVIREIEKSSDDLRKVVKDVIDDIKRLLKELREEIN

SEQ ID NO: 7568 - protein, 60 aa, Artificial Sequence
  Synthetic sequence.
SLEERLRKILTENERVIRKLERDLEENLERNKKTVKEIEDRLRKLDEDVERLVRELLRRK

SEQ ID NO: 7569 - protein, 59 aa, Artificial Sequence
  Synthetic sequence.
KDTAEEVIKEIEELTRRLEEEVRRVNERSDKSNEDVRRRVKEVEDESRDLARRLAERVN

SEQ ID NO: 7570 - protein, 60 aa, Artificial Sequence
  Synthetic sequence.
SLEERLRKILEKVKRTVDESRKRSKRLLEENRETMDRLREEAEEILERVKEKIKELVDRK

SEQ ID NO: 7571 - protein, 62 aa, Artificial Sequence
  Synthetic sequence.
EEAEKLVEEVIRDLDRVADELRELSKRLSDRSRESNERVRRTVKEVIKEIKRVLKELEEKVK

SEQ ID NO: 7572 - protein, 60 aa, Artificial Sequence
  Synthetic sequence.
DLRERMEKLLKEVKDEIDKSEKKSEDNLRTNKKDVDEIRKRLKRILDEVKEELRKLIDEK

SEQ ID NO: 7573 - protein, 60 aa, Artificial Sequence
  Synthetic sequence.
AEELVDRVAKRIRRVVEDVKRKSEDLNRKSNESNKRVRDLVERVKEEIDKVRDELRKSVK

SEQ ID NO: 7574 - protein, 60 aa, Artificial Sequence
  Synthetic sequence.
SEEERIRELLERVRRRLEESKKKSKDVADEVKETNDESRERSEKLLREVEERLRELLREL

SEQ ID NO: 7575 - protein, 56 aa, Artificial Sequence
  Synthetic sequence.
VEELRKEVEEVVERVRRISERLTEELRRSSERVKRISERLLEDLERVVRDVARRVK

SEQ ID NO: 7576 - protein, 60 aa, Artificial Sequence
  Synthetic sequence.
SEEERIRELLERVDRRLKESEKRSTDVARRVREENKELEKAARKILEDARRELEKLLREI

SEQ ID NO: 7577 - protein, 56 aa, Artificial Sequence
  Synthetic sequence.
VEELIKRVEDMVREVEKTSRKLIEELKRSSDEVRKMVEELLRRLERVLEEVKKRVK

SEQ ID NO: 7578 - protein, 58 aa, Artificial Sequence
  Synthetic sequence.
KDEETVTKLLEDVERKNRESEKDSRKIVEDVKDENRKLEDEARKSLEDSERKLERLER

SEQ ID NO: 7579 - protein, 56 aa, Artificial Sequence
  Synthetic sequence.
VRELAKRLRESTERVEEISRRLIKELEDSSDKVRKVVEDLLRENKEAVRRVAEEAT

SEQ ID NO: 7580 - protein, 60 aa, Artificial Sequence
  Synthetic sequence.
SELEKVEEDIRRLVERVKKIAEDVERLTRELVKEVRKSTEDSVRDIERLMKELREIARDV

SEQ ID NO: 7581 - protein, 59 aa, Artificial Sequence
  Synthetic sequence.
KDAKKRLEDLLDTLRKIVEDVSRRLKELNDRLRKLVEDSKRRNEELLRRLREIVKEIAK

SEQ ID NO: 7582 - protein, 60 aa, Artificial Sequence
  Synthetic sequence.
DSDKEVEKRIRELMKEVKDSTKESEDKIRESNERVKESSKRSEDEIRKLMEELDEIAKRV

SEQ ID NO: 7583 - protein, 59 aa, Artificial Sequence
  Synthetic sequence.
EDATRRLKKLLDDLKKEVDDSRRRNDELIKETERLIRESAKRNDKLLEDLKKRVDEIRK

SEQ ID NO: 7584 - protein, 60 aa, Artificial Sequence
  Synthetic sequence.
DEREEVEKRIRDLAEEVRRIVKRVEDETRRLVEEVKKSSDDSRRTIEKLARELKEITRRV

SEQ ID NO: 7585 - protein, 59 aa, Artificial Sequence
  Synthetic sequence.
KEAKDRLEDLLRRLREEVKRVKEKLKKLNDDLRREVEKSKEDNERLLKKLRDEVRKSAT

SEQ ID NO: 7586 - protein, 56 aa, Artificial Sequence
  Synthetic sequence.
DEVEKVLREIEKLIKEIREINKRINDRIEELIRRLRERVKKVSRESEELIRDLRRD

SEQ ID NO: 7587 - protein, 56 aa, Artificial Sequence
  Synthetic sequence.
ERKAREIIKRVEKVLEEVRRSLETSEKRVRDALREIEERLKENKRRVREVLEEIRK

SEQ ID NO: 7588 - protein, 61 aa, Artificial Sequence
  Synthetic sequence.
DEKEKLIKEVEDSTETVKRLVEELSRRSKKITEDVERLVKKLSDESKKILDEVRDLVRKRG

SEQ ID NO: 7589 - protein, 55 aa, Artificial Sequence
  Synthetic sequence.
EEADKLRKRSEDMVRRIEEHLKKNLKENKDALDKIRKELRENIETTKKTVDDIRK

SEQ ID NO: 7590 - protein, 61 aa, Artificial Sequence
  Synthetic sequence.
DEKDKLIEELDKILEDVRRRVEELSRRSKEITETVKELVKRLSDESERILREVDDVVRKRG

SEQ ID NO: 7591 - protein, 55 aa, Artificial Sequence
  Synthetic sequence.
EKAREVRRKVKETVERIEEELRRNIEENREMVERVEREARKNIKDTRKRVEEIRK

SEQ ID NO: 7592 - protein, 60 aa, Artificial Sequence
  Synthetic sequence.
RVEEKLEKIKRDIEKLVEDMKESNTRSKRKLEKLVEEMRRNNEELTRRVEELVKKIEDDV

SEQ ID NO: 7593 - protein, 59 aa, Artificial Sequence
  Synthetic sequence.
EDLVRRLLEEIRRILEEVRRTDKELLDENERILREVEKLNRDLVKEIEEILKKVEDDVR

SEQ ID NO: 7594 - protein, 58 aa, Artificial Sequence
  Synthetic sequence.
SEVEKAIEEIEKVIKEVRDKNRRVLEESKKLIRTVEETNKRNIEEIEKWIKTLDELTD

SEQ ID NO: 7595 - protein, 59 aa, Artificial Sequence
  Synthetic sequence.
EDAAKKAKEIIDKLRTLVEEVKRTNDKSLRDTREVVRRVEETLRRVEEKVKKRVDEIRK

SEQ ID NO: 7596 - protein, 58 aa, Artificial Sequence
  Synthetic sequence.
SEVEEVIRRIEEVLKELRRKNEEVLRESERANDEVRRVNEKNIRDIKKWLEDVKREVD

SEQ ID NO: 7597 - protein, 59 aa, Artificial Sequence
  Synthetic sequence.
EDARRRAEELERRVDKVVREVEKTNKESEEESKKLVDDVRRTLREITERVKDAVEKTLR

SEQ ID NO: 7598 - protein, 60 aa, Artificial Sequence
  Synthetic sequence.
SRDEEVARRVERVLEESEKLSKEVAEENEKVLREAREILEDVRKKVEDVARTLRELAKKV

SEQ ID NO: 7599 - protein, 59 aa, Artificial Sequence
  Synthetic sequence.
EEAKRRLEDLRRKLEELVKRNEKKLRDLDERLKELVERIERAAEKLLRDLRDLVRKITK

SEQ ID NO: 7600 - protein, 60 aa, Artificial Sequence
  Synthetic sequence.
RELEKVEKEVEDVLRDIERSSDEVRRENKRVAREMEESSRKVAEDVERVLRTLEELAKKV

SEQ ID NO: 7601 - protein, 59 aa, Artificial Sequence
  Synthetic sequence.
EEAKKRAEELVRRLEELLERNRETLERLDKELKDLVEKNKRTAEKLVKELEELVERIRK

SEQ ID NO: 7602 - protein, 60 aa, Artificial Sequence
  Synthetic sequence.
DELERVRREVKRLADESEKVSREVEERVRDTNRKSEEISRRVEKLARELLKKVEEVERRS

SEQ ID NO: 7603 - protein, 59 aa, Artificial Sequence
  Synthetic sequence.
EDLKRTLDELRKTIEKLVKDNRETLERLIRESEETIKRNREKLEELKRRLETLLRRVRK

SEQ ID NO: 7604 - protein, 60 aa, Artificial Sequence
  Synthetic sequence.
DELEDVRRRVDELVEELERVSRRVAELVKRIIDESRDISRRVARRVEELLRRLREVTKRS

SEQ ID NO: 7605 - protein, 59 aa, Artificial Sequence
  Synthetic sequence.
DELRKRLEDLKRKIERLLEDNRRKLEELIRRAEKVVEENERTMRKLKEDAKRLLEEIRK

SEQ ID NO: 7606 - protein, 59 aa, Artificial Sequence
  Synthetic sequence.
SVEDLVREVEERVRKVEKDLRELLDRLRRENEDAVRRSRESLRRNEEENKRVVDELRKD

SEQ ID NO: 7607 - protein, 55 aa, Artificial Sequence
  Synthetic sequence.
EEVVKKVREVLERVKETVKRVVDRNREVVKRLEDENRKVSEENKRVVEKVKEDAR

SEQ ID NO: 7608 - protein, 59 aa, Artificial Sequence
  Synthetic sequence.
SVEELVRRIAEKLRKVLDEIERLVDELRKENEEVVRDIERLVEDNEREVRDVLRKLEKD

SEQ ID NO: 7609 - protein, 55 aa, Artificial Sequence
  Synthetic sequence.
EDLVRDAERVLKRVTDEVRRVVKENKDVVRKVREEVERVSEENKRVLEKVTRDTK

SEQ ID NO: 7610 - protein, 60 aa, Artificial Sequence
  Synthetic sequence.
DEVETLKREVERLNKEVLDRVRKVIKEIKELDDRVRRENERVIREVERLIEEVRDRVRKN

SEQ ID NO: 7611 - protein, 59 aa, Artificial Sequence
  Synthetic sequence.
RRAEKIVKELREHSDEVVREMRELVERSKRHSTKVVEELKKSNKELEEKVRKVVRELEK

SEQ ID NO: 7612 - protein, 60 aa, Artificial Sequence
  Synthetic sequence.
SEVEELRERIKELNKRVLDTVRRVLERVKELNEEVDRRNKEVIKEVERLLEEVKREVTRE

SEQ ID NO: 7613 - protein, 59 aa, Artificial Sequence
  Synthetic sequence.
RRAEKIVDDIRRHSEDVVRRMRKLVEDSRRHSKRVVEEMERSNRELEERVKRVVEELKR

SEQ ID NO: 7614 - protein, 60 aa, Artificial Sequence
  Synthetic sequence.
SEVEELIKEIRRLNEEVRRRNKKVIEEVKKLNEDVKRKNDKVIEDVERLLREVKKRVEDE

SEQ ID NO: 7615 - protein, 59 aa, Artificial Sequence
  Synthetic sequence.
RRVEEIVRTIEKHSRDVVREMERSNDESEKHSRKVVREMEKSNKELKKKVEKIVRDLEK

SEQ ID NO: 7616 - protein, 60 aa, Artificial Sequence
  Synthetic sequence.
SEVEKLKREVERLNEEVLRRVRKVIEDSKRLNEEVRKRNEDVLKELKDLIREVKRRVEEE

SEQ ID NO: 7617 - protein, 59 aa, Artificial Sequence
  Synthetic sequence.
DRMRKIVEDLRRHSEEVVREAEDLVRRSEEDSRRVAREMEKSNEEIEKEARDVVRELER

SEQ ID NO: 7618 - protein, 60 aa, Artificial Sequence
  Synthetic sequence.
SEVERVVKEAEDLSRENNKRVKEVVRRAEDTNRRVEDENRKLLKEIKDLLREVKETVKRI

SEQ ID NO: 7619 - protein, 59 aa, Artificial Sequence
  Synthetic sequence.
ERVRRLLEEVLRRVAEDVRRSEEELDKVLRDSAESLKRSDKSLRDIVREVEKVLDEIRK

SEQ ID NO: 7620 - protein, 57 aa, Artificial Sequence
  Synthetic sequence.
SAEDLLRKLREDVERVMRELRKSNEESRKRVEEVVEEAERILKESRERSEELVRRLN

SEQ ID NO: 7621 - protein, 59 aa, Artificial Sequence
  Synthetic sequence.
EEVLRKLAEDVKRVLDKVKEENKRLLEENDRMLEEVRRLLKKLLEESEKVLEEVERKAR

SEQ ID NO: 7622 - protein, 59 aa, Artificial Sequence
  Synthetic sequence.
DLREEIRKLREDAKRVIDESRKSVKENEKRNKKLLDESEKSVRENEERNKELIKRVKDR

SEQ ID NO: 7623 - protein, 59 aa, Artificial Sequence
  Synthetic sequence.
REVLRKVKEELRRVLEKLRRLNEEASRENERILRELRKKNRDMNEDNRRILEELDEKAR

SEQ ID NO: 7624 - protein, 59 aa, Artificial Sequence
  Synthetic sequence.
DMEREVEKLERELRELIKRIRKIVDENRRRNEELLERSRESVRRNEEENRKLLEEVKKS

SEQ ID NO: 7625 - protein, 59 aa, Artificial Sequence
  Synthetic sequence.
EKVLREVKEEVRKLLEEIEKTVRDVSRENKRILDELRKKNKRADEENREILKKLREDVR

SEQ ID NO: 7626 - protein, 59 aa, Artificial Sequence
  Synthetic sequence.
SMEEEIRRLEEDVRRLVDKSRKSVKENEERNRKLLEESKESVRDNARRNEKLIRDVRRK

SEQ ID NO: 7627 - protein, 59 aa, Artificial Sequence
  Synthetic sequence.
REMLEEVLRRLEDALRRLEEENKRVSEDNERILEELRRKNEEADKRNRDILDDLRRRAD

SEQ ID NO: 7628 - protein, 59 aa, Artificial Sequence
  Synthetic sequence.
DMEDKVRKLERDVRELIKEVEKIVRDNADENRRVVEESEKSVRELADRARRLIDEIRKG

SEQ ID NO: 7629 - protein, 59 aa, Artificial Sequence
  Synthetic sequence.
EDVLREVKERVEEVLDRVRKKVEKVSRENKEIVKEVRKKNEDAVREAEELLKKIREEVR

SEQ ID NO: 7630 - protein, 60 aa, Artificial Sequence
  Synthetic sequence.
DEVEEVVRRIEELIKEVEDVDRDIERRVKELDEELRRVDDEIRRRAKKLLDDLEKRVREI

SEQ ID NO: 7631 - protein, 59 aa, Artificial Sequence
  Synthetic sequence.
ERVRRILTELRKRVEKVVRDSEKTLRESVERSARLLKESKESLEELERRAREVVERIKK

SEQ ID NO: 7632 - protein, 60 aa, Artificial Sequence
  Synthetic sequence.
DELEEAEKKVRDLIRRLREMNERALRESERLIRRLREVDEEIVRRIEDLLKKLREEVERE

SEQ ID NO: 7633 - protein, 59 aa, Artificial Sequence
  Synthetic sequence.
REVRKTLKDLEDTVKRVLEESEESARESEKRSRDVLRESERSLRELEKKVRKLLEEVKK

SEQ ID NO: 7634 - protein, 61 aa, Artificial Sequence
  Synthetic sequence.
SDVDKVAKEIDDALKDVRRKVDKVRKDNERVNREVEERVRRVTERNRDVIEEVKRRVEEVK

SEQ ID NO: 7635 - protein, 56 aa, Artificial Sequence
  Synthetic sequence.
SELVREIERRLEELVKELRKILDELRKRNEDTRRRLEEALKRNREEAERLEREIRK

SEQ ID NO: 7636 - protein, 60 aa, Artificial Sequence
  Synthetic sequence.
KDVDEIATELDEVIDRIRKKVKEVVERDEKVNRDVNDEVDKLTERNRRVLDKVLKDVTRR

SEQ ID NO: 7637 - protein, 56 aa, Artificial Sequence
  Synthetic sequence.
DRLVDELRKRVEDAKREIREILEKLKRDNDESKKRLERLLKENEDALREILERLRK

SEQ ID NO: 7638 - protein, 61 aa, Artificial Sequence
  Synthetic sequence.
DDVEKAVREVEEMLKRVDKEVERVSRENKRVSDEVRKKVKEVERKIKEVLDRIKDEVDRVK

SEQ ID NO: 7639 - protein, 56 aa, Artificial Sequence
  Synthetic sequence.
DELVKRLEDKMRRVKEKLKRLLEKNREDSERSERELREILKKITREVEELAKELEK

SEQ ID NO: 7640 - protein, 56 aa, Artificial Sequence
  Synthetic sequence.
EEVKKLLEEVRDLLRRVLEEVERSSDEDRKLNERVNEAIEKSIREVEELLRRIDRE

SEQ ID NO: 7641 - protein, 56 aa, Artificial Sequence
  Synthetic sequence.
EELVEELKRRVDEVKRRAEEINRENDERNKESKRRLEELNERLEERVRRLEEKLKK

SEQ ID NO: 7642 - protein, 57 aa, Artificial Sequence
  Synthetic sequence.
DEVEDLRRRVEKILEDVKRTVETASKRDRELNEEVNRLLRESVERVDRLLDRIRREA

SEQ ID NO: 7643 - protein, 56 aa, Artificial Sequence
  Synthetic sequence.
KEIVDRLRKAVEEVSREARKILDENRRRNEESEKRMREINKRLEDKVREVKKELEK

SEQ ID NO: 7644 - protein, 57 aa, Artificial Sequence
  Synthetic sequence.
REVDKLREDVRRLLEELLRALRESSKEDEKLNRKVNREVDRVLKEVDDLLEDIKKRV

SEQ ID NO: 7645 - protein, 56 aa, Artificial Sequence
  Synthetic sequence.
EEIVKRLEEEVREIVKEIKEINDKNRKKNEDSARKADEKVKELEERVRRVVKELRD

SEQ ID NO: 7646 - protein, 56 aa, Artificial Sequence
  Synthetic sequence.
KEVEDLVRRVEKLLRDIDRELKRSSDEDRELNERVNREVDRVLREVDRLLKEIRET

SEQ ID NO: 7647 - protein, 56 aa, Artificial Sequence
  Synthetic sequence.
ERIVRTLEKRIRDLVRKAEEIDRENEKRNKESSDRMERLVRELRKRVKRLVEELER

SEQ ID NO: 7648 - protein, 56 aa, Artificial Sequence
  Synthetic sequence.
DEMRRLLREVERILEEVERVLEKSVRDDERVNREVNRRLDEVLRRVEDLLRRIEKE

SEQ ID NO: 7649 - protein, 56 aa, Artificial Sequence
  Synthetic sequence.
ERLLERVRREVEKVRERADRIDKRLEDTNRRSKDRAEELVRELEKRVEDLKEKAEK

SEQ ID NO: 7650 - protein, 56 aa, Artificial Sequence
  Synthetic sequence.
DEVRKLEEEVDRILREVKEMVEDSIRRHKEVNDEIRRRVERVLEEVKTLLDLIREK

SEQ ID NO: 7651 - protein, 56 aa, Artificial Sequence
  Synthetic sequence.
KEIVDELRKRVEDVSREAKKLDDDLRENVKRLSEEMKKLVDDLRREVDRLEKERRK

SEQ ID NO: 7652 - protein, 57 aa, Artificial Sequence
  Synthetic sequence.
DEVEELRRKVEEILRRIREDVRKSIEDHRDVNRRVLEAVRRSTKRNKDVVDRLRDED

SEQ ID NO: 7653 - protein, 56 aa, Artificial Sequence
  Synthetic sequence.
ERIVKRLEDEVRKLVDEMRKLDEELTRNVDEVRREAERLDKENRDENRKLKEELKK

SEQ ID NO: 7654 - protein, 60 aa, Artificial Sequence
  Synthetic sequence.
SEMEKVVTDAKELLERLDRELERVIRESDKILDELRRKIEEVIKRSDELLEELDRRIKEN

SEQ ID NO: 7655 - protein, 56 aa, Artificial Sequence
  Synthetic sequence.
EELIERVRRLVEELIEKAKKLLEESERKSARLIEDLERLLEESRRKSDKLIKKARK

SEQ ID NO: 7656 - protein, 60 aa, Artificial Sequence
  Synthetic sequence.
DEVEEIRKEIEDILRRLRDLLRRVIEDSRRLLDELRERNERVIKESEDLLRDLEDKIRKR

SEQ ID NO: 7657 - protein, 56 aa, Artificial Sequence
  Synthetic sequence.
KEIVDRLRDEVRKLEEEAKELLRESNELTRELIDRLEKLNRDSNRKSRELIERLRK

SEQ ID NO: 7658 - protein, 60 aa, Artificial Sequence
  Synthetic sequence.
SELEEVEERIKKELDRLEKKMEESIKRDKEINRELNEMLKKSIKDSDDILRELRKEIEDD

SEQ ID NO: 7659 - protein, 59 aa, Artificial Sequence
  Synthetic sequence.
KRAEEIVKKLEKEVEDLVRKAKKLVDELRKENEESKKRARELLRRSEEKVKKLVREAEK

SEQ ID NO: 7660 - protein, 56 aa, Artificial Sequence
  Synthetic sequence.
DSEELVRTVKKELEDIIRESRKLVEDVARALEKIEKEIEEIVRTTDKELRKLIEEA

SEQ ID NO: 7661 - protein, 55 aa, Artificial Sequence
  Synthetic sequence.
EEVVKKVKDLLRELEKHNRTVLEEVKKALDELRRRLEEVHRRSKETLDRIRRDAT

SEQ ID NO: 7662 - protein, 56 aa, Artificial Sequence
  Synthetic sequence.
REDELVDTVRKRLKELIEESERLLEEVKKKLEEIKRRVEKILRETEKELRDIIRKN

SEQ ID NO: 7663 - protein, 55 aa, Artificial Sequence
  Synthetic sequence.
DKVLEKVRKVLEDLKRENKEVVERVDRVLEDAKRKLEKVHKDSRDALKKLDEDAK

SEQ ID NO: 7664 - protein, 56 aa, Artificial Sequence
  Synthetic sequence.
SEKELLDRVKEKLKKIIDDVEEILRRSKKELEKIIRESEKLVEEVKRDLRRLIEEN

SEQ ID NO: 7665 - protein, 55 aa, Artificial Sequence
  Synthetic sequence.
EKVVEEVERVLEKLLRDVERVHRRTKEVLDELRKENKKVVEDVRDVLEKARERAR

SEQ ID NO: 7666 - protein, 60 aa, Artificial Sequence
  Synthetic sequence.
EEVEDVARKIEKLLEDVRRIDKEISDRNRELLKEVRKIDEKILREIEKLLEELRDTATKD

SEQ ID NO: 7667 - protein, 55 aa, Artificial Sequence
  Synthetic sequence.
EEAERIKRELDRIRKESEETVKENEERLRRIKEESRRSVERARTELKRIEDEVRK

SEQ ID NO: 7668 - protein, 60 aa, Artificial Sequence
  Synthetic sequence.
KVEDELRKLREEVRRSKEEVEKKVKELDEEVKRSKRESEKKLRDLREEVKRLEDDAERSN

SEQ ID NO: 7669 - protein, 59 aa, Artificial Sequence
  Synthetic sequence.
EKFLEEVRERVRKLLDENHKILKEAERRVEELLRRNHKILKEALDRVRKLLKELRDRTR

SEQ ID NO: 7670 - protein, 60 aa, Artificial Sequence
  Synthetic sequence.
SIEEILRELREHVKENMERSEEIVRDLTRKVDESTRDSERILEKLKKDVDKLEEDAKRAN

SEQ ID NO: 7671 - protein, 62 aa, Artificial Sequence
  Synthetic sequence.
EEAEELLREVRERVERVSRRNEELLKRVERDVERVLRENHELLKRVAEEVERVLKEVRERTK

SEQ ID NO: 7672 - protein, 60 aa, Artificial Sequence
  Synthetic sequence.
SIEEILEKLRREVEESEKDSRRSAEELRKHVRENEKRSEDIVRKLTEDVERLERKARSRN

SEQ ID NO: 7673 - protein, 62 aa, Artificial Sequence
  Synthetic sequence.
EEAKELVREVAERVEDVLRKNHEINKTNAEAVKKWSEDNRKLLEDVRREVERVLKELEKEMT

SEQ ID NO: 7674 - protein, 59 aa, Artificial Sequence
  Synthetic sequence.
DEVRKLVEELRKINEDDKRRSDKNFDDNRKLAEDVKRVLERNVEENRKMAKRLEEVLRN

SEQ ID NO: 7675 - protein, 55 aa, Artificial Sequence
  Synthetic sequence.
EKLLKEAEERIRRNAEENRKLLERSKKALEEVERRARKLLEESRRALEELKKRAD

SEQ ID NO: 7676 - protein, 59 aa, Artificial Sequence
  Synthetic sequence.
DEVRELVKELRELNKRDKKRSKELRDKLEEANREDEEKTRKNKEDNERMAREVERVLRD

SEQ ID NO: 7677 - protein, 55 aa, Artificial Sequence
  Synthetic sequence.
ERLLKEAEELIRRNEEENRRILREVEERIKKNEDDNRRVLKRSREELERVEREAR

SEQ ID NO: 7678 - protein, 59 aa, Artificial Sequence
  Synthetic sequence.
DEVDKLRKELEDANARDREKSKENKDENDKALKELEEVLEKLKRELEEIVRRVKEVLDK

SEQ ID NO: 7679 - protein, 55 aa, Artificial Sequence
  Synthetic sequence.
EEILKKIEKEIRTNREENERLLKESEDELKRLEDEMREILERIKRLIEEVEERAR

SEQ ID NO: 7680 - protein, 59 aa, Artificial Sequence
  Synthetic sequence.
DEVRELVKELERINKEDRDKSRENFKRNADIAKEVEDNLERNEEENRKVEEEVRKVLRD

SEQ ID NO: 7681 - protein, 55 aa, Artificial Sequence
  Synthetic sequence.
EDLLRDAKRKIDENKEENERLLKESRKLLERVRKRAEELLRKSRKALEDLKEEAK

SEQ ID NO: 7682 - protein, 59 aa, Artificial Sequence
  Synthetic sequence.
SEVDKLEKEVRDANERDRRNSERNRKENEEMLRRVERVLRELKKKLEEAIRRARKVLDD

SEQ ID NO: 7683 - protein, 55 aa, Artificial Sequence
  Synthetic sequence.
ERILERIEELIRDNAKRNEDLLRRSKEMLDELRKKAKEILDRIRKLIKEVEDKAR

SEQ ID NO: 7684 - protein, 60 aa, Artificial Sequence
  Synthetic sequence.
DEVERVVEKLKTLIEEWKRLTEEIEKKNEELIRRIEKVLEDLFRENEKLARDIKREIDEL

SEQ ID NO: 7685 - protein, 55 aa, Artificial Sequence
  Synthetic sequence.
EELLRRIEEDIERLERTDREVLKRSEKKIRELRERAKELLKRSEEIIKKLEDEAR

SEQ ID NO: 7686 - protein, 60 aa, Artificial Sequence
  Synthetic sequence.
SKDDELKRKIDELIDRWRRLTEEIKKKNDELVKKWEKLTKEVTDHSRDLNRKIREELERL

SEQ ID NO: 7687 - protein, 55 aa, Artificial Sequence
  Synthetic sequence.
ERLLEEIEERIEKLERDDKKVLDDSRKKIDDLRKRDEEVIRRNRESIDRLRREAD

SEQ ID NO: 7688 - protein, 60 aa, Artificial Sequence
  Synthetic sequence.
DEVETVDDRVKKVIRKLEELLRELAKLNKDIVDDIRRRLKEVEERNRKLAEDIERLLEEG

SEQ ID NO: 7689 - protein, 55 aa, Artificial Sequence
  Synthetic sequence.
EDVIKKVRDEAERIRREVRRLDEESRKTVKRLLDEVRELNRRSEEELRELRRRIE

SEQ ID NO: 7690 - protein, 57 aa, Artificial Sequence
  Synthetic sequence.
SELEEVRERLRKLIEDLKRLNEESLKENREIIKALRELNERSLRENKELIKRLEDSN

SEQ ID NO: 7691 - protein, 58 aa, Artificial Sequence
  Synthetic sequence.
DEARTIIEEIKRRVDELRKHIEESIKEVKKLNDEVEKHIRESIKESEEDLKRLKDRID

SEQ ID NO: 7692 - protein, 60 aa, Artificial Sequence
  Synthetic sequence.
KDDEDVDEKIRRAIKKNEELSREIEDKIRRILKKHEDLTRDLAREIREVVRKLRELSKRG

SEQ ID NO: 7693 - protein, 55 aa, Artificial Sequence
  Synthetic sequence.
EELLRKVEELLRRLEEENRKILKEVDERLKDLEKKDRDLLEEAKKLLEDVERELR

SEQ ID NO: 7694 - protein, 60 aa, Artificial Sequence
  Synthetic sequence.
SELEKLIKELRDLVRESEERLRELVRKVKELIKRSEDEVERLLDRSRELAKELEEEIRRK

SEQ ID NO: 7695 - protein, 59 aa, Artificial Sequence
  Synthetic sequence.
REVLDKLKKDAKRVNDDSERIIKRADEEVKRVNEESKRMLEENEKMNRDLVRRIRERIK

SEQ ID NO: 7696 - protein, 56 aa, Artificial Sequence
  Synthetic sequence.
DLEEMLTEVERLARELEEESKKIRKEVERLARELEEESKEINKRIKDKADDLKEKL

SEQ ID NO: 7697 - protein, 59 aa, Artificial Sequence
  Synthetic sequence.
REIIKRLVDEVKKVIDELMKKNRKLLEDVERILTELSERNRDLARKVDKLIRDLEKRAR

SEQ ID NO: 7698 - protein, 60 aa, Artificial Sequence
  Synthetic sequence.
SKLEEVKERVKKLSKRNLDVAKRVLDEIDKLIKEDLKKTEDALRRIKELLDRLREMKRRG

SEQ ID NO: 7699 - protein, 59 aa, Artificial Sequence
  Synthetic sequence.
ERIRRIVKEVRELVRRNDEEVDKIVEEVKRLLERSSRENEKVVREVEELLKRLEEEARK

SEQ ID NO: 7700 - protein, 60 aa, Artificial Sequence
  Synthetic sequence.
DDVERLLKRVKELIDDDLRKTEKALREIEKLSRDNKKRTEDVLREIEERLRRLEEATRRG

SEQ ID NO: 7701 - protein, 59 aa, Artificial Sequence
  Synthetic sequence.
ERVRKIIRDVERLLEESTRRNEEAVKRVERLLEENKKRNEDVVREVEKELRRLREEARK

SEQ ID NO: 7702 - protein, 60 aa, Artificial Sequence
  Synthetic sequence.
SDIEKVLEDIRRLSKKNVDDSKRVLDEIRELSKRNLELVKEVLERIRRLLKKLEEARRRG

SEQ ID NO: 7703 - protein, 59 aa, Artificial Sequence
  Synthetic sequence.
ERIRKIVEDVKELLDRNREENERIVREVEKLLDENRKEVEKILREVERLLEELEKRERD

SEQ ID NO: 7704 - protein, 60 aa, Artificial Sequence
  Synthetic sequence.
KEVEDLLKRIRDLLKRVEETSREVLEEIKRLIDRDRKHSKEVLDEIKELLKRLIEAAKRG

SEQ ID NO: 7705 - protein, 59 aa, Artificial Sequence
  Synthetic sequence.
ERVRTIIREVEKLLKELEDKNDEIVRRVEELLRKSHEDNRRIAEEVREMLKRLEDEMRR

SEQ ID NO: 7706 - protein, 61 aa, Artificial Sequence
  Synthetic sequence.
SSLEKVEKDIRKLNDDSKKEAKRVTEENRKSNEDVERELRKIVEEVRRLIKDVEDKIRKDG

SEQ ID NO: 7707 - protein, 59 aa, Artificial Sequence
  Synthetic sequence.
ERVKRIVDELRKSLRKLEEDVKELIKENKESNDRLRERVERILKELRELLRELEEKVKT

SEQ ID NO: 7708 - protein, 61 aa, Artificial Sequence
  Synthetic sequence.
SEVERLVEEVRKSNKKWEEESRELTERNKKLNRETTKRAEDLLERVRELVRTVTEIIKREG

SEQ ID NO: 7709 - protein, 59 aa, Artificial Sequence
  Synthetic sequence.
ERLKRIVEEIRDSVRRLKEKSEELVRRNEESNDRLRRRVEEIAKEARDLVRRLEEEVRR

SEQ ID NO: 7710 - protein, 61 aa, Artificial Sequence
  Synthetic sequence.
SEAERVLEEVRRLNDKSKKTAEKLTEENKRLNKRTTDFLKEVLERIEELVRRVEDRIRKEG

SEQ ID NO: 7711 - protein, 59 aa, Artificial Sequence
  Synthetic sequence.
KRVKDIVREIRDSVRKLEEEVRKLIRENEKSNKDLRRRVRKIEEDIKRIIRELEERVRK

SEQ ID NO: 7712 - protein, 61 aa, Artificial Sequence
  Synthetic sequence.
SELEKILKDIEDLVRKWLEESKDLLRKLKKLNEDTTERLRRLLDELRKLIKDLLDKIRKDG

SEQ ID NO: 7713 - protein, 59 aa, Artificial Sequence
  Synthetic sequence.
KRVKDIVKKIEELVKKAKEESKKIVEEVRRSVKRLEEEVRKIEKDIKDLIDELRKKVTT

SEQ ID NO: 7714 - protein, 59 aa, Artificial Sequence
  Synthetic sequence.
SEVEDLRRELEEINKEWNKRTKDLVKEVEEVNRDINKKIRDLLREARRLVDEIRRLIEK

SEQ ID NO: 7715 - protein, 56 aa, Artificial Sequence
  Synthetic sequence.
EEVIKELRKLLEESERRAREMNKRLDRLLEESKKDVDRVREEIKRLVDEIEDRARK

SEQ ID NO: 7716 - protein, 59 aa, Artificial Sequence
  Synthetic sequence.
DEIEEVLKRLEEIVKTWDERTKRLTERVRTVNREVNERHKKLTRDLRELAREVLDLVRQ

SEQ ID NO: 7717 - protein, 56 aa, Artificial Sequence
  Synthetic sequence.
REMLRELEERIRTVEDKVRRVNEELRELLKTSNRRSEEIEKELEKILREIRERARK

SEQ ID NO: 7718 - protein, 59 aa, Artificial Sequence
  Synthetic sequence.
DEVRKVLEDLRKIVREWEERTERLLRDLKRINEEINRRVEKLTEELRRLVKEIKKLTDD

SEQ ID NO: 7719 - protein, 56 aa, Artificial Sequence
  Synthetic sequence.
EDVLREADKIIEDVEREARRVNKELKDLLDESAERIERIIREIERLVEKIKRDADR

SEQ ID NO: 7720 - protein, 59 aa, Artificial Sequence
  Synthetic sequence.
SEIEKVLDELREINRRINETAKEILRRLKEINERTKKEIDRLLDELRKLLRRVEELRKE

SEQ ID NO: 7721 - protein, 56 aa, Artificial Sequence
  Synthetic sequence.
EEALKDLERLLRESEKRIREIIKRIRESVEKLERDVRRVIDEIRRRLEEIERRLRK

SEQ ID NO: 7722 - protein, 55 aa, Artificial Sequence
  Synthetic sequence.
KEVEEALEELRRILREWEEVTKRLEERVEEINRRSLEELRRLKEEVEEIAKRIRD

SEQ ID NO: 7723 - protein, 56 aa, Artificial Sequence
  Synthetic sequence.
KEVLEELDKLVKDIKRKVDEVNEKWKESSKRLEDEHRKVIKELEELVKRVEEELRR

SEQ ID NO: 7724 - protein, 55 aa, Artificial Sequence
  Synthetic sequence.
KEVEDALKKAEDILRRWEEVTKKLKDEARKINEDSRRKLKRLKEESREIVERIKK

SEQ ID NO: 7725 - protein, 56 aa, Artificial Sequence
  Synthetic sequence.
EEVLRRLEKLVEDIKRKVAKVNDEWRKSSEDLEREHRKVHRESEKLIRDVEDRLRK

SEQ ID NO: 7726 - protein, 55 aa, Artificial Sequence
  Synthetic sequence.
SEVEEVRREVKRVVDDWRRVTKKLLDDIRRISEESKKIIRDLKEAAKTMIREVER

SEQ ID NO: 7727 - protein, 56 aa, Artificial Sequence
  Synthetic sequence.
EEVLKELEKLLEDLRREVEEVNERLKRLLDENEKRIREVLRELKKLLRDLDEKLRR

SEQ ID NO: 7728 - protein, 60 aa, Artificial Sequence
  Synthetic sequence.
DELERVREEVKKLSDTSREKLERALKKARDLLEENERRLRELKKEVEELIRRIEEKLKDR

SEQ ID NO: 7729 - protein, 59 aa, Artificial Sequence
  Synthetic sequence.
EELRKVLTDIERLLRENKKELDEVLKEVEKLSREADDKNRKVLKEIKELLDELKKRAKD

SEQ ID NO: 7730 - protein, 60 aa, Artificial Sequence
  Synthetic sequence.
SEVERMLEEVERISEESKRKLEEVLRRVEEIIKAIERTLEKVLKDDEEIIRRIEDTLRRR

SEQ ID NO: 7731 - protein, 56 aa, Artificial Sequence
  Synthetic sequence.
REVVKTIDDLLRENERRVDEALEEIEKRARDLREKVKELEERLDRTNRKLKKKVED

SEQ ID NO: 7732 - protein, 57 aa, Artificial Sequence
  Synthetic sequence.
KEVEDIIEESRKLDKELEDEIRRIIEESRRLNEELEEIARRIDEEIKELLERLKRRD

SEQ ID NO: 7733 - protein, 59 aa, Artificial Sequence
  Synthetic sequence.
KEDVERLVRSNREVARDVREKLKRLLEHNKEVVDRVREELKRLLDEARRVIEEVRKKAD

SEQ ID NO: 7734 - protein, 60 aa, Artificial Sequence
  Synthetic sequence.
DELERIDEKIKRDVEEHKRETKRILDESERLNREVKKRLEEIRERIRRLAEEIRKEIERD

SEQ ID NO: 7735 - protein, 59 aa, Artificial Sequence
  Synthetic sequence.
ERKLEKVMEDVKRLIDEARKENEDVARRMERSNKELKRKLDEIRREVEELIKELRERTK

SEQ ID NO: 7736 - protein, 60 aa, Artificial Sequence
  Synthetic sequence.
DDLERAREEVADLIRKHEEKTRRILEESRRLNERHRELSKRILDEIRKLAERIEELIKRE

SEQ ID NO: 7737 - protein, 59 aa, Artificial Sequence
  Synthetic sequence.
KEELDRIEEELKRLIDTLREKNREVEKRARDSNRDLKRTNDEIAKEVRELIKKLREDLK

SEQ ID NO: 7738 - protein, 60 aa, Artificial Sequence
  Synthetic sequence.
RELETIADRIRKLSRENSEVLKEIARRIERLVEEHRKESERILKEIKELADDITRLIRED

SEQ ID NO: 7739 - protein, 59 aa, Artificial Sequence
  Synthetic sequence.
KEELDKVEEEVRRLIRTNREILRTIEKRVRDLIEELKRRNDEIARRVEELIKRLRRETD

SEQ ID NO: 7740 - protein, 60 aa, Artificial Sequence
  Synthetic sequence.
SELEKVADELRKLIKDDNDLLDEILDRIRKLSKENEKRLREILKEIRKLMDEISKLIKKD

SEQ ID NO: 7741 - protein, 59 aa, Artificial Sequence
  Synthetic sequence.
KEELDKIREELERLIKRNKEKLDEIRREVDELIKKNEETLKRIEEEVRKLIEDLKEELR

SEQ ID NO: 7742 - protein, 60 aa, Artificial Sequence
  Synthetic sequence.
SDLEKIEKEIEDLVKRDNEVDKKVMREIRELSKENKERLRKILEDLRREAKKIKDDIERE

SEQ ID NO: 7743 - protein, 59 aa, Artificial Sequence
  Synthetic sequence.
KEKLKRVEKKVRELIKRNRDHNERTREDVEKLIRDNEDTLRRIEEEIERLIEKLKRDTK

SEQ ID NO: 7744 - protein, 57 aa, Artificial Sequence
  Synthetic sequence.
KEVEDAVKELEDLLRKNEDKTRKIVEDMRRSNKDLEDHSRKSEEEVRKLLDDLRRAG

SEQ ID NO: 7745 - protein, 56 aa, Artificial Sequence
  Synthetic sequence.
IKTLLDRVRKLAEEDNERLDRLRRESEELNERVRRVDKKLLEEIRRKAKKVEDDTR

SEQ ID NO: 7746 - protein, 57 aa, Artificial Sequence
  Synthetic sequence.
DEVREVDRRLKELLRRLKETIDEIRRRMEESNRRLEDHSRKSEEEARKLLEELERKG

SEQ ID NO: 7747 - protein, 56 aa, Artificial Sequence
  Synthetic sequence.
LEELLRRLEELAERAERKLEKALRDSEDLNRKVTEVDRRLLKEIRDLVEKVERERR

SEQ ID NO: 7748 - protein, 57 aa, Artificial Sequence
  Synthetic sequence.
SEDEKVRKEAEDLLRELEKHSRDTERRARKSNRDNNEHSKESVKDLRRLLERLRKAG

SEQ ID NO: 7749 - protein, 56 aa, Artificial Sequence
  Synthetic sequence.
IRKLLEEVRKLVDDLRKRDEEIMKTSERLNEEDNRKDRRLVEDVKRLADEVEKKTR

SEQ ID NO: 7750 - protein, 57 aa, Artificial Sequence
  Synthetic sequence.
SKVDDVKRRIRKLLEDSKKRSRESIERVERSNRRLEKHSRDSARRAKELLDKLREEG

SEQ ID NO: 7751 - protein, 56 aa, Artificial Sequence
  Synthetic sequence.
IDELLERLKELAKRIKELDDRLLRELEEINKTTEKLDRDLLKEIKERIDELRKREK

SEQ ID NO: 7752 - protein, 57 aa, Artificial Sequence
  Synthetic sequence.
DKVERVKKEVRDLLRRLEKHSEDSVREIDTSNKRLEEHSRRSKEELKRLLRKLKEAG

SEQ ID NO: 7753 - protein, 56 aa, Artificial Sequence
  Synthetic sequence.
IDRVLEEVRKIIRRIEEEDRRLLKEIRDINETTERLDRKLLDELRKVVKDIEDRER

SEQ ID NO: 7754 - protein, 60 aa, Artificial Sequence
  Synthetic sequence.
SELEEVKKKVEKLIRDVEKVSEDTRREVERLIREVEEATKEHLDRVRRLIEELREVRKAG

SEQ ID NO: 7755 - protein, 62 aa, Artificial Sequence
  Synthetic sequence.
DRLRERLERLAKEIEDLLRRLREISRTIEERARRLLEELKKRSEDLRKTAEELLKEIDEELK

SEQ ID NO: 7756 - protein, 57 aa, Artificial Sequence
  Synthetic sequence.
DEVETIKKKAEDLLRDSKRKTDELTKRMEELLERSKEDSERLIRRLRELLERLRRRG

SEQ ID NO: 7757 - protein, 56 aa, Artificial Sequence
  Synthetic sequence.
EEDVDREVKRLVDESKKIIERVEEDVKRLIRESEKKSRDVERRVEELERKAREDER

SEQ ID NO: 7758 - protein, 56 aa, Artificial Sequence
  Synthetic sequence.
SEVEKIKREMEKLLEEHKKLVDDIRREAERLHEEHRRLSDKIREDLKRLLEELRRS

SEQ ID NO: 7759 - protein, 59 aa, Artificial Sequence
  Synthetic sequence.
RKELDRLRREVEKVVRELKERNKELLKRLEEAVEELKRRNRKLLEDARRVVEEIKERAR

SEQ ID NO: 7760 - protein, 56 aa, Artificial Sequence
  Synthetic sequence.
STVERIDEELKRLHTEHKKLSDDIKREAERLHEEHRRLSEEIRERLERLLEELRRR

SEQ ID NO: 7761 - protein, 59 aa, Artificial Sequence
  Synthetic sequence.
EEDLDKILRDLERTAKELKDRNRRLLEEVERVVRELKRRNKELLKTVERVAREIERRAE

SEQ ID NO: 7762 - protein, 56 aa, Artificial Sequence
  Synthetic sequence.
REVEEIDKELRRLHEEHRRLVEDIRRKLKKLHDEHRRLSEEIKRRLEELIRKLRED

SEQ ID NO: 7763 - protein, 59 aa, Artificial Sequence
  Synthetic sequence.
REELTKLLEEVKRVVDRLKEENKRLLKEVKEVAERLKRENERLLEELRRVAEEVRERTR

SEQ ID NO: 7764 - protein, 56 aa, Artificial Sequence
  Synthetic sequence.
KEVEEIREEAKRLHEEHRRLSKRIDDELKRLHDEHKRLSDEIRKELERLIEELKKG

SEQ ID NO: 7765 - protein, 59 aa, Artificial Sequence
  Synthetic sequence.
RDKARKLLEEVRRMVKRLKEENKRLLEEVRKVVEDLKRRNKELLEKLKREAERVKEEAK

SEQ ID NO: 7766 - protein, 56 aa, Artificial Sequence
  Synthetic sequence.
SEVDEIRKRLEDLHREHRELSREIEERLKKLHDEHRRLVEEIIRRARELLEDLRRE

SEQ ID NO: 7767 - protein, 59 aa, Artificial Sequence
  Synthetic sequence.
RDKVERLLREVKKVVDKLKKDNEKLLRDLKRVVDELKEKNKRLLEEVKRVVDDIRRRAK

SEQ ID NO: 7768 - protein, 60 aa, Artificial Sequence
  Synthetic sequence.
DEVREVERKIDKLAKDLKDELRRLLKEYEELVERLEELLERILRESEKLAEELKEELKRR

SEQ ID NO: 7769 - protein, 55 aa, Artificial Sequence
  Synthetic sequence.
DKVRKRIEELVKELKDILEEIKRRVEELDERSKRILKEIADRNRKLVDELRKTLE

SEQ ID NO: 7770 - protein, 60 aa, Artificial Sequence
  Synthetic sequence.
SEVEKALEDVRRLVEELKKELKEILERYKRLVDKLKKENREDHERSKELAERLKDLLRKS

SEQ ID NO: 7771 - protein, 55 aa, Artificial Sequence
  Synthetic sequence.
EKVRDTLRKLLEELDDLVRRIKTTLRKLVEESRRSLRKNEEDNRKLVEELREEAR

SEQ ID NO: 7772 - protein, 60 aa, Artificial Sequence
  Synthetic sequence.
DEVREVLREAREVVKRLKDRLRRILEESRRVVDELRDKNRKDHETYRKVVEELKKRLEER

SEQ ID NO: 7773 - protein, 55 aa, Artificial Sequence
  Synthetic sequence.
EEVRKDIERLFKELEDILKEIKEDNRRLVEDIKRSLEKNKRDLEKLVKESEDEER

SEQ ID NO: 7774 - protein, 60 aa, Artificial Sequence
  Synthetic sequence.
DEVRKVLEDARRLVEKLERDLEKVLEDYKRLVDELKERNERSHRESRRLAEELKKELERE

SEQ ID NO: 7775 - protein, 55 aa, Artificial Sequence
  Synthetic sequence.
DEVKERIDRLVKRLEDLARRIKEELDKLVKESRESLERNKTEVKKLIRELEETVR

SEQ ID NO: 7776 - protein, 60 aa, Artificial Sequence
  Synthetic sequence.
SEVEDVLTKIEDVVRKLEEENKRSHDESRKLADELKKENKEDHDRYRKEVERLKKELEER

SEQ ID NO: 7777 - protein, 55 aa, Artificial Sequence
  Synthetic sequence.
DKVRKRVEELVKEIEKSARDNEEAVKRLAEELRDSARRNKEELEKLVKESDDELK

SEQ ID NO: 7778 - protein, 56 aa, Artificial Sequence
  Synthetic sequence.
RETEEIEKEIRRLVKELRELNDEVEDRVRKLIKELKELNDRSERTLRELADELRRS

SEQ ID NO: 7779 - protein, 59 aa, Artificial Sequence
  Synthetic sequence.
DDVVRKVLERAERLVREDKKHTKEVLERIKELVDRDKKHTRDVNEEVKRLVEEIKKKTK

SEQ ID NO: 7780 - protein, 56 aa, Artificial Sequence
  Synthetic sequence.
SEIEEIEKRIEDLARELKELNKEVEERVKKLIEDLRRLNEESRESTDRLMDELRKA

SEQ ID NO: 7781 - protein, 59 aa, Artificial Sequence
  Synthetic sequence.
DEVVRRVLEEIERLVRRDKEHTERVLRTIEKLVREDEEHTKRVNEEIRKLAKEIEERAR

SEQ ID NO: 7782 - protein, 56 aa, Artificial Sequence
  Synthetic sequence.
REIEELRKEIETLIRENEELNRRSKETSEELIRRLKKLNRDVEEEVRRLVKDLRDR

SEQ ID NO: 7783 - protein, 59 aa, Artificial Sequence
  Synthetic sequence.
DEVVRRVAEEARRLSKRNKDAIREVNETSRRLATRDAKHTRDVLREIKRLADEIRERTR

SEQ ID NO: 7784 - protein, 56 aa, Artificial Sequence
  Synthetic sequence.
SEIEKAEEDVKRLIKENEELNRRSEETSRKLVEENERLNKEVEDRVRKLIKELEDN

SEQ ID NO: 7785 - protein, 59 aa, Artificial Sequence
  Synthetic sequence.
DDVVRRILKRIEDLSRKNKRDIEEVNKESERLSRENKKKIKDVLEEIRRLVERIEREVR

SEQ ID NO: 7786 - protein, 60 aa, Artificial Sequence
  Synthetic sequence.
SEIEKVLEDLRRLADRHRKRVEEILREAEDSNRKTKKKHREVEKEVKELADKLKDEIRRD

SEQ ID NO: 7787 - protein, 58 aa, Artificial Sequence
  Synthetic sequence.
RRLDEVEKDLRRLIRELKRLNEEVEKRVRDLIKENEELNKRIHDDLRRLIKELEDETR

SEQ ID NO: 7788 - protein, 60 aa, Artificial Sequence
  Synthetic sequence.
SDIEKVLDDLRKLAEEIERAHEEVAREVRELSKRNKEVIKDILRRAKELAERIKELIDRS

SEQ ID NO: 7789 - protein, 58 aa, Artificial Sequence
  Synthetic sequence.
DDLRKVEETLRELIRKIRKKNEEIRRDLRRLIEENKELLERVRREVERLIEDIKRKLK

SEQ ID NO: 7790 - protein, 60 aa, Artificial Sequence
  Synthetic sequence.
SEIEKMLEELRRLSERNKRTTEEIEKRLRDSNRDTKRKHEEALRTIKELIDRIKRAIREE

SEQ ID NO: 7791 - protein, 58 aa, Artificial Sequence
  Synthetic sequence.
DKLRKAADDVRRLIEENRRLDERLHEEVKKLIEENRKLNEDINERVRRLIEELRRETK

SEQ ID NO: 7792 - protein, 60 aa, Artificial Sequence
  Synthetic sequence.
EEIERALREMRELSRTHKELVEKILRDIAELAKTHERINEDILRKIKKLIDEIADEIRKE

SEQ ID NO: 7793 - protein, 58 aa, Artificial Sequence
  Synthetic sequence.
RELDEIAKDVKRLIDENRELLKRVEDEVRRLIRKLEELNRRTEEEVKKLIKKLEDDLK

SEQ ID NO: 7794 - protein, 57 aa, Artificial Sequence
  Synthetic sequence.
RELEELEKELRELLRELRRLSEESRKELKKLLDELEELSRRSAKKLKDLLDDLRRRG

SEQ ID NO: 7795 - protein, 56 aa, Artificial Sequence
  Synthetic sequence.
IDEVRERLRELIERDKKLNKKLTDDLRRLAERDKRENEKLSKELEDLARKLREDAR

SEQ ID NO: 7796 - protein, 57 aa, Artificial Sequence
  Synthetic sequence.
SEIEELEKRIDELLKELRDLSRRIAEEVKRLLEELKKLSKDSEDKLRELLERLKRKG

SEQ ID NO: 7797 - protein, 56 aa, Artificial Sequence
  Synthetic sequence.
VEEVLRRLEKLVREDKERLKKVLKDARDLIKKDKDLNEKLSRELEKLVRELEERAR

SEQ ID NO: 7798 - protein, 57 aa, Artificial Sequence
  Synthetic sequence.
SEIEDLERRIRKLLEENRKLVDDVAKKLRELLRELRKLSEESRKRLEDLLRKLRKDG

SEQ ID NO: 7799 - protein, 56 aa, Artificial Sequence
  Synthetic sequence.
VEEVLRRLEKLSRENKDLIRRIDERIEKLIRDDKRRNREISERARELARKLEDEAR

SEQ ID NO: 7800 - protein, 57 aa, Artificial Sequence
  Synthetic sequence.
KESEELEKEIRRLLRELREISRKIEEDARRLIEELRRLTEESERELEELLEKLKRDG

SEQ ID NO: 7801 - protein, 56 aa, Artificial Sequence
  Synthetic sequence.
VREVLERLKKLVEEDKRRLKELLDRIRELMERDKRKNKEISERVRKLIKELEDKAR

SEQ ID NO: 7802 - protein, 56 aa, Artificial Sequence
  Synthetic sequence.
DEEDRLREELRRLLEELRELSERSRDEVKKLLEDLERLTRESEEKVRRLLEKLKRD

SEQ ID NO: 7803 - protein, 56 aa, Artificial Sequence
  Synthetic sequence.
VKRVLEELRRLVEEDKKLNEEITEDARRLIEEDRRLNKKISDEAEKLARELRERAR

SEQ ID NO: 7804 - protein, 57 aa, Artificial Sequence
  Synthetic sequence.
DELRDVKRELDRLLRENEEIVERIAETVRRLLEELKKLTKELAEELRKLLEELRKRG

SEQ ID NO: 7805 - protein, 56 aa, Artificial Sequence
  Synthetic sequence.
VETVLRRVRELSRDNKRRMRRVLEEAKRLAKEDKERIDKIRKEIEELIKRLKDKAT

SEQ ID NO: 7806 - protein, 56 aa, Artificial Sequence
  Synthetic sequence.
DEEEDLERRIKKLLDENRELLKRIAEELRRLLEELRRLTEESADRLRRLLKELKDR

SEQ ID NO: 7807 - protein, 56 aa, Artificial Sequence
  Synthetic sequence.
IETLLRELEKLSRDNKELLKKIEKEIRDLIKEDKERNRELSERLRKLVEELKKKAT

SEQ ID NO: 7808 - protein, 57 aa, Artificial Sequence
  Synthetic sequence.
REIEEAAKDLDRLLEENKKLVKEVEEELRRLLKENRDLVKESEDRIRKLLEELRRRG

SEQ ID NO: 7809 - protein, 56 aa, Artificial Sequence
  Synthetic sequence.
VEEVLRRVRKLSRENKEKIRKILEDVKKLSEDNKRRNEELSRRVKTLVDEIKKRAT

SEQ ID NO: 7810 - protein, 57 aa, Artificial Sequence
  Synthetic sequence.
SRIEELEKRIRELLKENRDLVKESEDRVEELLRRNEELVRRSKEKVERLLEELRRKG

SEQ ID NO: 7811 - protein, 56 aa, Artificial Sequence
  Synthetic sequence.
VDEVLRRLKKLSDDNKELNERLTRTLEELSRRNADINKKLSDEAEKLIRDLEKRAT

SEQ ID NO: 7812 - protein, 57 aa, Artificial Sequence
  Synthetic sequence.
KEIEDAERELRRLLEELKRLLDDVAREVKRLLDENKRLVEKSEEDVKRLLDELREEG

SEQ ID NO: 7813 - protein, 56 aa, Artificial Sequence
  Synthetic sequence.
VEEVLRRVRETVERVKKKIKDVLKEIEDLSRENKKLNRDLSERLKKLADDLREKAR

SEQ ID NO: 7814 - protein, 56 aa, Artificial Sequence
  Synthetic sequence.
DELEELSREIKKLLEENRRLVRESEEDLRRLNEENRKLVEDSERRVRELLKDLRDR

SEQ ID NO: 7815 - protein, 56 aa, Artificial Sequence
  Synthetic sequence.
IEEVRERLRKLSKENKDLNRELTKRSRELNARTKERNEEISRRAEELARKIREDAR

SEQ ID NO: 7816 - protein, 56 aa, Artificial Sequence
  Synthetic sequence.
DEKETLARKLDELLRELEKLVRDSAREVEKLNEENRRRLEESRDRLRKLLEKLKRD

SEQ ID NO: 7817 - protein, 56 aa, Artificial Sequence
  Synthetic sequence.
IERVDRELKRLAEEIKELNKRITDESRKLNEDTKRVNDKLSRDLEELARDLERRAT

SEQ ID NO: 7818 - protein, 57 aa, Artificial Sequence
  Synthetic sequence.
SEIERIERENDRLNEENKKITEDIERELKRLLEENRELSRTIEEELERLLRELRKRN

SEQ ID NO: 7819 - protein, 59 aa, Artificial Sequence
  Synthetic sequence.
EKTLRELLKRSEELSKENKDRLKKLLDDLREVSKKNKEDLKRLLREVREVARKVKERAN

SEQ ID NO: 7820 - protein, 57 aa, Artificial Sequence
  Synthetic sequence.
DDIERILREMERLLEENKEISDEIRKELKRLLDENRKLSEDVVKALEDLLRDLERRK

SEQ ID NO: 7821 - protein, 59 aa, Artificial Sequence
  Synthetic sequence.
KDTLRELARKIRKLSEENKERLKELLRELKKLSDENKERIKKLLKDAEKIIEDVRRRAK

SEQ ID NO: 7822 - protein, 57 aa, Artificial Sequence
  Synthetic sequence.
SEIERIDEDNKRLNDENRKLSDRVRRENERLNKENRELSKRVEETLKRLLDELRRRG

SEQ ID NO: 7823 - protein, 59 aa, Artificial Sequence
  Synthetic sequence.
KRTLTELLKESRELSKRNKDKIRELLRRSEKLSRENKKRIEDLLRELRRVVEKIKREAD

SEQ ID NO: 7824 - protein, 57 aa, Artificial Sequence
  Synthetic sequence.
KEIEDLRRDLDRLLRENRELTREVKEELEKLNRELEELVRRIKRTLDELLKDLERRN

SEQ ID NO: 7825 - protein, 59 aa, Artificial Sequence
  Synthetic sequence.
REEIERLREELRKLSEDNKDRIRRILERLRKTVEEIKKRLEDILRRLTEIAKEIEERAR

SEQ ID NO: 7826 - protein, 59 aa, Artificial Sequence
  Synthetic sequence.
SELEKLLEDLRRLSERSERELRRLRKELEEIIREIKKKMEENLERNRKVIDEIDKVIKD

SEQ ID NO: 7827 - protein, 58 aa, Artificial Sequence
  Synthetic sequence.
EEAKRLKEDAERLLRENERRIDELRKEADELIKELKKRIEDLVKESRRLLEELDRRAK

SEQ ID NO: 7828 - protein, 59 aa, Artificial Sequence
  Synthetic sequence.
EELERLEERLDRLIEEAERRLKDNLKKNEDMARKWEEDTKRNEKRNRDLIRRIRKVIKD

SEQ ID NO: 7829 - protein, 58 aa, Artificial Sequence
  Synthetic sequence.
RKVKELKRRARELLERLARLIDELRRRSEDLIRRLAEKSERLERESRKLLRDIAEKTT

SEQ ID NO: 7830 - protein, 60 aa, Artificial Sequence
  Synthetic sequence.
RELEELKKEAEKVSKESKDLIEKVIRDNEDVSRRSEELIRELMREVKEVIDRLRELIERR

SEQ ID NO: 7831 - protein, 59 aa, Artificial Sequence
  Synthetic sequence.
EDKVRRIKEELERLIEENEKLLEESKKRSEDNARRNEELLERLRRELERLARELEEELR

SEQ ID NO: 7832 - protein, 57 aa, Artificial Sequence
  Synthetic sequence.
REKEELKKDIERMVEELKKLNKESRDRTRKLIKELEDLVKESDDDTERLARKLEKEV

SEQ ID NO: 7833 - protein, 56 aa, Artificial Sequence
  Synthetic sequence.
VEDLLREARKLIEELKRHTEEVIKRNKKLIDELKEIIEDVIRRNRKLVKELEDTAK

SEQ ID NO: 7834 - protein, 57 aa, Artificial Sequence
  Synthetic sequence.
SEKEDLKRRLDKLAEDLRRLNKEVDDEVKELARRLRKLNKDSRKRTEDLIRELEKRV

SEQ ID NO: 7835 - protein, 56 aa, Artificial Sequence
  Synthetic sequence.
VDELREEIKELIDRLRKHTEEIIRRIRRLFEELRKHSKKVIDDNKRLFDELEKTAR

SEQ ID NO: 7836 - protein, 57 aa, Artificial Sequence
  Synthetic sequence.
KEKEDLKRKVDELDKELKKLNEDSRRKTKELIKRLKDINKRLREELEKLADELRKKV

SEQ ID NO: 7837 - protein, 56 aa, Artificial Sequence
  Synthetic sequence.
VEELDREITELIKELRRHTEEVIRRNEKLARELEKHSRDIMETIRELIRDLERTAK

SEQ ID NO: 7838 - protein, 57 aa, Artificial Sequence
  Synthetic sequence.
SEKERLEKRLREVVRELEKLNEDLDRRLEELARDLERLNEESRRESRKLAEDLKREV

SEQ ID NO: 7839 - protein, 56 aa, Artificial Sequence
  Synthetic sequence.
VEEVEERIERLIRDLKRHTEEIKKTIEELMKELREHSREIIKRSRDLFKELKDTTK

SEQ ID NO: 7840 - protein, 60 aa, Artificial Sequence
  Synthetic sequence.
SELEKVIEEIREISERSLEKIKRLMEKIKELSDRTAERLRRVLEEIRKIIEEIKELRDRG

SEQ ID NO: 7841 - protein, 59 aa, Artificial Sequence
  Synthetic sequence.
KELAKKITEDLKRNEERNRRAIEELERTLRKLEEENRRLIREAEDTLRRLVEELEKKDE

SEQ ID NO: 7842 - protein, 59 aa, Artificial Sequence
  Synthetic sequence.
SELEEVLKEAKRLIDEIRKHTRDVSERSKRLLEEDLKHTEEVIKEIRKLIKEILDRIRA

SEQ ID NO: 7843 - protein, 59 aa, Artificial Sequence
  Synthetic sequence.
EDDLRRLKETIERLAKDLERLNREHDETNKKLAKDSEDLNRELKKRVEELEEELRRALK

SEQ ID NO: 7844 - protein, 59 aa, Artificial Sequence
  Synthetic sequence.
KELEDVLKEIRDLARRIEEHSKKVLREIEELIRRLEEENREVLRRMREEIKKIKEDIRN

SEQ ID NO: 7845 - protein, 59 aa, Artificial Sequence
  Synthetic sequence.
KRKLDELRRDVRRLERRLERLNETLKERIDRLAERLEEVDRRLDEELKRLAEELKEELR

SEQ ID NO: 7846 - protein, 60 aa, Artificial Sequence
  Synthetic sequence.
DKLDEIKERIERLVETDLRVIKRILEEADELIKENEKLIEKILRDNRRLIEEVEEIIRRD

SEQ ID NO: 7847 - protein, 59 aa, Artificial Sequence
  Synthetic sequence.
EKKLRELKKRVDELREESKDLNDKLEKRIRDLKRELKKLNDRHEEELRKLKERLRRATK

SEQ ID NO: 7848 - protein, 60 aa, Artificial Sequence
  Synthetic sequence.
DELDEILKTADKLAEDDLDTIRRLLEEVRDLVRKDKEVIKRILEEIDRLIKEVEDIIRRD

SEQ ID NO: 7849 - protein, 59 aa, Artificial Sequence
  Synthetic sequence.
EKKLKELEDRVRELKRRSEELLKKVEETLRRLKEESRRLNEELERTIRELEERLRRATK

SEQ ID NO: 7850 - protein, 56 aa, Artificial Sequence
  Synthetic sequence.
SKEDRAREELKRLKEELEKLLEEHRKTLEDLNRELKRLVDEHEKSIRELRKELKDS

SEQ ID NO: 7851 - protein, 56 aa, Artificial Sequence
  Synthetic sequence.
IDDVIRRVRETIDEVVRRIEELLEENRKLIEDLEEKIRRLNERLKRLVEEIKERDR

SEQ ID NO: 7852 - protein, 56 aa, Artificial Sequence
  Synthetic sequence.
SERERVREEVRKLLERLRELLERHRRKLEKLNRELEKVLEDHRRTLERLKEELERS

SEQ ID NO: 7853 - protein, 56 aa, Artificial Sequence
  Synthetic sequence.
IDTVLEEARKLIEKAERDIRRLAKENEKTIEEVKERLKKLMEENKRLIEEIKERTR

SEQ ID NO: 7854 - protein, 60 aa, Artificial Sequence
  Synthetic sequence.
SEIEDLLRRLKEVADEIKERLKKLSEESEELVRRVKRRIEELNKENREVMKEIKRRIDSG

SEQ ID NO: 7855 - protein, 59 aa, Artificial Sequence
  Synthetic sequence.
EEDVRRLAEDIRRLLEEIEKLLKEHEEKNRKLKKELEDLVRRHRKSVEDLKREIRERSR

SEQ ID NO: 7856 - protein, 56 aa, Artificial Sequence
  Synthetic sequence.
DDEERLEETLERLERELKKIADEHRRRNEELRDTLRRIAEELRKTHKDLLERLEEE

SEQ ID NO: 7857 - protein, 59 aa, Artificial Sequence
  Synthetic sequence.
KRVVEEVERKLRRLMDRIREELKRLTDESEDLVTKILDTVRRIVESIKKLVDELREERK

SEQ ID NO: 7858 - protein, 60 aa, Artificial Sequence
  Synthetic sequence.
DEAERLLERVDKAHERSEELLDRVLKENRKVLEEIRKLADDLRKLLDDIMRRIEDLVRKE

SEQ ID NO: 7859 - protein, 59 aa, Artificial Sequence
  Synthetic sequence.
DRDLREIERRLKEIEEENRKLVKRLEDENRKIAREVEKLVERLERRLREIARRVEESVR

SEQ ID NO: 7860 - protein, 56 aa, Artificial Sequence
  Synthetic sequence.
REKEELKKSIERVKRELERLLEEHRKRSEELKRRLEELLKDHKRRTDEVLKEAKDK

SEQ ID NO: 7861 - protein, 56 aa, Artificial Sequence
  Synthetic sequence.
VDTLEEEIKDIIRDVKRAVKESLEEDDRLAKEVEDMVRKSKEEVERLIEKVKRDTD

SEQ ID NO: 7862 - protein, 56 aa, Artificial Sequence
  Synthetic sequence.
REKEELEKEIERIKREIKKMLDELKRHSEELKRRAERLLEEHRRETERIIREMRES

SEQ ID NO: 7863 - protein, 56 aa, Artificial Sequence
  Synthetic sequence.
VKTLLEEIRKILKEVEDRIREILREDKRLADELEKAVRDSLREVKRILDEVREAVR

SEQ ID NO: 7864 - protein, 56 aa, Artificial Sequence
  Synthetic sequence.
DEDKRLADEIKRVLDELKKSVKEHRDHSEELLRRAKELLKRHEDETRKIEEEARRN

SEQ ID NO: 7865 - protein, 56 aa, Artificial Sequence
  Synthetic sequence.
VETLKREIEELIRRAKKVNKESKEDDRRLADEVRKVVERSEETVKRLRDEVTERVR

SEQ ID NO: 7866 - protein, 56 aa, Artificial Sequence
  Synthetic sequence.
REKEELEKELRRIKRELEKILEEVRKRSKELLDRLRELLRRHEAETEKAIEEMERA

SEQ ID NO: 7867 - protein, 56 aa, Artificial Sequence
  Synthetic sequence.
VDKLLRDVREIAREAKRVIRRILKTDEDLARELEEIVRRSLKKVEDLIRKVKEDAR

SEQ ID NO: 7868 - protein, 60 aa, Artificial Sequence
  Synthetic sequence.
SEEEKLEEIIRRSRKRLKELIDRLRELVKKIDDDLKRLLDEHRRRLEESERRAEELLKKV

SEQ ID NO: 7869 - protein, 56 aa, Artificial Sequence
  Synthetic sequence.
VEKVLKELEESSRRVVELIKKLMRELEKLLRDVEERAKDLLRKNTRSSEELEKRIE

SEQ ID NO: 7870 - protein, 60 aa, Artificial Sequence
  Synthetic sequence.
SEEEKLKKLLDESEKRLREILKRHEEIVRDIKRRLEELLKRHKELLDRSLKRLEELLKEN

SEQ ID NO: 7871 - protein, 56 aa, Artificial Sequence
  Synthetic sequence.
VEELLERVKKSSEDVAREIRKLARDNERLLEEVKRLIRKLLEENRESSKDVEDKIR

SEQ ID NO: 7872 - protein, 60 aa, Artificial Sequence
  Synthetic sequence.
SKEEELRDKLRKIRKRLEELLERLAREIDRIRRALEDLLRRHKEELDRSRKRAEELLKEI

SEQ ID NO: 7873 - protein, 56 aa, Artificial Sequence
  Synthetic sequence.
VDRVLEELDRLLKEVEETIRDLARKLRELLKRVEDTLRKLLKENKDSSRRLEEEIR

SEQ ID NO: 7874 - protein, 60 aa, Artificial Sequence
  Synthetic sequence.
SKEEELARMIEESVKRLKKLLDDLRKVIKESKDRLKELIDDHRRILEEIRRELEELLKKK

SEQ ID NO: 7875 - protein, 56 aa, Artificial Sequence
  Synthetic sequence.
VDKLLKEIEDSSRKLAEEIKKLIDEIRESSKEVIERVRRLLERNKELVRKVKEEIR

SEQ ID NO: 7876 - protein, 60 aa, Artificial Sequence
  Synthetic sequence.
SEVEKLEEEIKKINDEIRRLSDKNLEDLKRILEEIEDLSRRNLKKTKDILREIEEEAKRR

SEQ ID NO: 7877 - protein, 59 aa, Artificial Sequence
  Synthetic sequence.
DEFAERLKRSLEDSKRTSKELVDENRKLNEELERTVRKLIEDNKRLNDRVEKRVKELAD

SEQ ID NO: 7878 - protein, 58 aa, Artificial Sequence
  Synthetic sequence.
SLEDEIRRLIEEIKRKLKELLERLKEEIDRIREELKKSNRKLDELSRRIEEEARKRVG

SEQ ID NO: 7879 - protein, 59 aa, Artificial Sequence
  Synthetic sequence.
EEKIERVLREMEKLLRELERIAREVLKEIEKILRENKKHNEEVMERNKRLAKELKEKAD

SEQ ID NO: 7880 - protein, 58 aa, Artificial Sequence
  Synthetic sequence.
DLEREIDELIKDIARRLEESNRELEKLVRRIEEELRRSNKELEDLSRRIKTELRKEVG

SEQ ID NO: 7881 - protein, 59 aa, Artificial Sequence
  Synthetic sequence.
EEKAKRVADEIRKILRENEEHNEEVARRIEEILRRNKKHNKEVADKNRELLKKLKEEAR

SEQ ID NO: 7882 - protein, 56 aa, Artificial Sequence
  Synthetic sequence.
KLVEEIRKSAEDNRRRLEKLVRESKKSLDDNERENRKLVDELRKIATKIKEDLERD

SEQ ID NO: 7883 - protein, 59 aa, Artificial Sequence
  Synthetic sequence.
KEAVDKLEEENKRDHDEYKKVVDELKKENKEDHERSRKLAEDLKRLLEDIRRRIKETRR

SEQ ID NO: 7884 - protein, 59 aa, Artificial Sequence
  Synthetic sequence.
DEVEKLIEDLKEVTKKHAKRVEETNRHNEDVLRKVAKEVKRILDDVKRVVDEVKKVVDA

SEQ ID NO: 7885 - protein, 59 aa, Artificial Sequence
  Synthetic sequence.
DKAKKKLEDVLKRSREEIERLKDDSRKSVDETRERLKKLKEDLKRLLEEVRKEVEKLKR

SEQ ID NO: 7886 - protein, 59 aa, Artificial Sequence
  Synthetic sequence.
SEVEKLIKELRDVLKKVAEDVEKTNRDLEEVSKRSAEKVKKLEDELEKVLREVEELVKN

SEQ ID NO: 7887 - protein, 59 aa, Artificial Sequence
  Synthetic sequence.
RKAEEDLRKVLTEIRKRAEELRRESDESVKRSRKELERLLREIEKRVEEIEDRARKAKK

SEQ ID NO: 7888 - protein, 56 aa, Artificial Sequence
  Synthetic sequence.
EEVERIIEEIRDEVKKAAEKVEKVLKESREISKRAEDEVRRVLDEIRKLDETLRDA

SEQ ID NO: 7889 - protein, 56 aa, Artificial Sequence
  Synthetic sequence.
REKLRKVLDEIRREIERLKERLDRLDEESDRKSEKLKEDLERLLREIEKRIRDERR

SEQ ID NO: 7890 - protein, 56 aa, Artificial Sequence
  Synthetic sequence.
DEVRKVLEEIKELLKRLAEKVKKLIKESREISKRAAEKVKRLIEKSRRLLDTLEKA

SEQ ID NO: 7891 - protein, 56 aa, Artificial Sequence
  Synthetic sequence.
KDTLKTVLDTIKKKIEELVKELREVDEESKKRSKELKEEMDKVDEDIKRAIERRTR

SEQ ID NO: 7892 - protein, 56 aa, Artificial Sequence
  Synthetic sequence.
DEVRKVLEDIKRDLDRLAKRVKDVLREIEELTKEAARTVKKVIEESRRLLRKLKEA

SEQ ID NO: 7893 - protein, 56 aa, Artificial Sequence
  Synthetic sequence.
REDLTELLKRIEEKIKRLVEELERLLKRSREESKRLVEEMEKVNREIEEEIKKRAT

SEQ ID NO: 7894 - protein, 60 aa, Artificial Sequence
  Synthetic sequence.
EEVERLLKEIKDLLDEVARENKEALKRSKELLEEVAEDNKRVLREIEKLLEDVERKVKDE

SEQ ID NO: 7895 - protein, 59 aa, Artificial Sequence
  Synthetic sequence.
KELLKELEDLLRKARKTVEDLDRELEELNEEIRKALEELDKELERLVREIRKRLEDARR

SEQ ID NO: 7896 - protein, 60 aa, Artificial Sequence
  Synthetic sequence.
REAEELLKEIERLLREVERENKKALEDSRRLLEEVAEEVKKVLREIEELLKTLEELVRKE

SEQ ID NO: 7897 - protein, 59 aa, Artificial Sequence
  Synthetic sequence.
EELLRELKRLLEEIERRVRELDEELRKLNEDIKRELERLIRELEELLKRAEETLRRLKD

SEQ ID NO: 7898 - protein, 60 aa, Artificial Sequence
  Synthetic sequence.
SEVEDALRRLKELLRRVAEENRKVLEESKKLVEDARRKNEEVLKEIEKLLEDVAREVKDR

SEQ ID NO: 7899 - protein, 59 aa, Artificial Sequence
  Synthetic sequence.
EELLRELKKLLEEIKKSVEDLDRELKKLNDEIRDESRKSKEELERLLEDIERALRELAR

SEQ ID NO: 7900 - protein, 60 aa, Artificial Sequence
  Synthetic sequence.
SEAEEVLRRIEELVERATRTVEKLAEESKRLLEKLAEENKRVLEEIKRLLDEVADKVRKK

SEQ ID NO: 7901 - protein, 59 aa, Artificial Sequence
  Synthetic sequence.
KELLDELKTLLDEITKRLKDLTDKLERLNDKIRRELERLDEELRELLERIREEMEKLTR

SEQ ID NO: 7902 - protein, 60 aa, Artificial Sequence
  Synthetic sequence.
DLEEELKELLERIRKAHEELIKELEDLTEKIERDHEKLIKRLEDLLKRIEDEMRKLLEEI

SEQ ID NO: 7903 - protein, 59 aa, Artificial Sequence
  Synthetic sequence.
SRTVKEILKRIEDSLRRAAKKVKDLAEENKDSLRRVAEKVERILEELKRLLEEIARRVK

SEQ ID NO: 7904 - protein, 60 aa, Artificial Sequence
  Synthetic sequence.
SLEEKLEDLIRRLKESNERLKRELERLIEELRKNNERLLKELDDLVEEIERALRDLLREK

SEQ ID NO: 7905 - protein, 59 aa, Artificial Sequence
  Synthetic sequence.
SRKVEKILKDAKDSNKKVADTVREILKRARDSNKRVAERVKDLLRRLRELLKELAERVK

SEQ ID NO: 7906 - protein, 60 aa, Artificial Sequence
  Synthetic sequence.
DLEEELKELIKRIRDAHRELKERLDKLVEEIKRNNEKLSDDVRRLVREIEKELRRLLEEI

SEQ ID NO: 7907 - protein, 59 aa, Artificial Sequence
  Synthetic sequence.
KEKVKKLLKELEESLKRVADEVKRLLEELERSNREVEKRVRELLEEARRLLKDLADKVR

SEQ ID NO: 7908 - protein, 60 aa, Artificial Sequence
  Synthetic sequence.
DLERELRELIKRIEDDIRKNVKRNEESIRKTEDELRKNVRENERLIEEMRKELEKLRRRN

SEQ ID NO: 7909 - protein, 59 aa, Artificial Sequence
  Synthetic sequence.
EEVARKLLDELREIKKRINDTSRTTLEDNKRLAKEIHDSSKESLKRLKKILDDIREEAR

SEQ ID NO: 7910 - protein, 60 aa, Artificial Sequence
  Synthetic sequence.
RLAEELRKLIDKVRRDLDRNRETNRELIKRAKDELRKNEEENRRIIDEIRRALEDLTRKN

SEQ ID NO: 7911 - protein, 59 aa, Artificial Sequence
  Synthetic sequence.
EEAVRKVKKEIEDIVREIHKLSKRTLEELERIVEKIHEDSKRMLERVKKLLDKIRRDAE

SEQ ID NO: 7912 - protein, 60 aa, Artificial Sequence
  Synthetic sequence.
SLAEELRKLIKRVEDEIRRLAEENKDLIRKARETIRKNEETNREVITRIRREIEKLEKDN

SEQ ID NO: 7913 - protein, 59 aa, Artificial Sequence
  Synthetic sequence.
EEVVRELLKEIRKVLEDIRRESKTSLDDIRRLLKEINDLSEETIREAEELLDRIRKKAT

SEQ ID NO: 7914 - protein, 60 aa, Artificial Sequence
  Synthetic sequence.
SLREELKRLIDESRKSLRENEERNKKSIDDTRRLLRENERRNRETIKELKKTLDELRRRS

SEQ ID NO: 7915 - protein, 59 aa, Artificial Sequence
  Synthetic sequence.
KEAVDRLLERIRRINEEINRTSEKTLEENDRLVKELHERSERLLRKLEELLRKIDETIR

SEQ ID NO: 7916 - protein, 60 aa, Artificial Sequence
  Synthetic sequence.
SLAEELRRLIEEVKKRLKELEDRNRKLIKEARDELKENEETNRKTIEDIERTLEKLERDN

SEQ ID NO: 7917 - protein, 59 aa, Artificial Sequence
  Synthetic sequence.
EEAVRDLLRRIRELLRDLERLSEESLRKLKEIVEDIHRKSKTMLDKLRKMLEELRREAT

SEQ ID NO: 7918 - protein, 60 aa, Artificial Sequence
  Synthetic sequence.
SLAEELKRLIEESRKSVEELERRNRKLIEDARRDLERLARENRKLIEEIRRRLKDLAKDN

SEQ ID NO: 7919 - protein, 59 aa, Artificial Sequence
  Synthetic sequence.
EEVVRRLLEEIKRLNDEAKRKSKESLDRLREILKEIRKTSERTLEKLKRILDRIREEAT

SEQ ID NO: 7920 - protein, 60 aa, Artificial Sequence
  Synthetic sequence.
SEIEELLERIRDLMRRINKKSEDHLRELEKILREIRRLAEKSNEEIERLLRELEDLAEKR

SEQ ID NO: 7921 - protein, 60 aa, Artificial Sequence
  Synthetic sequence.
MKDLKKTLDDLLDELRKDIERNVKENRDTLKRIEDDIRRLAEENKKLLEEVRKKIEELET

SEQ ID NO: 7922 - protein, 60 aa, Artificial Sequence
  Synthetic sequence.
SEIEELLRRLEDILRRIEELIRKVLKELRDLVEKSNDLSRRHLEDAKRILKEIEEEVKRR

SEQ ID NO: 7923 - protein, 60 aa, Artificial Sequence
  Synthetic sequence.
VEELRRRLRKILEDIRKRIEELVEELRRLLKEWEEESKKNDETNREVLKRIEDRIRELER

SEQ ID NO: 7924 - protein, 60 aa, Artificial Sequence
  Synthetic sequence.
DEAEEIKERIKKVVEDLERKVRELLRRSEKLAEDLHELSKENIERMKRLLEELEDLVRKR

SEQ ID NO: 7925 - protein, 55 aa, Artificial Sequence
  Synthetic sequence.
EEIEDLLRKVEERIRELEEELRRLNKKIEEEVRRNKDENRRVNEEIERRIRELAR

SEQ ID NO: 7926 - protein, 60 aa, Artificial Sequence
  Synthetic sequence.
DESKEILDRIRKVNEDLRRLAEELLKDSRRVVEEAHKLSEDNIRRLEELLKEIEKEVRRR

SEQ ID NO: 7927 - protein, 55 aa, Artificial Sequence
  Synthetic sequence.
DKIRKLLEDSKKTSDELKEELDRLNEEIERSVRDNKRRNEEVNKRIEDEIRKLAT

SEQ ID NO: 7928 - protein, 60 aa, Artificial Sequence
  Synthetic sequence.
SEAETILEKIRRANEELNRLSEENIRKSRKVVKELHELSKENIKRARDLLREVKKLVEKR

SEQ ID NO: 7929 - protein, 55 aa, Artificial Sequence
  Synthetic sequence.
ESIKELLKEVEDDVRKNKEENKKVNKEAEDEVRENKERNTRVNKEMEEEIKRLAK

SEQ ID NO: 7930 - protein, 61 aa, Artificial Sequence
  Synthetic sequence.
SERERLERLVREAAKELKRLLEELERLHKKIDEDLKRSNDRLRELHERIKKDIERLLRRIG

SEQ ID NO: 7931 - protein, 56 aa, Artificial Sequence
  Synthetic sequence.
VEEILKEIEDILRKVKEDVKRVLDENRRVLEENKEHAERILRENKRMLEELRREAK

SEQ ID NO: 7932 - protein, 61 aa, Artificial Sequence
  Synthetic sequence.
DSEERLRKLMREAREELKELLRRLRELHEEIRKRVEELLRRLEELSDKLRRDLERLLREIG

SEQ ID NO: 7933 - protein, 56 aa, Artificial Sequence
  Synthetic sequence.
VEELLKTIKELVDRLRRIVEKVLDENRRLLKRLEEEIKRVLDENREMLDRLRKAAE

SEQ ID NO: 7934 - protein, 61 aa, Artificial Sequence
  Synthetic sequence.
SKEETLEKLVREVKDRLKKLLEEVRRLTEELERELKKLREELEELSKELEKDLRRLKKRVG

SEQ ID NO: 7935 - protein, 56 aa, Artificial Sequence
  Synthetic sequence.
VEELLKRIKELLEELERRVEEVLRRNRELLKRLEETIRKVLEENKKLLKEVREDAK

SEQ ID NO: 7936 - protein, 61 aa, Artificial Sequence
  Synthetic sequence.
DKEEELRRLVEEVEKRLRELEKELEDLTDKIEKRLRESNERIKKLSDDIRRRLEDLLRKVG

SEQ ID NO: 7937 - protein, 56 aa, Artificial Sequence
  Synthetic sequence.
VEELLKRIRDILKRVEEIVKEVLERNRKVLEDNERHAEEVLRRNKRLLEELEKRAT

SEQ ID NO: 7938 - protein, 61 aa, Artificial Sequence
  Synthetic sequence.
SKEDDLRKIVKEIEEEVRKLLKELEELTKELEDRLRESNKTLKELNERIKRRLEELLRRIG

SEQ ID NO: 7939 - protein, 56 aa, Artificial Sequence
  Synthetic sequence.
VEEVKKELEDLLRRLREEVKRVLDDHRRILKENEDHAREVLKRNKELLRKLEEEAK

SEQ ID NO: 7940 - protein, 61 aa, Artificial Sequence
  Synthetic sequence.
SKEERLKKLVDDVRKTAEKLKRDLERLTKEAEETLERLKRELDRLNREIAEEIKKILDRVS

SEQ ID NO: 7941 - protein, 56 aa, Artificial Sequence
  Synthetic sequence.
VETLLEEIERKLREVEKRIREVLKRHRELLRRLRETIKRVLERNKELLDRLREAAR

SEQ ID NO: 7942 - protein, 61 aa, Artificial Sequence
  Synthetic sequence.
SKEETLKKLMDRAEEELRRLKRELEELNDRIREALKKLNEDLRRLHEKIKEDIRKLLEEVD

SEQ ID NO: 7943 - protein, 56 aa, Artificial Sequence
  Synthetic sequence.
VEELLETIERILEEVRRRIEKVLEENKRLLDENKKHAEESLKKNKELLKRLRDAVK

SEQ ID NO: 7944 - protein, 59 aa, Artificial Sequence
  Synthetic sequence.
SEVDEVRERLERLLRTVERVVERILRELKRLNDELRKIAEDLLRENKDLLRELAERVRK

SEQ ID NO: 7945 - protein, 59 aa, Artificial Sequence
  Synthetic sequence.
SEALKDIEKLVRKIKEELKRLLKEVAETLERSERSLDKLIEDHRRLVEDIERALKELRK

SEQ ID NO: 7946 - protein, 60 aa, Artificial Sequence
  Synthetic sequence.
SEVEKVLETIKDLLRKLEEIVKKILDEDRKLMEKVTKIVEDLLEENKRLLEELERLAREG

SEQ ID NO: 7947 - protein, 59 aa, Artificial Sequence
  Synthetic sequence.
SELLKRIRELVKEVKDRLRRLREELEESVRRARKTLEDLERRHRKLLKDIRETIKELIR

SEQ ID NO: 7948 - protein, 55 aa, Artificial Sequence
  Synthetic sequence.
DLDREIERLVEELERRLRELLRRNEELVKRVEDELEKLKRESEKLLRELRKKLEE

SEQ ID NO: 7949 - protein, 59 aa, Artificial Sequence
  Synthetic sequence.
KEAVDKLLKELKDILKKLEELSRKSMEDIKDILRRYEKLVKELLDELKKILDELDRADK

SEQ ID NO: 7950 - protein, 55 aa, Artificial Sequence
  Synthetic sequence.
DLKDEIEELVKRARERLERLREESEEIVKELEKVLRDLEKENRDLARRLRDELRK

SEQ ID NO: 7951 - protein, 59 aa, Artificial Sequence
  Synthetic sequence.
EEAVRRLKDELRRILEEYERVVEELKKRLKDLLREAERLSKESLDELKRILRKLKEDAK

SEQ ID NO: 7952 - protein, 60 aa, Artificial Sequence
  Synthetic sequence.
SLEDELRRLVEEDERNIRKLNDENRKSVRKLEELLRRLNKRNRETIERIKRLLDRLREES

SEQ ID NO: 7953 - protein, 59 aa, Artificial Sequence
  Synthetic sequence.
KEEIDRILRKVERLSRKAHEDVRRINEELEKLLEKLKREVKRENDRVEEEAKRLADEVK

SEQ ID NO: 7954 - protein, 60 aa, Artificial Sequence
  Synthetic sequence.
REVDELVKRIEELLREMKKKNDESLKDSRDLLRELEKRVERVIEEIEKLLRDLEELVRKE

SEQ ID NO: 7955 - protein, 56 aa, Artificial Sequence
  Synthetic sequence.
EKRLKKLLDELRDMSRKADRALRELNKDVARKIEELRRRLKKLLDEVKERADELTK

SEQ ID NO: 7956 - protein, 60 aa, Artificial Sequence
  Synthetic sequence.
SEAEKLLEDLKRLVEDLRRKNKKLNDDNERLTTELEKTSRKLLEELKRLLEKVADDVRRT

SEQ ID NO: 7957 - protein, 58 aa, Artificial Sequence
  Synthetic sequence.
ELKERLDRLLEEVKKTIRELEKRNRESHKRTKDVARRSAEETKRVLEKIEDDLRKLDK

SEQ ID NO: 7958 - protein, 60 aa, Artificial Sequence
  Synthetic sequence.
SEAEKLLKEIKDLVDELRKRSKELIDENKRLTEEVEERARRLLTELRKLLKRLEELVRRE

SEQ ID NO: 7959 - protein, 58 aa, Artificial Sequence
  Synthetic sequence.
ELEERIRRLLREIEKEAKRSRDRSREVHRRTDEELRRLEREIKEILKEIKRKLDELRR

SEQ ID NO: 7960 - protein, 59 aa, Artificial Sequence
  Synthetic sequence.
SDVDRLLKENRDVSKKVEDDVRRLLEELKRISEEIARRVKRLLEELRRILREIEELVKK

SEQ ID NO: 7961 - protein, 59 aa, Artificial Sequence
  Synthetic sequence.
DELRRRAEKSIEDNERKLRKLEEDAKRIIDDNERILRDLERRAKDVIREVRKALEDLKR

SEQ ID NO: 7962 - protein, 60 aa, Artificial Sequence
  Synthetic sequence.
DEAEKLLEEVKEENRRVNEDIKRVIEEIKKLIDESRRLMEKIIRDVEALLTRIRDVVEKL

SEQ ID NO: 7963 - protein, 59 aa, Artificial Sequence
  Synthetic sequence.
EDVRREIERIMRELKKNLDRLEEEIRRIADELRRVNTRLEEEIKRVIDEARKTLEELRR

SEQ ID NO: 7964 - protein, 60 aa, Artificial Sequence
  Synthetic sequence.
SKEERLEEILRRHKKSLDEIRKELRKLLEDHRKSIEDLIRKLRELLERLKELLERLERSG

SEQ ID NO: 7965 - protein, 56 aa, Artificial Sequence
  Synthetic sequence.
VDRLITEIKRINEELRESVRRLLERAKRIDEELRRTAEELVKTIEKLAKELEETVR

SEQ ID NO: 7966 - protein, 61 aa, Artificial Sequence
  Synthetic sequence.
DEIEEVVERIRRIDKELNKRAEEVIRRNKELDERLNREIERVKEEIRRLIKRLEEVTRRDL

SEQ ID NO: 7967 - protein, 59 aa, Artificial Sequence
  Synthetic sequence.
EEAKKKLEDLLEEHERNLRKIERDLEELNERHERNLRKLKRELEEILKRAKEVLDELRK

SEQ ID NO: 7968 - protein, 61 aa, Artificial Sequence
  Synthetic sequence.
SEIEKVLREIEEIDKRLNKEVEDVLRENRRVDEELNRHSERVREEIERLVKRLDDVAREEL

SEQ ID NO: 7969 - protein, 59 aa, Artificial Sequence
  Synthetic sequence.
EEMKKTLEKLLREHEENIKELKRRLEELNEEHERNIRRSEETLKKLLKEAEDRLREIKK

SEQ ID NO: 7970 - protein, 60 aa, Artificial Sequence
  Synthetic sequence.
EEAERVLKRIADLIEELKRHSEEVSRRSKKLLDDLSRHTEKVSKESEDLLRRLEELARRG

SEQ ID NO: 7971 - protein, 59 aa, Artificial Sequence
  Synthetic sequence.
REIEERLRTLRRRLERMVEEIERLNEENLRRVEKRVRELEKENEDNLREAKKLLDEIRR

SEQ ID NO: 7972 - protein, 60 aa, Artificial Sequence
  Synthetic sequence.
SEVEEVLKDIERLIKELREENKRSLDRSRRLAEDLERRNRESLRRIEKLLRELEKIARDL

SEQ ID NO: 7973 - protein, 59 aa, Artificial Sequence
  Synthetic sequence.
EEVRKRAEDVLRRLEEVIKELEKTNEDAKRELKRLIDELRRTNEEVNKRLEERLDKIRE

SEQ ID NO: 7974 - protein, 60 aa, Artificial Sequence
  Synthetic sequence.
SEVERVLKDIERLLKELEERNRRSLEESAKSTRKVEEDNKRSLDKSTELLKRLEEDAKDD

SEQ ID NO: 7975 - protein, 59 aa, Artificial Sequence
  Synthetic sequence.
EEVRKRAEDVRRRLEEILKRLKETNEDMKRENKRVLDELRKTNEDAEKKLRDLIRKLRE

SEQ ID NO: 7976 - protein, 60 aa, Artificial Sequence
  Synthetic sequence.
SEVEKVLKEIDELIKDVERTNRESLEESERLLEKLKRENERTVERSERLAEELERLAREL

SEQ ID NO: 7977 - protein, 59 aa, Artificial Sequence
  Synthetic sequence.
EEVKDRADKLLRRLEEMVEKIRRTNETLLRALEKLIRDLKRNNEEVEKRLREIAKKIRD

SEQ ID NO: 7978 - protein, 60 aa, Artificial Sequence
  Synthetic sequence.
SEVDELLKRLKKLLEDDKRLAEELLKTIEKVNDDTRKRSEELLRRLERALEELEKLVRKV

SEQ ID NO: 7979 - protein, 59 aa, Artificial Sequence
  Synthetic sequence.
EEVKRRLEEVLREIKRLVDETRKELRRIDEESKRLAEKSRRDSRRVEERLRTLLEELRK

SEQ ID NO: 7980 - protein, 60 aa, Artificial Sequence
  Synthetic sequence.
SEVEKLLEDMERLLKEDEELVRRLSKRSEEIVRDDRRRNKEILDEIRKLLEELKRLADRL

SEQ ID NO: 7981 - protein, 59 aa, Artificial Sequence
  Synthetic sequence.
KDVEERLRRAEERIRRAVERTRDHARRNHEKLKELVKETRESNDRLKKEIRKLLEELRK

SEQ ID NO: 7982 - protein, 60 aa, Artificial Sequence
  Synthetic sequence.
EEEERIREVKKRSEDLLEELKRSNERVERESDKLAEEIRRKLEELARRADEVIRRLRARK

SEQ ID NO: 7983 - protein, 56 aa, Artificial Sequence
  Synthetic sequence.
TEKLLEDLKRINKETERLNRELLRDLERINEETRERIDRLLRELERMIDELRKRVD

SEQ ID NO: 7984 - protein, 60 aa, Artificial Sequence
  Synthetic sequence.
SERERAEEIRKRSEDVVREMRESNKDVSRKSEELAKKLREDLKRVEKKVRELLEEIKREK

SEQ ID NO: 7985 - protein, 56 aa, Artificial Sequence
  Synthetic sequence.
TEELLKRLEEISRRSRELNRRLLEDLKRINKETKERADKLLEDLERLLEDIKRRVD

SEQ ID NO: 7986 - protein, 60 aa, Artificial Sequence
  Synthetic sequence.
DEDERLKEVEEESKKVADELRDRLRRLMEESRRRLKRLREEAEEIKRELDTIAEDLKREK

SEQ ID NO: 7987 - protein, 56 aa, Artificial Sequence
  Synthetic sequence.
TEEILRRLEEISEESERRVEKLLRENKEINEETDRRVKELLERLKEVLERIERRVK

SEQ ID NO: 7988 - protein, 60 aa, Artificial Sequence
  Synthetic sequence.
DERERLREVLERSRKLAEDLRRSNEELERRSRELAKELRKTNKELEKRLKDKADDLRREK

SEQ ID NO: 7989 - protein, 56 aa, Artificial Sequence
  Synthetic sequence.
TERLLEELERISEESKRRNDELLEKNERVNEETRRRNEELLDELRRLLEEVERRVK

SEQ ID NO: 7990 - protein, 59 aa, Artificial Sequence
  Synthetic sequence.
DIEERIREVLRKARRVLERSEERSRELVERLRRVLEDSRRRTKRLTEEAKELLDEVRKR

SEQ ID NO: 7991 - protein, 59 aa, Artificial Sequence
  Synthetic sequence.
KKLVEDLLREIEKIIKEIEDTTKRVVDELRRLLEEIKRTSDELEKEVRKLLEEIKRATD

SEQ ID NO: 7992 - protein, 60 aa, Artificial Sequence
  Synthetic sequence.
STREALKELIDRLRDLVRRIRDKHRKLLEEIKRVLDESERRHRELIKRVEELLRDLARRV

SEQ ID NO: 7993 - protein, 56 aa, Artificial Sequence
  Synthetic sequence.
VETIIRRAEEALKRLEDSSRKVEETIRKVLEDLRRSSEEVAERVRRVLERLEEKAQ

SEQ ID NO: 7994 - protein, 60 aa, Artificial Sequence
  Synthetic sequence.
SSEERLRKVIEDLKRLAEESRKRHKELIDELRKAVERIERRHKKLLDEIKKVVDDIRRRV

SEQ ID NO: 7995 - protein, 56 aa, Artificial Sequence
  Synthetic sequence.
VDTIIEEVKRVLEELKRSTEEVEKRVRDAIEELERSSEELARRIKEVLKRLEEETR

SEQ ID NO: 7996 - protein, 60 aa, Artificial Sequence
  Synthetic sequence.
SAEEKLDRLRKEVERLSDETRKELERILKKVEDVIRETRRRAKELEEELRRLIRDIEEKL

SEQ ID NO: 7997 - protein, 56 aa, Artificial Sequence
  Synthetic sequence.
IETVIREIERLLEEDRKAVEEILRRIEKLIEDDKRAVDRIVKEIKDILDKLREETR

SEQ ID NO: 7998 - protein, 60 aa, Artificial Sequence
  Synthetic sequence.
DIEDELRKLEEEIRRVIEKWKRLTEENRRENERVIRKWDKLSKDLADEIRRVIEDARRKL

SEQ ID NO: 7999 - protein, 59 aa, Artificial Sequence
  Synthetic sequence.
KELVKELVDRVKRLIREIEKEARRTSEENKDLLKKIEDDAKRSEDELRELIKEIKKRID

SEQ ID NO: 8000 - protein, 60 aa, Artificial Sequence
  Synthetic sequence.
DIEDTLRKLAEDIKKVERDMEESNRRNREKNREVIEKWKKLSDDLERELEEVIEDARRKL

SEQ ID NO: 8001 - protein, 59 aa, Artificial Sequence
  Synthetic sequence.
RELVRKLIEDVRRLIEEIRRENKESSDRNKRLVEEIDERAKRSADELKRLLKEIRDRID

SEQ ID NO: 8002 - protein, 60 aa, Artificial Sequence
  Synthetic sequence.
DIEEALDEVRKEIEEVIRRWKKLTRENEEENRKVIEDIRRRLDELRREIEKVIRDARRKL

SEQ ID NO: 8003 - protein, 59 aa, Artificial Sequence
  Synthetic sequence.
RELVKKLIDDIRKLIDEIRRDAERTSRDNKRLVEEIERTIEKLIREVKELLERIKEEID

SEQ ID NO: 8004 - protein, 60 aa, Artificial Sequence
  Synthetic sequence.
DIEEILKKVEDDAREVIKEMRKSNEDNKRKNKKVIEEIERTLKKIEDDARRVIDEIEKKL

SEQ ID NO: 8005 - protein, 59 aa, Artificial Sequence
  Synthetic sequence.
RELVKKLDDELKELIKKIRTDNKRSSERNDELVKEIRKRIEKLVREAKELLKRIREDID

SEQ ID NO: 8006 - protein, 60 aa, Artificial Sequence
  Synthetic sequence.
SIEETLDELRKKIEEVIRRMKKSNDDNEKENREVIDRIRRTNEEIRKRAERVIEDARRKL

SEQ ID NO: 8007 - protein, 59 aa, Artificial Sequence
  Synthetic sequence.
KERVDKLIREVEDLIRRIEEENKKSSEENKRLVRRIEKDNEDSIRELEKLIEDIRRTID

SEQ ID NO: 8008 - protein, 60 aa, Artificial Sequence
  Synthetic sequence.
SLEELLEKVKREIDKVLERIERIVRKNAKENERVIREDERLLRELVKEIKEVEDRIRKRG

SEQ ID NO: 8009 - protein, 58 aa, Artificial Sequence
  Synthetic sequence.
DLMRKLLEEVKELIKRLEEEIEKASREDRRLVEEAKEKSKELAKRIKEELKRIEDEVR

SEQ ID NO: 8010 - protein, 60 aa, Artificial Sequence
  Synthetic sequence.
DEVDDIIRKLKELIKELREKSKRISEENKRLVRRLEELSRRIIKEIKDLLEELKDRARKD

SEQ ID NO: 8011 - protein, 59 aa, Artificial Sequence
  Synthetic sequence.
EEVKDKLRRIKEEADKAIKDNEDLLRRNERENREAVKRNEELLKEVRREVEEVIRRTRK

SEQ ID NO: 8012 - protein, 60 aa, Artificial Sequence
  Synthetic sequence.
SEVEEVIKRIKKLNKETEDAVREVIKRIEDSNEKLLRDVEELIKKIEKALRDLEDKARRV

SEQ ID NO: 8013 - protein, 59 aa, Artificial Sequence
  Synthetic sequence.
REVEELLRRVKRHTEEVVRRVERELRRIAEHVKEVEKTVRELVRRIREKIREVVERVRK

SEQ ID NO: 8014 - protein, 60 aa, Artificial Sequence
  Synthetic sequence.
DEARELVKELEDLIREITKTVRRLLEESEELIKRIDDAVDDLRRRDEDLNREIKEEIEKR

SEQ ID NO: 8015 - protein, 56 aa, Artificial Sequence
  Synthetic sequence.
ERILRELEERVKELEKEAREILKRSEDETDKLREKAERILEDLERKNRRTMDEARR

SEQ ID NO: 8016 - protein, 60 aa, Artificial Sequence
  Synthetic sequence.
SEVEELVERVKRLIDEIRKRVTDSVEESKRLIKEIKEEVDRLAEEDKRLNERIKETIRRR

SEQ ID NO: 8017 - protein, 56 aa, Artificial Sequence
  Synthetic sequence.
ERIVKKLEEEIRKIIKEIRELNKRSEDETKKIVDEARKILEDLRRENEDTKRKITE

SEQ ID NO: 8018 - protein, 60 aa, Artificial Sequence
  Synthetic sequence.
SEVEDLAKRIEDLIRRILRENERSLEESKRLIDEIRKRIEDLLRRSKELIDRIREEVRER

SEQ ID NO: 8019 - protein, 56 aa, Artificial Sequence
  Synthetic sequence.
KRILDELRKAVKKLEDDSRRLNRESEERTKKLKKELDELLKKSKDETKKLVEDLRT

SEQ ID NO: 8020 - protein, 57 aa, Artificial Sequence
  Synthetic sequence.
SEVEKLLRELEDVIRRLREDVKRIVEEDERLNKRLNDELRRLSEKNDRLNDRIRREV

SEQ ID NO: 8021 - protein, 56 aa, Artificial Sequence
  Synthetic sequence.
KEKVKRLRELVKKVIEDMERILRRLEKANRESAERAKDVLRRNHKKDEDSKRELER

SEQ ID NO: 8022 - protein, 57 aa, Artificial Sequence
  Synthetic sequence.
DRVREIVERVERVIRDILRTVEKLSEENKDLNRRLTEKIRDLERRDRELNKRLRDEV

SEQ ID NO: 8023 - protein, 56 aa, Artificial Sequence
  Synthetic sequence.
KEIVEDLRRKVEKVKRDAEKLLEDNHRRDRRNLREIEKIVEELKRRNEKTLRDLTK

SEQ ID NO: 8024 - protein, 57 aa, Artificial Sequence
  Synthetic sequence.
SEVEKLEEEVKEVIERLLRTVRDLSRRNEELNKRLTEDNERILKEDEDLNEELERRV

SEQ ID NO: 8025 - protein, 56 aa, Artificial Sequence
  Synthetic sequence.
KDVLRKLKKEAEDAIKEAEDILRENHEKDKKNKEDSEKLLRDLERRNEETLRRLRK

SEQ ID NO: 8026 - protein, 59 aa, Artificial Sequence
  Synthetic sequence.
RIEEILETLREELRTVLKKSKEILDELRKENKESIDRSKEILDRLRDEIRRILREIREK

SEQ ID NO: 8027 - protein, 59 aa, Artificial Sequence
  Synthetic sequence.
DEELKRAADKVKKLIKELDEENKKARDDDKRLNKKLNKDNDDLRREVEELLKRLRDEAE

SEQ ID NO: 8028 - protein, 60 aa, Artificial Sequence
  Synthetic sequence.
RIEDLVRDNKRKNDENTKRHERIVERLEEELRELVKRHEEDVRRLRKELEDLKRDAERKG

SEQ ID NO: 8029 - protein, 59 aa, Artificial Sequence
  Synthetic sequence.
DKKVEDLDRDNERLNRELTRHLEDLVRRVKELLRRMEEHLRELAERVKKLLDELRKEAT

SEQ ID NO: 8030 - protein, 60 aa, Artificial Sequence
  Synthetic sequence.
SDVEELAERVRRLSEEHAELVKRIVETSKRLNDDLRRMVKEIADRVRRLLEDIERKVRED

SEQ ID NO: 8031 - protein, 59 aa, Artificial Sequence
  Synthetic sequence.
EDVRKIIEDLRRHLEENRERVERIIRELRRLTEKTKKELEDIARELEKLVDELREEVRR

SEQ ID NO: 8032 - protein, 60 aa, Artificial Sequence
  Synthetic sequence.
SEVEKAEEDIRRLLKEVKDMDKKIVDDDERLNRELERTVRELAKEIEKLIRDLEERVRKE

SEQ ID NO: 8033 - protein, 59 aa, Artificial Sequence
  Synthetic sequence.
KDVKKIIKELEEELEKIAKESEESIKRLRKENRDSEERLRKILEKLKKDLEDVKRELER

SEQ ID NO: 8034 - protein, 60 aa, Artificial Sequence
  Synthetic sequence.
SDVEDVVRKIRELIRENLKRSKEIADENRRLNTENRERSKTLEEEVRRLLEEVKERAERL

SEQ ID NO: 8035 - protein, 59 aa, Artificial Sequence
  Synthetic sequence.
EEVRRILEKLRDDLRKLNETNRRIIKELRERNEKSNRDNRKILEELKDRLKKLEDELRR

SEQ ID NO: 8036 - protein, 56 aa, Artificial Sequence
  Synthetic sequence.
DEVDEVDKRSKETLKKIEDDARRVLEEYERTLEKIKRDVDRVLKESEETVRKLRAD

SEQ ID NO: 8037 - protein, 60 aa, Artificial Sequence
  Synthetic sequence.
EKELEDLVRELEEINKRLEEELRKLVEELRRHLEELRDELRKLVEELRKINEELEDRLTK

SEQ ID NO: 8038 - protein, 59 aa, Artificial Sequence
  Synthetic sequence.
SEMEDLKRVSDEVKKELEDLNRKSAKVSKEVEEEAKRLNRESREVVRRLKEELEKLERD

SEQ ID NO: 8039 - protein, 62 aa, Artificial Sequence
  Synthetic sequence.
KEVADELKKILDTHRKVDKEAKDRSEKLVRDHREVDKDVKRESDEILKRAKDTLDEIRERLR

SEQ ID NO: 8040 - protein, 60 aa, Artificial Sequence
  Synthetic sequence.
SELEKILKEIEEELKRVKERLERLHREHERLLRDVTRKLRKLLRDHREVLERVREELRRR

SEQ ID NO: 8041 - protein, 56 aa, Artificial Sequence
  Synthetic sequence.
REDLERTLRRIKEEVRKVERKAKEVLRETREKLKRLLERAREVLDENKKRLDDVAT

SEQ ID NO: 8042 - protein, 60 aa, Artificial Sequence
  Synthetic sequence.
SLEDIRRRLRELVRRLEEELRRSHEELERLVRDLERRLRESLRKLEELVDRLKKEIEKRG

SEQ ID NO: 8043 - protein, 59 aa, Artificial Sequence
  Synthetic sequence.
DDTARRLLEEAKKELDRIKEENERALRKIKDVIRKIDEESKRLNKEVADLVKKIEDRIR

SEQ ID NO: 8044 - protein, 58 aa, Artificial Sequence
  Synthetic sequence.
DLEDIVREIEKLLRDLERKAREIHERDERLARDLERKHRDIIREIERLLDELRERVER

SEQ ID NO: 8045 - protein, 59 aa, Artificial Sequence
  Synthetic sequence.
RKKVEEELERVRRIIKELERRLRELHKENKKLLDEILEESKRLAEEVRKTIEDIKRKIK

SEQ ID NO: 8046 - protein, 60 aa, Artificial Sequence
  Synthetic sequence.
SEVEDLLRRDRELNREHKRLLEEASKKNKEELERVLEKVKELLERVKKRLDEAKEALERG

SEQ ID NO: 8047 - protein, 59 aa, Artificial Sequence
  Synthetic sequence.
ERLERVLRESRKLNKESHETLKELIDRNRKLNKELEEAVKKIEEEIKKLLKELKEEKDR

SEQ ID NO: 8048 - protein, 60 aa, Artificial Sequence
  Synthetic sequence.
SEVEKLLREDRELNKRHVEKVRELSERNKELLERHEEKLKKVAKEIEDRLRRLEEMLRRG

SEQ ID NO: 8049 - protein, 59 aa, Artificial Sequence
  Synthetic sequence.
DRLKRVEEESEELNKRSHETLRRLVEENKKRNKELHERVERIKRRLEKLLRELEEEIRK

SEQ ID NO: 8050 - protein, 60 aa, Artificial Sequence
  Synthetic sequence.
SEVEELLDEDRKLNEELTKSAKRLTDENKKLLEDMKRKAEELKKRVDELLKEVTDVLRRG

SEQ ID NO: 8051 - protein, 59 aa, Artificial Sequence
  Synthetic sequence.
DRLERVLRESRKLNEDSKKRLEELIKENKDDNDRLREDLERIVRELEKRLDKLRKDTET

SEQ ID NO: 8052 - protein, 61 aa, Artificial Sequence
  Synthetic sequence.
KELEDLLRRIKRLIDENRRLSKEVLEEVRKLSEKHKKEVEDILKEIKELIEEALRRIERDG

SEQ ID NO: 8053 - protein, 60 aa, Artificial Sequence
  Synthetic sequence.
KERLDRILKTLRELLRKLREDNERIRREIREIVKRNSDELARIEEELRKLLDDLAKKAEE

SEQ ID NO: 8054 - protein, 61 aa, Artificial Sequence
  Synthetic sequence.
KELEDVLKEVEELSRRHKRRAERVSEENRKLLRRLKEEARKILEDIRRLLKKLEERVRRDG

SEQ ID NO: 8055 - protein, 60 aa, Artificial Sequence
  Synthetic sequence.
RERLKRILDEIRRIVEKNKRDLERLLRENEELNKRLREELRRILEEIEELLRELEERLRK

SEQ ID NO: 8056 - protein, 59 aa, Artificial Sequence
  Synthetic sequence.
SEAEEALKELKETSDRHKEDLDRLHEEDRRTNEEVEKELRKLVDEAKKKLDRVREIVEE

SEQ ID NO: 8057 - protein, 56 aa, Artificial Sequence
  Synthetic sequence.
EELLRRLEEIVRDNKRRVEEILERNRRLNEESEKKVRDIIKKLRDDLERLARELEK

SEQ ID NO: 8058 - protein, 59 aa, Artificial Sequence
  Synthetic sequence.
SEAEEALKELKRTSDEHRKRLEDLHRRDKKLNDDSKRRLDELLKRDEDTNRTVLDIARQ

SEQ ID NO: 8059 - protein, 56 aa, Artificial Sequence
  Synthetic sequence.
EELLRTLEKIVEDNAREVTEIIKKNRKLNDDSRREHERINDESRRLNEETEKRLRD

SEQ ID NO: 8060 - protein, 57 aa, Artificial Sequence
  Synthetic sequence.
DELEEILRRVDELIKTIEEELKKIEKRVKELLETHRELNKRLLDDHRRLAEEVKKAN

SEQ ID NO: 8061 - protein, 60 aa, Artificial Sequence
  Synthetic sequence.
RDRVEDVLRKIAEKIKRLEDRIKEVLDKLRKLAKELEDESRKVLDDSNKLIERVKRELKR

SEQ ID NO: 8062 - protein, 60 aa, Artificial Sequence
  Synthetic sequence.
DTERVVTEIKKTNDELKRRHEKVVEDDRRLLEELRRRHERVVREVERLLRELKERVDRRA

SEQ ID NO: 8063 - protein, 59 aa, Artificial Sequence
  Synthetic sequence.
REVLKKLLDDNRKIIEDLTRKNEKLHEDSKRIIEKIDDENREILRRVEEIVRRIEEELN

SEQ ID NO: 8064 - protein, 55 aa, Artificial Sequence
  Synthetic sequence.
SAEDVKRRIKESADRIRKRLREALERAKKLHTDNEEENKRVNDEIKKRVEEIRRR

SEQ ID NO: 8065 - protein, 59 aa, Artificial Sequence
  Synthetic sequence.
EKLLRELERDVRRLEREITEVVKRLEDEHKRASERNKRLLEEIKDRVRKLIEEAEERRK

SEQ ID NO: 8066 - protein, 60 aa, Artificial Sequence
  Synthetic sequence.
EEVERVRRTIDELSKENEKALKEVEERIKKLSDENEKAVRKAEEDNERLNRTAERLKRSN

SEQ ID NO: 8067 - protein, 56 aa, Artificial Sequence
  Synthetic sequence.
EKVLRDIRKKIKENHEKNERVIREIERLLKENEERNEEVIRRIKESNRKTEKDLTD

SEQ ID NO: 8068 - protein, 60 aa, Artificial Sequence
  Synthetic sequence.
SEVEEVERRIDRLSKENRRVLEEAKRRIKKLSDENKRMLEEARKRNEKLNREVKKLKKSN

SEQ ID NO: 8069 - protein, 56 aa, Artificial Sequence
  Synthetic sequence.
EKVLRDIREKAKRNHDANEKVIREIRDILRRNNEENKRVIEEIDKSNKDTEDELRK

SEQ ID NO: 8070 - protein, 59 aa, Artificial Sequence
  Synthetic sequence.
REVEEVKKEIKKLSDENKEVLERARKRIEDLSRENEDVLRRLKERNEDLNRRVRELKER

SEQ ID NO: 8071 - protein, 56 aa, Artificial Sequence
  Synthetic sequence.
EEVLRDIRRELKENHDENRKVIEDVRRIAEENHRRNKRVIDEIRRSNKETVDELRK

SEQ ID NO: 8072 - protein, 59 aa, Artificial Sequence
  Synthetic sequence.
RAEELRKEIEEIIKKNKKENEDVLREDRRRLKELKEEIEKVVREDRRTLEELEERLRRS

SEQ ID NO: 8073 - protein, 59 aa, Artificial Sequence
  Synthetic sequence.
EEVLKEIRERVEKLSEKNKRALEKWKRDSERLSREVERELEEWKKRSKRLAEEVEEATR

SEQ ID NO: 8074 - protein, 61 aa, Artificial Sequence
  Synthetic sequence.
DLEELEREVEKKLKELEDRVRKVIEESKTELKKLEEELRENSREVRDILRRLEEDVRRKVK

SEQ ID NO: 8075 - protein, 59 aa, Artificial Sequence
  Synthetic sequence.
KRLLEELRRRLDRVRKEVERLIKEHRETTDELRKRVEKLSEDHRREVEKLAKTVKDELK

SEQ ID NO: 8076 - protein, 61 aa, Artificial Sequence
  Synthetic sequence.
SRAEKIREDIRRLRKENEDRIKEIEDEFRKLLEEHERKNKEIEERVRRLVKRIEDEIRRKN

SEQ ID NO: 8077 - protein, 55 aa, Artificial Sequence
  Synthetic sequence.
DELAKRVREVSEDVNRRLDKIMKDLRRVIKELDEESKRLLEEIKRRMEEILEELR

SEQ ID NO: 8078 - protein, 60 aa, Artificial Sequence
  Synthetic sequence.
SEEEKLAKDNERLVREHEEESKKLLKTIRDLSEEHKRDLKRAMEENKEKVDRLRDMLKRG

SEQ ID NO: 8079 - protein, 55 aa, Artificial Sequence
  Synthetic sequence.
EEIATKSEELHKELEETNERIAREVEKLEKENDEILEEIADRSRRLHEDLDRERK

SEQ ID NO: 8080 - protein, 61 aa, Artificial Sequence
  Synthetic sequence.
DELEEVLRTIEKLVEDHNRELERVLRRVKELADRHREESERVAREIKKLVDDARRLVEERG

SEQ ID NO: 8081 - protein, 58 aa, Artificial Sequence
  Synthetic sequence.
DEVRRIRERVKELLDRNRERLERIEREIDRLLEDLKRKNEKIEREVRRLLAKLKEEAR

SEQ ID NO: 8082 - protein, 61 aa, Artificial Sequence
  Synthetic sequence.
SELEKIVEENRRLVKEHNERLKRILDELRELAKRHEDRSRKAMKENEELVRTVLELMKRDG

SEQ ID NO: 8083 - protein, 58 aa, Artificial Sequence
  Synthetic sequence.
EKVRKIREESKRLHETNRRRVEKIEEEIRRLLKRLEDTNRDIERRSKKLHEDLEREAR

SEQ ID NO: 8084 - protein, 61 aa, Artificial Sequence
  Synthetic sequence.
SELDKVMRDNDRLVKEHAEVSKELLDRLKKLAEDHKKRSEEVLRENKRLVDEVRRLAKERG

SEQ ID NO: 8085 - protein, 58 aa, Artificial Sequence
  Synthetic sequence.
EKVRKIARRSDDLHRELKERNDRIKREIERLLEELKRTNDKIVEDSKRLHDDLEREAR

SEQ ID NO: 8086 - protein, 61 aa, Artificial Sequence
  Synthetic sequence.
DELEEIRKTIEELSKENKKKLEEVMKEVEELARRHEKRSRDLLRRLKKLVDELRDRVEKTG

SEQ ID NO: 8087 - protein, 58 aa, Artificial Sequence
  Synthetic sequence.
ERVRKISEDVRKLLEDNKRIAERIDERIKELLKRLEDTNRRIEEEIDRLLEELKREAD

SEQ ID NO: 8088 - protein, 57 aa, Artificial Sequence
  Synthetic sequence.
DELDDLLRRAKETSDRHKETLKKILDEMREEVKRHNRDLERILEEVKRLIDEVRKAN

SEQ ID NO: 8089 - protein, 59 aa, Artificial Sequence
  Synthetic sequence.
REDVKRIKETMKKLLDENRTEVEKIKREADRLLEENRRLVKEIEDTIRELLKRLEDERR

SEQ ID NO: 8090 - protein, 60 aa, Artificial Sequence
  Synthetic sequence.
SKKETIKKDAEEALKRSKKKLDELKERLRKVMRETEERLRRLEKELRDLAREIREKIKKR

SEQ ID NO: 8091 - protein, 55 aa, Artificial Sequence
  Synthetic sequence.
DRLRKEVEDLNRETDKVIEKLREDIDRLDKESEEVIRRLKDEIRRLFEEIDRRLR

SEQ ID NO: 8092 - protein, 61 aa, Artificial Sequence
  Synthetic sequence.
SELEEVKERVDRLIREVEKMNRDSERRVKKLIDDVRRENRRTEEDVRRLVKRAEEIVRKDG

SEQ ID NO: 8093 - protein, 59 aa, Artificial Sequence
  Synthetic sequence.
KEKVDRLKKEADDLLRKIKEDNERITEKVKELLERLRKNNEEIKREADRLLEELRRRVK

SEQ ID NO: 8094 - protein, 57 aa, Artificial Sequence
  Synthetic sequence.
SELEELDKRITELSEEIKRRLEELLRRNEDLSRRIEEAIRRILKRNEDVIRDIKRKN

SEQ ID NO: 8095 - protein, 58 aa, Artificial Sequence
  Synthetic sequence.
KKVRDIEEKIERLNRELEKIAKEIRERTERLNKRLEELIREVDERNRDLLRRLEEEVK

SEQ ID NO: 8096 - protein, 60 aa, Artificial Sequence
  Synthetic sequence.
KDEEDARRKLEELRELARRDIERNKRELERLRREIEKDEEDNEEVIKRLRERVEELRRRQ

SEQ ID NO: 8097 - protein, 58 aa, Artificial Sequence
  Synthetic sequence.
ESLKRLKEELEKLLRDYKKKLDDSDKELRDLLAEYDDRLTRSDKRLRDLLKEAREKSK

SEQ ID NO: 8098 - protein, 61 aa, Artificial Sequence
  Synthetic sequence.
DTAERAEEELERSDRELKETLRRAEEELKRSHKELERIVERARRELRRLAEELEEVIRRKK

SEQ ID NO: 8099 - protein, 60 aa, Artificial Sequence
  Synthetic sequence.
EETLRRKLERLLERHKKVVDDVERTLRDLLERHKEVVERVREKLTDLLRKLKKVIDDVRR

SEQ ID NO: 8100 - protein, 58 aa, Artificial Sequence
  Synthetic sequence.
SELETIKKRAEELSKESEDILRDIERKLRKLSEESKDILRRLKEELEKLHKELVDKKG

SEQ ID NO: 8101 - protein, 59 aa, Artificial Sequence
  Synthetic sequence.
EELEKELEEVLTEYREVVERLADELRRLLKKYEDDVRRLEEHARRDLEKLDRDIKEEER

SEQ ID NO: 8102 - protein, 57 aa, Artificial Sequence
  Synthetic sequence.
SKLDDLLRKIERLVTESLRRLRKTNEDAKRLLERSVRELEKSNKEIRDLVKEIKERN

SEQ ID NO: 8103 - protein, 59 aa, Artificial Sequence
  Synthetic sequence.
KKKVDELRERLRELLKRHRDAVEKNRRDLEKLREDHRRLVEKNKRDLDKLKEELDRTKK

SEQ ID NO: 8104 - protein, 57 aa, Artificial Sequence
  Synthetic sequence.
SELDELLKRLEELVREIIKRLRDSNRRAKEVVDRSVKRLEESNRTLRELIKDVKDKN

SEQ ID NO: 8105 - protein, 59 aa, Artificial Sequence
  Synthetic sequence.
EEKLRRIKRRIDELEKTLRKIIKDNTDNLRKLTEDHRRLVEKNKRDLEKLEEELKRRRK

SEQ ID NO: 8106 - protein, 57 aa, Artificial Sequence
  Synthetic sequence.
SKLDELLERIREEVKRSVKRLEDSNKEIKRLMEESADELRRSNKELRDAVRDLKRKN

SEQ ID NO: 8107 - protein, 59 aa, Artificial Sequence
  Synthetic sequence.
EEKVRRLDKVLEDLRREHEKIVRDNEENLRRLLERHKRLVDKNKEDAERLLRELRETVR

SEQ ID NO: 8108 - protein, 59 aa, Artificial Sequence
  Synthetic sequence.
SELEELLKRLRDLIERIVKRLRELSKESEDLIRRIERTIEKLSEDSERAIEEILRRIDK

SEQ ID NO: 8109 - protein, 59 aa, Artificial Sequence
  Synthetic sequence.
EDRLREVEEEAKKLEKRIEDMIRKHKETNKRLKEELDKLVKEHKDRNRKLLEELKKRAT

SEQ ID NO: 8110 - protein, 61 aa, Artificial Sequence
  Synthetic sequence.
SEIEEVIERLDDTMRRIEERIRDTNRRLKKVIDDSKRRNERTNREVRKTIEKLTRELERDG

SEQ ID NO: 8111 - protein, 54 aa, Artificial Sequence
  Synthetic sequence.
EVKRRLEELRRRIEKMLEEHRESLRRLEEELEESHKRHKDTLRKLSKELEEKLK

SEQ ID NO: 8112 - protein, 61 aa, Artificial Sequence
  Synthetic sequence.
DEVDEVLKRVDELLKRHEETNKRLEEEIRKIHEENKRTIEELLKEVRKRAEEVERLVRRDG

SEQ ID NO: 8113 - protein, 59 aa, Artificial Sequence
  Synthetic sequence.
EEELKRVKERLKEIRKRAKESHDRLRETVKELIDRNRKLLRELEEELRKIEEKIREDAR

SEQ ID NO: 8114 - protein, 56 aa, Artificial Sequence
  Synthetic sequence.
SEEDELRETAKRIREEVKKSIEENRELAKRITDEVRELLERNKRRIEEVKERLERS

SEQ ID NO: 8115 - protein, 56 aa, Artificial Sequence
  Synthetic sequence.
EDDLRRRLEELLKRLRDESRKVNEDLKRLVDELRRLSKEMNEELKELEDRVREKER

SEQ ID NO: 8116 - protein, 57 aa, Artificial Sequence
  Synthetic sequence.
SEEDEVREDNKRIVEEVERLLKEIEDNNREITREAEELLKRLEEEARRLMEEIRRSK

SEQ ID NO: 8117 - protein, 60 aa, Artificial Sequence
  Synthetic sequence.
DEELLRRLRDMNRRSKERADRLIEEAKKENDRSSKRVRDLIREVDEILKEVKKRVEDVTT

SEQ ID NO: 8118 - protein, 56 aa, Artificial Sequence
  Synthetic sequence.
SEAEKVVEELKKLLREVEKKIRDHTEDVKRILEELERRLRKHSEEVRRTAKELKDK

SEQ ID NO: 8119 - protein, 59 aa, Artificial Sequence
  Synthetic sequence.
EKVLRELEKILEDIKRTLDKLLRENRETLKRIEDRLRELLEENRKLLEKIERELRERSR

SEQ ID NO: 8120 - protein, 56 aa, Artificial Sequence
  Synthetic sequence.
SEVEDVIRKLRRKAEDLTRRLKEHTDDVKRLMEELSKDIKDHTREVKRIAREAKEK

SEQ ID NO: 8121 - protein, 59 aa, Artificial Sequence
  Synthetic sequence.
EEVLRDLERVLRDIERRLRELLRRNEEVLDRIRRTLEDLHRKNEEVLREIERDLRERER

SEQ ID NO: 8122 - protein, 56 aa, Artificial Sequence
  Synthetic sequence.
SEVEDVIRRLKKKLRELVERIREHTKRVRDLARKLEEEIKRHTEEVKRIADEAKKR

SEQ ID NO: 8123 - protein, 59 aa, Artificial Sequence
  Synthetic sequence.
DELLKRLEDVLRKIRKDLEELLRKNNRDLEEIKKRLEELHRRNRETLERIRKDLEEDER

SEQ ID NO: 8124 - protein, 61 aa, Artificial Sequence
  Synthetic sequence.
SEIEEVLERIKKLLDELRKESRKLLEDHKKRAEELEEKARRLSERHKELLDRLKEVVDRDG

SEQ ID NO: 8125 - protein, 59 aa, Artificial Sequence
  Synthetic sequence.
EEMLKRAEDLLRRIDEELKRSHEELKELSDRIRERLERLLRTLEELSKEIDKRADDLRK

SEQ ID NO: 8126 - protein, 61 aa, Artificial Sequence
  Synthetic sequence.
SEIERVLEELRKLLEELRRESKKLLDELRKLLEDARRESEKLLRELKDLLRRAEELVKRDG

SEQ ID NO: 8127 - protein, 59 aa, Artificial Sequence
  Synthetic sequence.
EKVLDELRRELDKIREDLKKSHRELEELIKKIRTELDKSNRKLEELLKRIEERLDEMRR

SEQ ID NO: 8128 - protein, 61 aa, Artificial Sequence
  Synthetic sequence.
SEAEKVLEELKKLLRDLEETSKRVLREIRELLKEAREKSKRLLDRLRKLARDLKELVRRDG

SEQ ID NO: 8129 - protein, 59 aa, Artificial Sequence
  Synthetic sequence.
KEVLDRIKRLLEEIERELERSNKELEDLLRKIEEDLERSHRELEKLIREILKELEDARK

SEQ ID NO: 8130 - protein, 57 aa, Artificial Sequence
  Synthetic sequence.
DAEERLRKLLDDIRRELKRLTEETRKSLEKIKRDNDELEKKLRKLNEDSDRRLKEAN

SEQ ID NO: 8131 - protein, 59 aa, Artificial Sequence
  Synthetic sequence.
EKTIEDLLRELEKALRDLEKEVREINKELKRVLDEIAKTHEDLLKKHEELLRRVEERAR

SEQ ID NO: 8132 - protein, 57 aa, Artificial Sequence
  Synthetic sequence.
DLERELEKLLKDIKEELDKLIRTNEETLKEIEREVRKLLKRNKELLDRIREEVRKTG

SEQ ID NO: 8133 - protein, 59 aa, Artificial Sequence
  Synthetic sequence.
KEVVDRILKEARELLERIREENRRTLEDLRRILEDLRRRNKRHLDELRRVLKELRDKRK

SEQ ID NO: 8134 - protein, 56 aa, Artificial Sequence
  Synthetic sequence.
SLEERLEKLLKEIRETVKKNIEENRDLLRRVEEDLRRLTERNKRLLEKIRDALRKA

SEQ ID NO: 8135 - protein, 59 aa, Artificial Sequence
  Synthetic sequence.
EEVARRLMDDLRRLLEKIDRLSREHLERVRKILEDLRRLSEKHLKELEDLLREAEEEAR

SEQ ID NO: 8136 - protein, 56 aa, Artificial Sequence
  Synthetic sequence.
SLEERLEELLDEIRKMLKRLEDENRRLLKEIEKRVRENTRTNRELLKRIEDRIRKA

SEQ ID NO: 8137 - protein, 59 aa, Artificial Sequence
  Synthetic sequence.
EEVVRTLLRELEKILAEAEDLSRRHLERLRDILREAEDLSRKHLEELKKVLEELERRAK

SEQ ID NO: 8138 - protein, 57 aa, Artificial Sequence
  Synthetic sequence.
SDVERLLRELEDLLRRLEERIRELNKRHEELVRRLKEEVKRLSREHNEVVADVARKN

SEQ ID NO: 8139 - protein, 59 aa, Artificial Sequence
  Synthetic sequence.
KELRDRLRDVVRRLEDELRRLDDELRKNSEEVKKVLDDLRRHLEENSKRAEDTLRELRR

SEQ ID NO: 8140 - protein, 57 aa, Artificial Sequence
  Synthetic sequence.
SEVEKLLRELEKALEDLRRTNEKLDREHDAVVKEVKKIAKDLSREHRDVVEDVKRKN

SEQ ID NO: 8141 - protein, 59 aa, Artificial Sequence
  Synthetic sequence.
EELRDELRRVVEDVEKKLDDLRKRNEENSRKVKEVLEKLTRELDKNREEVERTLEELRR

SEQ ID NO: 8142 - protein, 57 aa, Artificial Sequence
  Synthetic sequence.
SEIEKLLEEIKESLERLKKTAEDLLEELRRLLEELERRVKELSDEHRRLVKELKDRN

SEQ ID NO: 8143 - protein, 59 aa, Artificial Sequence
  Synthetic sequence.
EELKKRVEDVLREIKRAHDDLRRRLEKILRDIEKTIEDLERHMKENHDDAERVIEELKR

SEQ ID NO: 8144 - protein, 60 aa, Artificial Sequence
  Synthetic sequence.
SEEEALERVLRELRRSLEELEEELRRAIRKLEDNLRRLREALETILKKLDDLLDDLRRRK

SEQ ID NO: 8145 - protein, 55 aa, Artificial Sequence
  Synthetic sequence.
DKLKKEADDLDRRSRKTIKEVLDEIKELDDRSNERIEEVIREIEDEARRLAREVD

SEQ ID NO: 8146 - protein, 60 aa, Artificial Sequence
  Synthetic sequence.
SEEERLREIRERLKKSLEDLKRELEEILRELERSLDKLRRDLERLLEDLRRLLDELRRRK

SEQ ID NO: 8147 - protein, 55 aa, Artificial Sequence
  Synthetic sequence.
EELEKKARELNERSKEKIKRLLEKLRKLDKESKDEIKRVLDKLRELAKRIKEEMD

SEQ ID NO: 8148 - protein, 60 aa, Artificial Sequence
  Synthetic sequence.
SEEERLRRVIEEYKRVLDELSERLKRLLDELRRSLKKLEEDLKRLLDELKRTLDELIRRV

SEQ ID NO: 8149 - protein, 55 aa, Artificial Sequence
  Synthetic sequence.
EELEKKLREALDTVRRLYEALIKKARELDKRSKDEIKRVVDKLKKLVRDIEERVR

SEQ ID NO: 8150 - protein, 60 aa, Artificial Sequence
  Synthetic sequence.
DDIEDVLRRIEKLIRDLRDHSRKLVEEIEKLIEDHTRHSRKLERDIKELLKRLRELRRRG

SEQ ID NO: 8151 - protein, 59 aa, Artificial Sequence
  Synthetic sequence.
EEVKKRLDEARRKAEKVVKESRDTLRELKDKVRENLDRSRKELKKLEEELEEVLREARE

SEQ ID NO: 8152 - protein, 60 aa, Artificial Sequence
  Synthetic sequence.
SDVERVAKTIEDLIREHTEHVKRSAERVERLIKEHTDHVRRSLTRIEDLLRRLEEMRRRG

SEQ ID NO: 8153 - protein, 59 aa, Artificial Sequence
  Synthetic sequence.
EDVERKARELERKVRENVRKVRDDHRKLEEKFRDNLRKVKREHEEAERKMRDLLREARR

SEQ ID NO: 8154 - protein, 60 aa, Artificial Sequence
  Synthetic sequence.
KDVDKVEEDIERLLADLRRHNEKLHRDIERLLEELRRHNDKLRKTLEDLLKKLKELAERG

SEQ ID NO: 8155 - protein, 59 aa, Artificial Sequence
  Synthetic sequence.
EDVKRRLEDLERKARRVLEESRKDLEEAKKKVDELMKRARDSLRELTRRLEELVRRIRK

SEQ ID NO: 8156 - protein, 60 aa, Artificial Sequence
  Synthetic sequence.
SEVEEVMKEIERLIEELRRHNEELARRLEELIKDHTRHNEELHKTIEDLIKELEDLARRG

SEQ ID NO: 8157 - protein, 59 aa, Artificial Sequence
  Synthetic sequence.
EEVEKRLRELKEKLDKVLDELRETLKRLEEKARENLKRSRDDLETIKRKLKKVMDEARR

SEQ ID NO: 8158 - protein, 59 aa, Artificial Sequence
  Synthetic sequence.
SDVERLIEELERLLDELRKKTEEIIRRIKKLIDELRRKTEEVIKRLEKLARDLTRLTER

SEQ ID NO: 8159 - protein, 59 aa, Artificial Sequence
  Synthetic sequence.
EEARRRIDEIRKKAEEVNKESRDRLRRLKEEVDKVDKDSKRRLDELREELRRLMEESKR

SEQ ID NO: 8160 - protein, 60 aa, Artificial Sequence
  Synthetic sequence.
DAARELRERLKKAIEDHRRLLERAARDVERLNKELEDILRRMAEDMKRSIEELKRVSEEG

SEQ ID NO: 8161 - protein, 56 aa, Artificial Sequence
  Synthetic sequence.
EKDLRRLEEEIRKEIRRSNETLKKLKKKTEDSLRTIKRRLEELHEEAKKVLDDLRR

SEQ ID NO: 8162 - protein, 59 aa, Artificial Sequence
  Synthetic sequence.
REDETLKRLEEENEEVNKRSEETLRKLLEDNRRLLERIEERLRELLEELRRLLEKIRKD

SEQ ID NO: 8163 - protein, 56 aa, Artificial Sequence
  Synthetic sequence.
KDELTERVKRHIEENKKLTEDVARKSEKHLRDLEELLERLRKLVEDLLRRLEEEAR

SEQ ID NO: 8164 - protein, 59 aa, Artificial Sequence
  Synthetic sequence.
SELEKVRKESERNLRSNEKLLRELDELSERNLDKLRRFVEEVRELVREMLERLDSVRRR

SEQ ID NO: 8165 - protein, 59 aa, Artificial Sequence
  Synthetic sequence.
EEVKRDVERNEKENKELLDRTRRKVEENAKRNKKLLEDIREDLKRLATELRRKLEEIRR

SEQ ID NO: 8166 - protein, 61 aa, Artificial Sequence
  Synthetic sequence.
DKEETVKDLERRYRDLLREIEKRLRELVRRNDKLLEEIKKAIEDLIRENEKKIKEIKERRG

SEQ ID NO: 8167 - protein, 55 aa, Artificial Sequence
  Synthetic sequence.
DELRRRAEEALERNKRLLEELKKENDDHLKRLKELLEELKKRNEDHLRRLDEEER

SEQ ID NO: 8168 - protein, 59 aa, Artificial Sequence
  Synthetic sequence.
KELEEIKRAVDESLKRAKELMDRHRREVEKSLEEMKRLAEDHKRRADRLLKELKRLADE

SEQ ID NO: 8169 - protein, 59 aa, Artificial Sequence
  Synthetic sequence.
DEVRRAVKELKDRHKELLDRIERESERLREEHRRLLEKIERTSEDLIRRLEKLIRDIRR

SEQ ID NO: 8170 - protein, 59 aa, Artificial Sequence
  Synthetic sequence.
DEVETVEEEVKKSLEELRDLARKHEKKVRESLKRLEESLRRSEEKVKDIIRRLEELKKR

SEQ ID NO: 8171 - protein, 59 aa, Artificial Sequence
  Synthetic sequence.
EEVKKRLEDLRKEHEDTLRDIERRSRELLKRHKDKVDEIRKAHERLIRELEEIARRIKK

SEQ ID NO: 8172 - protein, 59 aa, Artificial Sequence
  Synthetic sequence.
SEEEELKKKLEKSLDELRRSLKKSAEDVRRILEELKELMKRHKEVVEEIARELDELRKR

SEQ ID NO: 8173 - protein, 59 aa, Artificial Sequence
  Synthetic sequence.
EDVERSLRDLRRKHKELVDRIDEEHKRLEKELRDIIEEIERRSRKLLKELEDIIRETRR

SEQ ID NO: 8174 - protein, 59 aa, Artificial Sequence
  Synthetic sequence.
SLEEELKRVMKEVRDLAKEHSDRSRDVMREIRELSEENERRLRRVLEEAKRLADDLRRD

SEQ ID NO: 8175 - protein, 59 aa, Artificial Sequence
  Synthetic sequence.
ERLKDILRRIREDIERLLDELRKLNEKIKRDVDRLLKENKETLDDIERRIRKLLDDERR

SEQ ID NO: 8176 - protein, 60 aa, Artificial Sequence
  Synthetic sequence.
SVEELITRVERENERVARRDEELLRENEKRNRDVTREDRDLLKKLKEEVEEVLKRIREEG

SEQ ID NO: 8177 - protein, 59 aa, Artificial Sequence
  Synthetic sequence.
EETVKELVKHNEDLLRKWEKKSEDLSRKNEEALERWRRKSKKLAEELKKTLEDIRREVT

SEQ ID NO: 8178 - protein, 60 aa, Artificial Sequence
  Synthetic sequence.
DVEDKIRRLKERIKEVTERDRKLLEELKREAEEVLRRDKKSLEEVEREIEEILKDAERKG

SEQ ID NO: 8179 - protein, 55 aa, Artificial Sequence
  Synthetic sequence.
DELIREVEKVLEDWKRKVDELNRRLKKVLKEWEDTVRKLNEELKDVLDKLREELD

SEQ ID NO: 8180 - protein, 56 aa, Artificial Sequence
  Synthetic sequence.
DMEDKLRKIKEAIKKVLDEIRKLLEDIRRRLKRVREEIEEIHKRNEEENDRVKKEL

SEQ ID NO: 8181 - protein, 55 aa, Artificial Sequence
  Synthetic sequence.
DELIKKIRELLEELKDELRKLLEEAEEVLERLKRSVEELSRRNKKLVEDLDRKTR

SEQ ID NO: 8182 - protein, 56 aa, Artificial Sequence
  Synthetic sequence.
SVEEKARDILEKLKRVVEKIKEIADRNRRENEDADREIKRLIEENKKRNEDLLRRL

SEQ ID NO: 8183 - protein, 55 aa, Artificial Sequence
  Synthetic sequence.
DELIKRIKEIIETLEKEVEDLSRENKKKVEEILDKVRKVSTRNREKLDELDKKVR

SEQ ID NO: 8184 - protein, 61 aa, Artificial Sequence
  Synthetic sequence.
SDEEILRELEKRLEENVRRVEKRHEELEREVRDNLRRAEEKHRELEERVKRVIEEVIRTKG

SEQ ID NO: 8185 - protein, 59 aa, Artificial Sequence
  Synthetic sequence.
EEMVRKLVEDVDRLITDHTRSLEDVDRKVKDVIRRHTDSLRKVEEDVKRIIEELRKKAE

SEQ ID NO: 8186 - protein, 61 aa, Artificial Sequence
  Synthetic sequence.
DDEEILKKLREDVERVIKKIEDSLRELRKRLKDNVDRAEELHRRLEERAKKLIDEIIKKRG

SEQ ID NO: 8187 - protein, 59 aa, Artificial Sequence
  Synthetic sequence.
REFVRRLAERVKKLLKELEDRLRELEERVKEVITRHTRSLEEIVRRVERVLEEMERAAK

SEQ ID NO: 8188 - protein, 60 aa, Artificial Sequence
  Synthetic sequence.
SETEEAKKEIDEIIKRIEEETKRLRETYKRIIEEIERVSKRLEDEYRKLIEELERAKREG

SEQ ID NO: 8189 - protein, 55 aa, Artificial Sequence
  Synthetic sequence.
EELDKLRRRLEEILKRHEESNKKLSEDLERILEEHRRENERLHRELREILERLRR

SEQ ID NO: 8190 - protein, 56 aa, Artificial Sequence
  Synthetic sequence.
SIEDILRELEKELRESSKRSREILERLREELRDSSRRSEEILERLKRKVKRVKEEI

SEQ ID NO: 8191 - protein, 59 aa, Artificial Sequence
  Synthetic sequence.
DKRVREVAERLRRLNERYNREVKRLEKEARRLNEEYNRLVERLAREVEKLIRDLKEEAR

SEQ ID NO: 8192 - protein, 59 aa, Artificial Sequence
  Synthetic sequence.
SLEDLVREIRKRLDDMEREVKKVDDESRKRLDEARKRVEKINRESEKRLKEVADELSEL

SEQ ID NO: 8193 - protein, 59 aa, Artificial Sequence
  Synthetic sequence.
EKLARDLRREVRKLEKRLEELLKELKETTEKILRELERLLKKLEDDTRRVLEEIKELKR

SEQ ID NO: 8194 - protein, 58 aa, Artificial Sequence
  Synthetic sequence.
DEEREVKRKYREDLDDIRRHSEEVLKRYDEAVKKLDEDLKKVVEEYERALEEIVRRAG

SEQ ID NO: 8195 - protein, 56 aa, Artificial Sequence
  Synthetic sequence.
EEMSKDLERELRRSRRENERLAKELEDALRKSEEDIRRLVEENKERLERLERELSR

SEQ ID NO: 8196 - protein, 61 aa, Artificial Sequence
  Synthetic sequence.
SEAEKVEEEVKELVKRNREKHDEIRRRIEKLKEDLKRTSERSERKIKRLVEKIDDTLRKKG

SEQ ID NO: 8197 - protein, 59 aa, Artificial Sequence
  Synthetic sequence.
EDELKRMADTIRDEIRKDNERLRRTLEKAKREADEYRERDKRKLEDFEREIRRIEEETR

SEQ ID NO: 8198 - protein, 56 aa, Artificial Sequence
  Synthetic sequence.
DEREEIEKTIRELMRENDDLVRKIRREIEESLRENRRTLEKIKKEIEELTRKAKRD

SEQ ID NO: 8199 - protein, 59 aa, Artificial Sequence
  Synthetic sequence.
EETLRKRLEEVKRKSDEHKKELEERLREVRRRSERVNEELKKTLEEVRKKIRELIERDR

SEQ ID NO: 8200 - protein, 59 aa, Artificial Sequence
  Synthetic sequence.
SEEEVARRVEERVEELDRRLREIVKDLRDHNRRMKEKLEEAVERVRRRDKELDDILRET

SEQ ID NO: 8201 - protein, 55 aa, Artificial Sequence
  Synthetic sequence.
EELRKKLEDLRRKIDEKVKKVTKEHRDSAKKIRDDVRRVKEENKKANRELAEKRR

SEQ ID NO: 8202 - protein, 58 aa, Artificial Sequence
  Synthetic sequence.
SREEEVEEEYERLLEEIRRRVKEVEKEYRDLLKKIEDDVREVRKEYEKLVEDLSRKAG

SEQ ID NO: 8203 - protein, 56 aa, Artificial Sequence
  Synthetic sequence.
EDASRRLRDIARRSREELEEEVKRLRTEIEKSERELRETTKENRKIIEDVRRRLEK

SEQ ID NO: 8204 - protein, 58 aa, Artificial Sequence
  Synthetic sequence.
SEKEEVEREYRELLKEIEKRIDEVIKEYRDLLRDIRREVKRVLREYAELVKELKKTTG

SEQ ID NO: 8205 - protein, 56 aa, Artificial Sequence
  Synthetic sequence.
DEAARELRKKAEDSKRELEKLEEENRRIIKRSRERLKKIEEDNRRIIKEVLDRARK

SEQ ID NO: 8206 - protein, 59 aa, Artificial Sequence
  Synthetic sequence.
SKEELVKKARDELRRVLEELKRAVDELRKRDEDYERKSEDVVRRLRKIDKDVREVLRRG

SEQ ID NO: 8207 - protein, 55 aa, Artificial Sequence
  Synthetic sequence.
EEVEEEIRREAKRIDDELEKVEEENKRTLDRAKKHNEEVEKENRDTLREIDKERE

SEQ ID NO: 8208 - protein, 62 aa, Artificial Sequence
  Synthetic sequence.
SIEEEAKEIIDKVRKEVEDIVRRLKETNDEVRERLERILRRLEEVDEEAKRRVEELRERKRT

SEQ ID NO: 8209 - protein, 55 aa, Artificial Sequence
  Synthetic sequence.
DRLREELEKLARDVERRTRELEKHHRELMKRAKEETERLERHHDELAKRVREKLK

SEQ ID NO: 8210 - protein, 60 aa, Artificial Sequence
  Synthetic sequence.
DEIETVLDEVRRLHEDAKRRLEEMIDEVRKLNEESVRELARVVEEVERLLRTVKEEVERA

SEQ ID NO: 8211 - protein, 56 aa, Artificial Sequence
  Synthetic sequence.
AREALKESRKVVEESRESVRRVLEKNRRVVEESKRLAEELLRRVKKVVDEIRKRVE

SEQ ID NO: 8212 - protein, 60 aa, Artificial Sequence
  Synthetic sequence.
DELEEVVRRVRELSRTVKEELREVIERVRELSERVKKKLRKVLREVAELHREVMKRVRDS

SEQ ID NO: 8213 - protein, 56 aa, Artificial Sequence
  Synthetic sequence.
AEEVLREVEKVVEDSRRSAKDALKRVEDRVRESDKSVRELLEENRKVVEDIKRRVD

SEQ ID NO: 8214 - protein, 60 aa, Artificial Sequence
  Synthetic sequence.
EELERILDKVRKVIEEVRKRLRDDLRTVEKVLKETEEVLRRAAERAKRALERVEEAARRG

SEQ ID NO: 8215 - protein, 55 aa, Artificial Sequence
  Synthetic sequence.
REVLRKVRELLRTIREEVERVLRKSNELSTRIKKRIDDVLETLERLLKELDDKLR

SEQ ID NO: 8216 - protein, 60 aa, Artificial Sequence
  Synthetic sequence.
KDVEDVEREVDEVVKRSDDTVEENLRRAEDVVRDTDRIVKEMKERIDRVVERVEEVVRRG

SEQ ID NO: 8217 - protein, 55 aa, Artificial Sequence
  Synthetic sequence.
EEVLRKVTRLLREAKRRTEESHKKVNDLSRRVKERVDEVLERVKRLLEEVKRKVK

SEQ ID NO: 8218 - protein, 60 aa, Artificial Sequence
  Synthetic sequence.
DEAEKVLKESKDTVDKIRRDVERLVDESRKTVDRIRELVDKAVKDSKDSVDRLRDVMRRN

SEQ ID NO: 8219 - protein, 56 aa, Artificial Sequence
  Synthetic sequence.
EEVLRRIEKVNRDVARRVEEVFREAKEVNKKVDREVEDVIRKVKRVNEKVDEELKK

SEQ ID NO: 8220 - protein, 59 aa, Artificial Sequence
  Synthetic sequence.
SEAEEVVRRSRETVTRNVRMLEKVVRDSEETVKKIVRDVERLLEESKKSVDDLRRLKEE

SEQ ID NO: 8221 - protein, 56 aa, Artificial Sequence
  Synthetic sequence.
EKVLREVKEVNERVRETSRDIADRVREVNEDVKRKVKKVIDDIRRVNEKVKRELEK

SEQ ID NO: 8222 - protein, 60 aa, Artificial Sequence
  Synthetic sequence.
DEAREVVKRVKDLVRRLRRLSEKSLEDDKRLIEEVNKRSKDILDKVKKLVDDLRDMVRRT

SEQ ID NO: 8223 - protein, 56 aa, Artificial Sequence
  Synthetic sequence.
EEVIKEIERVVRKVLEESREVHERIRETVKEVNDRNRKVLREIREVVKKVFEDARR

SEQ ID NO: 8224 - protein, 59 aa, Artificial Sequence
  Synthetic sequence.
SDAEEVVRENRELVERIVREVEKILRDNEELVKRLVELVETSLRRNEKMVDELKKLVDR

SEQ ID NO: 8225 - protein, 56 aa, Artificial Sequence
  Synthetic sequence.
SRVIKEIRDTSKDAVRKVEEVLRRIEETVRDAERKVKEVIKRIRETSKEVLDRVRK

SEQ ID NO: 8226 - protein, 60 aa, Artificial Sequence
  Synthetic sequence.
DAAERALRRSEEVVRESVEEVKTWVDENRRSVERLREELRKDEERVRRVVERIRKLVEDG

SEQ ID NO: 8227 - protein, 56 aa, Artificial Sequence
  Synthetic sequence.
EEVLKRVRKTNDDSDKEVKRLIDEARKLNDDVRKEVEEVLERTTRILDRVRKEVEK

SEQ ID NO: 8228 - protein, 60 aa, Artificial Sequence
  Synthetic sequence.
DEAREVERRVREMVKELKRRLEEDVKESDKSVKDLERIAKEDVDRSRESVKELRDRVRRR

SEQ ID NO: 8229 - protein, 56 aa, Artificial Sequence
  Synthetic sequence.
EEAVRRVKRIIEEVRKVLEDVFRESERLNREVREKLKRMFETSKELNKRVEEALRE

SEQ ID NO: 8230 - protein, 61 aa, Artificial Sequence
  Synthetic sequence.
DSRRELEDDVRRIVETNRRLLEELERRVKKILEENRRLVEELRKENERIVRELTDRVRRDG

SEQ ID NO: 8231 - protein, 56 aa, Artificial Sequence
  Synthetic sequence.
EDVVRTVEKLIRDLEEESRRVLEEVRRLLDEVRKESEEVHKRVNEIVKRVEDEIRR

SEQ ID NO: 8232 - protein, 59 aa, Artificial Sequence
  Synthetic sequence.
SSKDEIRRRVEEVVERSDEIVKRSREHVKTVVDELDRVVKELERKVREVVKKLDKIRKD

SEQ ID NO: 8233 - protein, 56 aa, Artificial Sequence
  Synthetic sequence.
ERALREVEEISRKSEEKLRRVLKESEDIAKEAEDRLKTVLERVERIADEVLKRLTK

SEQ ID NO: 8234 - protein, 59 aa, Artificial Sequence
  Synthetic sequence.
SKVKEVEDRVREVVKESERVARESLEHVRRVVRKTEDVVRRLKEKVRKAVEDLKEIKRR

SEQ ID NO: 8235 - protein, 56 aa, Artificial Sequence
  Synthetic sequence.
EEVLKKVEEISERSRRELRRALKESDKISEESLRRLRKVLREVEEIVRRVLEELRR

SEQ ID NO: 8236 - protein, 59 aa, Artificial Sequence
  Synthetic sequence.
SKVEKLEEEIARLVERSRRLVEELKKEVTKVKEKVDEIVERSRRHVKKVVEKLRDIKRR

SEQ ID NO: 8237 - protein, 56 aa, Artificial Sequence
  Synthetic sequence.
EEVLRRVEETSDRSEKELRTVLRDVTEDIKRIAEELKKALEDSTEIIRRAEDELRT

SEQ ID NO: 8238 - protein, 61 aa, Artificial Sequence
  Synthetic sequence.
DSDRKIDDEVRKVVETSERSLRENIKRIEKVVRKLEEEVRKDLEEVRRVVKELREIVKRNK

SEQ ID NO: 8239 - protein, 56 aa, Artificial Sequence
  Synthetic sequence.
EEALRKVEEDLRRLDRRVEEVVTRSKEILDEARKSVEEVVRRSDEILRRVEEDLRR

SEQ ID NO: 8240 - protein, 60 aa, Artificial Sequence
  Synthetic sequence.
DEVEDILRKVEEIVKKSITDARRLLKEAREIVEESIKTAEELLRRNEDIVRKLSEDVKRT

SEQ ID NO: 8241 - protein, 55 aa, Artificial Sequence
  Synthetic sequence.
KRVLEKIKKVVDDSVRVNREVLKRVEEVLEESKRVNEKVEEDVRRVHEEVRKEIK

SEQ ID NO: 8242 - protein, 60 aa, Artificial Sequence
  Synthetic sequence.
DRVEKLLEDAKKIVEDSKRTAEKLLRENEKIVEKIKREADKILEDNKKIVDELAEAVKRT

SEQ ID NO: 8243 - protein, 55 aa, Artificial Sequence
  Synthetic sequence.
RRVLEEVKRVIDESRRVNKRVEEEIRKVHRDVERRLEEVLKRVRDTSEDVRRKIK

SEQ ID NO: 8244 - protein, 60 aa, Artificial Sequence
  Synthetic sequence.
SEAEKLLRDVEREVERVIEDADKLLREIEEIVKRSEDKAREILKENEKIVRELKEAVRRT

SEQ ID NO: 8245 - protein, 55 aa, Artificial Sequence
  Synthetic sequence.
EEVLRRIKKVVDDVRERLREVEKRIRDVIDRSRRVNERVLREAERTSREVERAID

SEQ ID NO: 8246 - protein, 59 aa, Artificial Sequence
  Synthetic sequence.
DEAEDVLRKVRERVKESERHVEKVLEDVRRVVKKSIDHARDVLRKVKEVIDRVRELVER

SEQ ID NO: 8247 - protein, 55 aa, Artificial Sequence
  Synthetic sequence.
ERVEREIRRVLKRSKERLEEVVKEIRELSEKSRRVLEEVKKRIREVLERVRKDVE

SEQ ID NO: 8248 - protein, 59 aa, Artificial Sequence
  Synthetic sequence.
REAEEVLKEVRKAVEDSIRHVEEVLEEVKKVVEESIRHIRDSLRDVRRVIEEVDRLVKR

SEQ ID NO: 8249 - protein, 55 aa, Artificial Sequence
  Synthetic sequence.
KRVKEEIDRVLDESKRVLEEVVTRIRKVSDDSEKEVRRVHKESKRVVEEVERTVD

SEQ ID NO: 8250 - protein, 60 aa, Artificial Sequence
  Synthetic sequence.
DEAEDVLRRVREMVERSIEHVRRVLKEVEDVVRESIKHVEDVVREVREVIREVEELVDRN

SEQ ID NO: 8251 - protein, 55 aa, Artificial Sequence
  Synthetic sequence.
KRVEEEIDKLLRESKRELDEVRKRIEDLSRESERRLREAVEEIRRLVKKVAEKVN

SEQ ID NO: 8252 - protein, 59 aa, Artificial Sequence
  Synthetic sequence.
KEAEDVLDEVRKAVEESIKHVKRVLEEVEEIVRRSIKHARDSLRKVKEVIDKVRTLVRR

SEQ ID NO: 8253 - protein, 55 aa, Artificial Sequence
  Synthetic sequence.
ERVRREIKRLLDESREVLKEVTKRIRKVSRDSERVVEKVHRDSKDVLDKVREDVR

SEQ ID NO: 8254 - protein, 57 aa, Artificial Sequence
  Synthetic sequence.
SSLEKAEDEVRELLRDVERVLKEVRDRIEELNRKVNEVLRRVIEESERLLREVLERV

SEQ ID NO: 8255 - protein, 59 aa, Artificial Sequence
  Synthetic sequence.
SEKVRRLVDKVRETVTDIVRRVTRLLEESEESVRRLIEKVKKLNEESRRIVEKIEKDAR

SEQ ID NO: 8256 - protein, 57 aa, Artificial Sequence
  Synthetic sequence.
SELERVEEDVKRVNKEVNDTLEKVIRDSKRVLDEVEERTRKVKRDSERLLERVERAV

SEQ ID NO: 8257 - protein, 59 aa, Artificial Sequence
  Synthetic sequence.
EEVVERVLEESRRSVETLIRDVERVNKKSREAVERNIRRSTAANERSKKIVKEIIDTAK

SEQ ID NO: 8258 - protein, 59 aa, Artificial Sequence
  Synthetic sequence.
DEAEDVVRRVREEVERLIRRSREVAEESKRTVDKLRRELEELLRRSRETVERIKKLIDE

SEQ ID NO: 8259 - protein, 55 aa, Artificial Sequence
  Synthetic sequence.
DKVREDIERVLREVEEVDKEVKERVRKVDEDSKKEIKEVKDEIRRVDEESRERAE

SEQ ID NO: 8260 - protein, 59 aa, Artificial Sequence
  Synthetic sequence.
DEAEKVLEKARDLVRRNIERSRRVLEENKKSVDDLIRRNEETNRRNEKSVDEVKKLVDN

SEQ ID NO: 8261 - protein, 55 aa, Artificial Sequence
  Synthetic sequence.
DDVLREVKRVLDEARRVSEEVEKESRRVLEEAKRVAEEVHKRSKKVVDDVKERAR

SEQ ID NO: 8262 - protein, 61 aa, Artificial Sequence
  Synthetic sequence.
SELEDVKRRIDKVVREVEEVVREVSERSKKVLEEVRRSAERVNREIERVLREAKDEVRRRT

SEQ ID NO: 8263 - protein, 56 aa, Artificial Sequence
  Synthetic sequence.
AKRVLEEARKIVDRLRKIVEEVVRRSEELIRRLKKINEDSLRRVEELVKDLIREVS

SEQ ID NO: 8264 - protein, 60 aa, Artificial Sequence
  Synthetic sequence.
KEAEEVVERVRELIERLRRRVTEMLRESKRLVEENIKRSEDALKESERLVDKLRELVKRT

SEQ ID NO: 8265 - protein, 55 aa, Artificial Sequence
  Synthetic sequence.
DKVLRTIEKLLDDVKKEVEKVNEDSKRLLRDVERVSKEVNDESRRVLEEVKREAK

SEQ ID NO: 8266 - protein, 59 aa, Artificial Sequence
  Synthetic sequence.
SELEKIVEKIKRIIDESRRTVEESVRKSEKIVEEVKKRLEELVEEVRKIVEEIVRIIRN

SEQ ID NO: 8267 - protein, 58 aa, Artificial Sequence
  Synthetic sequence.
EELEKVKRMVDKVVDDVRKVNDTSRKRSKETLEEARRKVEEVKRRIDKVLRDVKREID

SEQ ID NO: 8268 - protein, 60 aa, Artificial Sequence
  Synthetic sequence.
DEVEEVVKRVKEVVEKIVRELEKLVEESKKIVEDAVREDERLVEKIERVVRRLVEEVRRS

SEQ ID NO: 8269 - protein, 55 aa, Artificial Sequence
  Synthetic sequence.
EEVKKLVDEVVKEVEEVIKRVEDLDRRVLEENRESTRDVERRVREVVKRVREALK

SEQ ID NO: 8270 - protein, 59 aa, Artificial Sequence
  Synthetic sequence.
SDAERVVREVERLVDTTRKLVKKVVEDIRRVVETAKRDLDRVVKRSEDVVREVKKLIEE

SEQ ID NO: 8271 - protein, 55 aa, Artificial Sequence
  Synthetic sequence.
DRVIKLVRKLNKDSERKLREVRDRVERVIEEVEKRLREVKERSKETIEDVERARK

SEQ ID NO: 8272 - protein, 59 aa, Artificial Sequence
  Synthetic sequence.
DEAEKVVEEAKRRVKEVVERLREVADRNRRSIEELVKELRAVVEDSRKSVEDLVRRVRN

SEQ ID NO: 8273 - protein, 55 aa, Artificial Sequence
  Synthetic sequence.
EEVKKLVEDVIEEVRKVVKEVEDISRRVIEDLKRVLEEVEKRSRKLIKEARDETR

SEQ ID NO: 8274 - protein, 59 aa, Artificial Sequence
  Synthetic sequence.
DELREVVKRVRRLIEEVRRLVKELVDRVRKVIEELKRRSEDSARESERVVREIKKLVEE

SEQ ID NO: 8275 - protein, 58 aa, Artificial Sequence
  Synthetic sequence.
EELEDVDRDIERVREEVKRVVDEVRKRIRDVLEDARRESKRVLDRSRESLREVREAVR

SEQ ID NO: 8276 - protein, 59 aa, Artificial Sequence
  Synthetic sequence.
DELEELVKRVEDVIREIEERVRRLVRESERVVKEILKKSRKSVEKVKEVVDRAVDLVRK

SEQ ID NO: 8277 - protein, 58 aa, Artificial Sequence
  Synthetic sequence.
ERLKDVEREIRRVLRRAEKVVDEALKRSRDTLREVRKVSKEVREDIERVVKEADEAAR

SEQ ID NO: 8278 - protein, 56 aa, Artificial Sequence
  Synthetic sequence.
SVVDRVREELEKVLRHSKKVVEDVKREIDKVLKRSEDALRRVEEESKRVLEEVERD

SEQ ID NO: 8279 - protein, 59 aa, Artificial Sequence
  Synthetic sequence.
KDTLKKLVEEARKVSEDSRRRLERIVEEMRRVSEDSRRRLEEIVRENRKVVEEVRRRAT

SEQ ID NO: 8280 - protein, 56 aa, Artificial Sequence
  Synthetic sequence.
SVVERVREEIKRVLENSKRAVDKVREDIKRVLDESRKAIKEVEDEIRKVLEEVERG

SEQ ID NO: 8281 - protein, 59 aa, Artificial Sequence
  Synthetic sequence.
SDTVRRIVEEIEKVSRESVKRLEDIVREMKKISEESKETVDRIVEKIREVVKRLLEAAK

SEQ ID NO: 8282 - protein, 56 aa, Artificial Sequence
  Synthetic sequence.
SAVETVRKTIEDVLRNSERVLKKVREDSKKVLENSERVLKEVEDRSKEVLKEVEDG

SEQ ID NO: 8283 - protein, 59 aa, Artificial Sequence
  Synthetic sequence.
KKELDEIAEEIKRVSEDSVRKARELAERNKKVSDESVKRVKKIVRENEKVVEELLKAKK

SEQ ID NO: 8284 - protein, 60 aa, Artificial Sequence
  Synthetic sequence.
SEVDEIVRRIKEISKRSVDDLEKLARDNKKAVEEVLEELRKLLEENEKMVREVLEEVRRS

SEQ ID NO: 8285 - protein, 55 aa, Artificial Sequence
  Synthetic sequence.
ERLDRMLKEVIKHSEKVVRDVEETSKTVLKEIEDALKKVEEASKRVVDRLEEATR

SEQ ID NO: 8286 - protein, 60 aa, Artificial Sequence
  Synthetic sequence.
RRVDEIAKKIKRISEESVKTLDKIMEDARKIVKDVLDELRKLAEDNKRVVREVLERVRRS

SEQ ID NO: 8287 - protein, 55 aa, Artificial Sequence
  Synthetic sequence.
ERLRRTVERVIRHSREAVKRVKDEVEKVVKELEDVVRKVKEDSERVVKEVEEAKR

SEQ ID NO: 8288 - protein, 59 aa, Artificial Sequence
  Synthetic sequence.
SEAEDVVRRSKRSVERLKKELDDVVRESKESVERLVRRNDEVVKRSRESVDELTEAVKR

SEQ ID NO: 8289 - protein, 59 aa, Artificial Sequence
  Synthetic sequence.
KDLVERVERTVRTTLKELEDALREVKRMVEDTLKKAEDVNRRVAEEVKKSEKRLRDVAK

SEQ ID NO: 8290 - protein, 59 aa, Artificial Sequence
  Synthetic sequence.
DEVDDVVRKSEKSVEELVRKLETVVKRSEESVRELLEKNREVVERNERSVRELLERLEK

SEQ ID NO: 8291 - protein, 59 aa, Artificial Sequence
  Synthetic sequence.
KDLLKRVEDTARRVNREIEEALDRVRKAVEKTLKKLKDVNDEVRKESEKVLKELRDATK

SEQ ID NO: 8292 - protein, 61 aa, Artificial Sequence
  Synthetic sequence.
SDEDRVREMVRTVIEKLDRVLEEVERDSAKTDRDNKKSAEDVRRESKRTDDELKDVVRKAG

SEQ ID NO: 8293 - protein, 56 aa, Artificial Sequence
  Synthetic sequence.
VDEVVERAKKLVKRLEDRLREVVKESRRLVRRVVERNREVAERSKDLVRRLVEDTR

SEQ ID NO: 8294 - protein, 60 aa, Artificial Sequence
  Synthetic sequence.
SKEEEVERRVEEVIKELEEVLRRVEEEIKRVIDDNRRSARDVEEKSKRTDEELKDVVRKA

SEQ ID NO: 8295 - protein, 56 aa, Artificial Sequence
  Synthetic sequence.
VDEVARRVKEMVERLRKLAEEVVREAERVVREVVDENRKVVEESKRLVKELLERVK

SEQ ID NO: 8296 - protein, 60 aa, Artificial Sequence
  Synthetic sequence.
SDEERVDEEIKTVIEELKRSLKEVEDTIRKVIKENKDSAKRVKETSEKTDREIEDVVRKA

SEQ ID NO: 8297 - protein, 56 aa, Artificial Sequence
  Synthetic sequence.
VDTVAKEVRDLVRENVERNKEVVKRAKKVVDDVVRENRKVAEDSKKLVKEVKDRVR

SEQ ID NO: 8298 - protein, 61 aa, Artificial Sequence
  Synthetic sequence.
DDEERVKELIKEVIRELEESLRRVKEDSKRTDEKNKKSMEDVERKIERVRRRLDEVVKEAG

SEQ ID NO: 8299 - protein, 56 aa, Artificial Sequence
  Synthetic sequence.
VDEVAKRATDIVKRNAELNKEVVDESRRLVEEVVDRNEKVAKRAEEIVDELERRTR

SEQ ID NO: 8300 - protein, 60 aa, Artificial Sequence
  Synthetic sequence.
DEFKEVVDRVKRLVTENVRENRRVVEESERLVKEALKRLEDLVRRAKEIVDRLDDLVRKI

SEQ ID NO: 8301 - protein, 59 aa, Artificial Sequence
  Synthetic sequence.
KDLLKRVRDSIETVKKELDDSMKKVSDDDERSKKELEDVLEEVRKRIEKVMKELRDTSR

SEQ ID NO: 8302 - protein, 60 aa, Artificial Sequence
  Synthetic sequence.
DEVREIVREVKRLVEENVRRNDDVARKSRKLVKENKDRNKEVVDRLRELVKRALDEVRRI

SEQ ID NO: 8303 - protein, 59 aa, Artificial Sequence
  Synthetic sequence.
EKLLKEVEDMIRTVKKELKDSARRVSEEDKRSKEDLKRSAKEVEETIKDVLRKLDTETT

SEQ ID NO: 8304 - protein, 60 aa, Artificial Sequence
  Synthetic sequence.
DEAEEVVRRVERLVKENVKLNKEIVKRSRDLVKELEERLREIVKRVEEIVKRAKDLVEEI

SEQ ID NO: 8305 - protein, 59 aa, Artificial Sequence
  Synthetic sequence.
KDLLKRVREVIERVDRELDKSMKEVHDENEKSVRRLREVLERVKKRIKDVTKELEDRTR

SEQ ID NO: 8306 - protein, 60 aa, Artificial Sequence
  Synthetic sequence.
SLVEEVVRRVEDLVRKNVRLNEEIVRRSEDLVRRNVELNEELVRRAEDLVRRIEELVKKI

SEQ ID NO: 8307 - protein, 59 aa, Artificial Sequence
  Synthetic sequence.
EELLRKVEKMIERVVRELKKSAKRVHDENRRSDEDAERSMERVERVIERVERDIDRRLR

SEQ ID NO: 8308 - protein, 60 aa, Artificial Sequence
  Synthetic sequence.
DEAREVVTEVKRLVRENEERNKEVVKRSKKLVEDLKDLARKLVDRAKKLVDTLRDLVRKI

SEQ ID NO: 8309 - protein, 59 aa, Artificial Sequence
  Synthetic sequence.
ERLLEDVERKIETVIRELRKSMEEVKESSRRSNEELKKVADDVERTIRKVERELEKEST

SEQ ID NO: 8310 - protein, 60 aa, Artificial Sequence
  Synthetic sequence.
SDAERVVDDLERRVRENLEDLRRAVREVREVVKKNLETITRVLEEVERVVDRLSKLVKEG

SEQ ID NO: 8311 - protein, 55 aa, Artificial Sequence
  Synthetic sequence.
REVDKVLKDVARKVEEANEKSRRVLEEVEELVERVNRELHETLKRVAERVKRDAT

SEQ ID NO: 8312 - protein, 60 aa, Artificial Sequence
  Synthetic sequence.
SDEERVTKVLEEVKERIERANRTLEKRVREVTDRVREVNERSDKVNRDSERKIREIIKRL

SEQ ID NO: 8313 - protein, 55 aa, Artificial Sequence
  Synthetic sequence.
EKLVRDLRKIVEENERKNRDLLRKIEKIVEEIERRNRDVVRRSKESVERLREEVR

SEQ ID NO: 8314 - protein, 60 aa, Artificial Sequence
  Synthetic sequence.
DADRELRRVAKEVTDRSRRVLEDSERVVRESHEKSKRVLEDLRRVVKEVAERIDEVLKRV

SEQ ID NO: 8315 - protein, 59 aa, Artificial Sequence
  Synthetic sequence.
EEVARDVVRKLKRIVTENLKKNTKVVRDSEDLVRRDLEEVDRVVKKVKKDVDEIERDVK

SEQ ID NO: 8316 - protein, 59 aa, Artificial Sequence
  Synthetic sequence.
DEVREVVKELKRIVDELLDELRKVVEELEKIVTDDLRRIEEAVKRSKDSVEDLERRLKS

SEQ ID NO: 8317 - protein, 59 aa, Artificial Sequence
  Synthetic sequence.
KDLLRELEEVARRVEEKIKKAVRELEKVMREVNRKSTEVLKRLEKVVRDSEKRIDDATR

SEQ ID NO: 8318 - protein, 59 aa, Artificial Sequence
  Synthetic sequence.
SDVDEVVKEVKAIADDSTRLNKESAEKSRELVDRDTKKNKRSVEELRRLVTEILKVVES

SEQ ID NO: 8319 - protein, 59 aa, Artificial Sequence
  Synthetic sequence.
DELLRKLEEVVEKVRRDDERSHRESERVSRESTKRSRDSHRESREVVTEVKKEVDRAAK

SEQ ID NO: 8320 - protein, 60 aa, Artificial Sequence
  Synthetic sequence.
DEAEEVVDRARKLVKESEDLNRRSVEESEKLVTTSTELNKRTVDRLREIVEEVKDLVRKT

SEQ ID NO: 8321 - protein, 59 aa, Artificial Sequence
  Synthetic sequence.
EDVLRKVKKTLEEVKRRDDEAMRRSHKKDDDSRKRDEESMRRSDEVVREVIEEVREAER

SEQ ID NO: 8322 - protein, 59 aa, Artificial Sequence
  Synthetic sequence.
DEIEDVVRKVEEMVKESKDRVDRNVEESRRIVTESREKVKDSVRRVEEVVKEIKKLAEQ

SEQ ID NO: 8323 - protein, 59 aa, Artificial Sequence
  Synthetic sequence.
DKVVKKVDDALKRVEKKDRDAIREVERVNREVEKDDERVLRDSERVLEEVRKRVEEVTT

SEQ ID NO: 8324 - protein, 59 aa, Artificial Sequence
  Synthetic sequence.
SEIDEVVERVRKAVEDSRKVVEDLIKTVEDAVREHERLVRRVVEEVDKLVEDIRKLLER

SEQ ID NO: 8325 - protein, 59 aa, Artificial Sequence
  Synthetic sequence.
ERMLRKVDEVIKRVAREDERVVKKLEDVLRDVKRRVDEASKEVDRRLKEVKKRVEKEAE

SEQ ID NO: 8326 - protein, 59 aa, Artificial Sequence
  Synthetic sequence.
KEAEEAAKRAEEAAKRHEDLAREAAKEAKRAADESRKAAEEAAKRAEKAARDIADLARK

SEQ ID NO: 8327 - protein, 59 aa, Artificial Sequence
  Synthetic sequence.
EKAARKAEDALRRAREIAKKASEDAKRALDEARKADEDAARKAEKALKEAEDAAREARR

SEQ ID NO: 8328 - protein, 63 aa, Artificial Sequence
  Synthetic sequence.
DEEEELKEVVREVAERVEEVNRKSERELDKARKDSERALEKLERVLREVAERVKRVLDEASKR

SEQ ID NO: 8329 - protein, 56 aa, Artificial Sequence
  Synthetic sequence.
VKDVIRELEEVVRRNTDLVRKVEEEIRKVVEESKRSIEEVIKRLRKLVDDIRKAIK

SEQ ID NO: 8330 - protein, 63 aa, Artificial Sequence
  Synthetic sequence.
DEREKLAEVVKRVAEDVKRMNKESREALKRVKEEVKRVNEKSEKVTREVKKEVERVIEEAKRT

SEQ ID NO: 8331 - protein, 56 aa, Artificial Sequence
  Synthetic sequence.
VEDVIRELEKVVEDNKRLVEKVVRDARKVVEDNKELVDRNVKRLEEVVREITKEIK

SEQ ID NO: 8332 - protein, 60 aa, Artificial Sequence
  Synthetic sequence.
RDVDELVRELRDVVRKVLETARDSVRELKRIVTESLRRAEDLVKEITDVVREVLDAVRRA

SEQ ID NO: 8333 - protein, 59 aa, Artificial Sequence
  Synthetic sequence.
REVVKKLRDVIREVKEDVERVLKEVRDVNREVNKIDKEAVERIRRVLDEVRKRVDEAAR

SEQ ID NO: 8334 - protein, 59 aa, Artificial Sequence
  Synthetic sequence.
KEIDDVVRELKEIAKRDEDKVRRVVEDLERVAREDLRKVREVVKELRRVVKTLLDLVRR

SEQ ID NO: 8335 - protein, 55 aa, Artificial Sequence
  Synthetic sequence.
KRLDDVLREVADIIRRSIRDLERVLEEVKRIIETSNDELRKVLKEVRETITEAER

SEQ ID NO: 8336 - protein, 60 aa, Artificial Sequence
  Synthetic sequence.
SEIDEMVRKLKEMARRDLETVRRVVERLRKLAEDDLRRVRKVVKKLKELAKDIVRLVEEG

SEQ ID NO: 8337 - protein, 55 aa, Artificial Sequence
  Synthetic sequence.
ERLRKVLKEVKDIIRKSNKELDEVLRDVERIIRESIEELRRVLEEVKKIIKEARD

SEQ ID NO: 8338 - protein, 59 aa, Artificial Sequence
  Synthetic sequence.
DEVDEAVRRLEEIVTRIEKDVDDVARRSEESAKEVEKAVRKVVEEHKKVAEDIRKLVED

SEQ ID NO: 8339 - protein, 59 aa, Artificial Sequence
  Synthetic sequence.
REVKERLKKVLDKVRKRIKRVVERLEEAARKSRKIIRDAKEELERVSREVEKVIRDVRR

SEQ ID NO: 8340 - protein, 60 aa, Artificial Sequence
  Synthetic sequence.
EEVKELVERLRDLVRESEKRVDEVVKRLEDLVRRNEELNRELVTRLRDLVRKLEEKVKDT

SEQ ID NO: 8341 - protein, 59 aa, Artificial Sequence
  Synthetic sequence.
KEMVREIKRVVDEVRKRDKEALDRLKKVIEEVRRKVKRSEDEARRVVEEVKRIVDRVET

SEQ ID NO: 8342 - protein, 60 aa, Artificial Sequence
  Synthetic sequence.
REVDDLVRRLEELVRRNEKKNEDVVRESKELADRSRKLVKELVKRLRELVKTVVRLVEET

SEQ ID NO: 8343 - protein, 59 aa, Artificial Sequence
  Synthetic sequence.
KELVRKLKKVVDEVRERIDRSTEEVRRVSKESKDIDKRAKEEIEEVLRDVEKKLRETAT

SEQ ID NO: 8344 - protein, 60 aa, Artificial Sequence
  Synthetic sequence.
DEFRDVVRKLEKLVEDITREAEEVVKISKALAEENKRLNDELVDRLRRLVEEVRKKVEDT

SEQ ID NO: 8345 - protein, 59 aa, Artificial Sequence
  Synthetic sequence.
KEVVKRVKDVVDRVRDEVRRVAEKVDRVSKESKRIIDESTKRAREVLERVRKRVEDERK

SEQ ID NO: 8346 - protein, 60 aa, Artificial Sequence
  Synthetic sequence.
SEVDDIARKLRDLVRRNKELNDEVVRRSEKLVKENKELNEELVRRLKELVDRLEDEVRRT

SEQ ID NO: 8347 - protein, 59 aa, Artificial Sequence
  Synthetic sequence.
KEMVKKLRKVVEEVRREIDDSMRKVKKVSEDSKRRIERSTEEIEEVAKRVADKVTDVER

SEQ ID NO: 8348 - protein, 60 aa, Artificial Sequence
  Synthetic sequence.
RELEEVVRELRKLVTEDLDRVRKSVEESERVVREDERRVDESVKRTREIADEVRRLKEEG

SEQ ID NO: 8349 - protein, 55 aa, Artificial Sequence
  Synthetic sequence.
EELKKVLKEVRKVVTDSERRDKEANRKVEEVIRRSKKKDEDAHREVRKVVEDVRT

SEQ ID NO: 8350 - protein, 60 aa, Artificial Sequence
  Synthetic sequence.
SKDEKLEKVIREVKRVIERVSKESEDVLRKVRKVIEDVSRESRRVLEDSRRVLERVAREG

SEQ ID NO: 8351 - protein, 56 aa, Artificial Sequence
  Synthetic sequence.
VDEVVDRARRIVDDVDRLNREVVKRLKDLVEDLRRLNEEVVRRNKELADTVRKDVR

SEQ ID NO: 8352 - protein, 60 aa, Artificial Sequence
  Synthetic sequence.
SEDEKLKEVVDEARKILEDADRELKRVVKEVEDVIRDVSKKSTEVRKEVKEILKEAADKG

SEQ ID NO: 8353 - protein, 56 aa, Artificial Sequence
  Synthetic sequence.
VDKVVDDLRKLAEDLLRENKEVVDKLRELVERVKKLNEDVVREARRLADEVLKRVT

SEQ ID NO: 8354 - protein, 60 aa, Artificial Sequence
  Synthetic sequence.
SEVERLEERLKRIVEDIKRLVKKSVEDSRKIVEEIRKLVKDSVEKNKRSVEEVEDIVRKD

SEQ ID NO: 8355 - protein, 55 aa, Artificial Sequence
  Synthetic sequence.
ERVKRVLREVEERVKEVKKENEKAHEEVRKDVERVLEDDDRALRESRERAERVKK

SEQ ID NO: 8356 - protein, 60 aa, Artificial Sequence
  Synthetic sequence.
TEVDELLDSLRKIVTEIEKLVEESEKRLREIVKTIEKLVKDSVRTLKKIAREIEELAKDR

SEQ ID NO: 8357 - protein, 55 aa, Artificial Sequence
  Synthetic sequence.
ERVEKVLREVRDRVKKVNKRNEDALREVDKKVKDVNKENEDVLEEARRVVEEVRR

SEQ ID NO: 8358 - protein, 60 aa, Artificial Sequence
  Synthetic sequence.
REDEKIKKVVEEVRKKLEDVDKNSRDAIEDDKRVNKEVDRNSERAFKENEDEIRKVKEAG

SEQ ID NO: 8359 - protein, 56 aa, Artificial Sequence
  Synthetic sequence.
ADEVVKELERIVAEVEKLSREVVKRLKENVKRVRDLSKRVVEYLKEDADRLKEDVR

SEQ ID NO: 8360 - protein, 59 aa, Artificial Sequence
  Synthetic sequence.
DEERKIRKAVEDVRRVIKEVEENSKRVFDENKKVIDDVRKEVEKVLKENRDVIKEVRDK

SEQ ID NO: 8361 - protein, 56 aa, Artificial Sequence
  Synthetic sequence.
ADEVLKELKKLVEELEKLSREVVKYLREDAKRLKDLVRKVVEYLKEDARRLDEEVR

SEQ ID NO: 8362 - protein, 57 aa, Artificial Sequence
  Synthetic sequence.
SVVEKLLEDARRVVEKVREAVERNLKKVRDLVKKLREDVKRSKDHLEEVVRKLEEAK

SEQ ID NO: 8363 - protein, 59 aa, Artificial Sequence
  Synthetic sequence.
EEVERRVEEVIRDLERVLREVRERVRRINEESRRMLEDVERESRKALRDLEEVLDRVRR

SEQ ID NO: 8364 - protein, 58 aa, Artificial Sequence
  Synthetic sequence.
SVVEELRKRVEDVVDEVREVVERNRDLMRRVAEESKKIVDDSLRHIKEVVDEVRRAKN

SEQ ID NO: 8365 - protein, 59 aa, Artificial Sequence
  Synthetic sequence.
ERVKKRVRDVLRKLREVLERVAEEVKKVNKRSREVNKRVEEKSEEVLRDLERVLREVET

SEQ ID NO: 8366 - protein, 59 aa, Artificial Sequence
  Synthetic sequence.
SEVEEVVERLRRKAEEDLRRVEEAVKEHRRVVKEDLDRVRDAVERHREVVETIRKLKED

SEQ ID NO: 8367 - protein, 55 aa, Artificial Sequence
  Synthetic sequence.
EKLKRVLKEVEEVVRESKERLREVHEEVRKVIEDSKRILKTVHDDVRRVIEEVKK

SEQ ID NO: 8368 - protein, 59 aa, Artificial Sequence
  Synthetic sequence.
DDVERVLKELDELLKRDETEVREVEKRHREVLETIERRVREVIERHKEMLRRLAELVRS

SEQ ID NO: 8369 - protein, 55 aa, Artificial Sequence
  Synthetic sequence.
EELKKVRDKVRRVIEESKRRLEELHEEIRRLITELKRRLEEVTEEIKRAIDELRR

SEQ ID NO: 8370 - protein, 59 aa, Artificial Sequence
  Synthetic sequence.
DEVEDVVRRLRKIVEDIRRDVERVVEEHDRVVRKLKRRVEEAVEEHRKVLEEIKKVKEN

SEQ ID NO: 8371 - protein, 55 aa, Artificial Sequence
  Synthetic sequence.
EDLKRVLKEVEDVVREVDKILTDATERVKRVITEVKDILRRVHEEVREVIKRVKE

SEQ ID NO: 8372 - protein, 59 aa, Artificial Sequence
  Synthetic sequence.
DEVEEVVRELREILKRDLDEVRKAVEDHERLLREITKDVKRVADRHRDLLRKIRELKEN

SEQ ID NO: 8373 - protein, 55 aa, Artificial Sequence
  Synthetic sequence.
EKLKRVLKELEDVIRESEEILERVTRKAERVIERVRKILEEATKEVERVIREVRR

SEQ ID NO: 8374 - protein, 55 aa, Artificial Sequence
  Synthetic sequence.
EEDERIEKVTEEVKKVIEDVTRLTETVMRESEKVIEDVTRDSDRVRKEVKKVLEK

SEQ ID NO: 8375 - protein, 56 aa, Artificial Sequence
  Synthetic sequence.
VDEVVKRLKELVTRLAEENKRAVDTNRKLAEDLKELNRKAVEELKELLRRVDERDR

SEQ ID NO: 8376 - protein, 56 aa, Artificial Sequence
  Synthetic sequence.
SEDEEIDRVDKDVKRVSDTSNKILDDVEKEVDKVIREVTAESKKVLDEAKKVLDKV

SEQ ID NO: 8377 - protein, 56 aa, Artificial Sequence
  Synthetic sequence.
VEEVVRRLEKLVDDDRKLVEKVVKELRELLKELRDKNKEVVDELRRLAKTVDEEDR

SEQ ID NO: 8378 - protein, 60 aa, Artificial Sequence
  Synthetic sequence.
SAEEIAERVLRELRKVTKEVAEEDERVLREDEKVTDEVRKEDKRVLDEARKVIDDVRKKG

SEQ ID NO: 8379 - protein, 55 aa, Artificial Sequence
  Synthetic sequence.
EEVVKRVRENVKRTRELSKRSVEKNEENVRRTREMSKRTVKEIRDVVKELRDRVK

SEQ ID NO: 8380 - protein, 59 aa, Artificial Sequence
  Synthetic sequence.
SKREKAEEVLKEAKKVIDDVREKDRRALEEDKRVTDEVARIAEKVLKDLRDVIEEVRER

SEQ ID NO: 8381 - protein, 55 aa, Artificial Sequence
  Synthetic sequence.
EEVVRRVRKVVTELEELSRRSVEENRRNAEETERLIREIVERARRVVETLKETVR

SEQ ID NO: 8382 - protein, 59 aa, Artificial Sequence
  Synthetic sequence.
SVEDILRKVAKEAEDVAREVTRILEEANRRVEEVVKRVKEENERANEKVERVVREVKAR

SEQ ID NO: 8383 - protein, 59 aa, Artificial Sequence
  Synthetic sequence.
EEVVRRVVETVKDIVKRLRDIVREVLKKNERIVEELKKTSDESKKRNDDIVRELDERAR

SEQ ID NO: 8384 - protein, 59 aa, Artificial Sequence
  Synthetic sequence.
SVEEILEEVLRRAEKIVKEVKDLDRRALEENKKAIKEVADELRKVDEEVKKVVDEVRRE

SEQ ID NO: 8385 - protein, 59 aa, Artificial Sequence
  Synthetic sequence.
EDVVRKVVRDVEDIVRRMREEVRRSVEDLKRNADENRDEVRKVVKENKDIVREMRERVR

SEQ ID NO: 8386 - protein, 59 aa, Artificial Sequence
  Synthetic sequence.
REKEKLEKAVRDARRVIERVERKDREALKEVERVVRESHKTLEDVLREIRKVATEVRRE

SEQ ID NO: 8387 - protein, 56 aa, Artificial Sequence
  Synthetic sequence.
VDKLMKTIEDLLRRVEELVDRSVKELKRLLDENRKLVKRVLEEIRRILKELRDEVK

SEQ ID NO: 8388 - protein, 59 aa, Artificial Sequence
  Synthetic sequence.
DEEEKLRKVKKEADDVIRRSHEEDERVLREVEKVVRESHEELKRVADEIRRVVEEVKTR

SEQ ID NO: 8389 - protein, 56 aa, Artificial Sequence
  Synthetic sequence.
VDKVMETIRRLVTKNRELVKRSVDELRDLVDKNRKLVERVVERIEEIAKKARDDVK

SEQ ID NO: 8390 - protein, 60 aa, Artificial Sequence
  Synthetic sequence.
KVVEEIEKEVRRSVEELERLVTEDLRKVKEVVKRAEEVAEEDERKVDEVVKELKRAAKEG

SEQ ID NO: 8391 - protein, 59 aa, Artificial Sequence
  Synthetic sequence.
EEMERRVREVLKRNEDVTDEVKKKIEESNRDLEDALRKVEKKIRESNERLRRVLEEVRK

SEQ ID NO: 8392 - protein, 60 aa, Artificial Sequence
  Synthetic sequence.
KEVEDVLDDVRRVVEKLEREVKKVEDTNERVVETLDEIVKEIRDRNRKVVETLKEIMKSN

SEQ ID NO: 8393 - protein, 55 aa, Artificial Sequence
  Synthetic sequence.
DKLRKAEKDLRDVAKEVRDKIRRADERLKRVIERVADEIRKVNTDLKRVADEVRK

SEQ ID NO: 8394 - protein, 60 aa, Artificial Sequence
  Synthetic sequence.
SEVEDVEREIEEVVEELRKIAEDDLRRNDTVVKEVRELVKRDREKNRKSAEELKKLKEEG

SEQ ID NO: 8395 - protein, 55 aa, Artificial Sequence
  Synthetic sequence.
EELKRVMEKITRVVEKVKEDVDRSKKKAEEVIREVEERLKRSLDESRKVLEEVKK

SEQ ID NO: 8396 - protein, 59 aa, Artificial Sequence
  Synthetic sequence.
REVEEVKKRVDEVVKRLRKLAEDDDRKNKESADRLRAIVDRDKKENTRSMETLRRLRER

SEQ ID NO: 8397 - protein, 55 aa, Artificial Sequence
  Synthetic sequence.
ERLEDAKKKLEDVIDEVRRRLEESNKRSRDVMEEVRKEVRRSLRESEEVVKDVEK

SEQ ID NO: 8398 - protein, 60 aa, Artificial Sequence
  Synthetic sequence.
DEVREIKRLVDELVKRLKELAERSRRLVDEVAKRSKELAKENLDLNEDIVRRLDEVAKRG

SEQ ID NO: 8399 - protein, 55 aa, Artificial Sequence
  Synthetic sequence.
KELKDVAREIERVLKEVEEEDDDALRKIEEVSKRSKEIIDESMEKVKKVMEDVTR

SEQ ID NO: 8400 - protein, 59 aa, Artificial Sequence
  Synthetic sequence.
SEVETVKKLIEDIVRESRRLVRENEELNKDVIRRSEELVRRSKEAVKRLVDKLDELRKR

SEQ ID NO: 8401 - protein, 55 aa, Artificial Sequence
  Synthetic sequence.
RELERAVEEIERVSRDSKREIKRSTEEVRKASERSRKEDEELERRARRVVEEVKR

SEQ ID NO: 8402 - protein, 59 aa, Artificial Sequence
  Synthetic sequence.
SELEKVVEEVEEIVRRSERHVTEVVKTSKKSVEDSNRHVAKVVEDVKKKVTELIEAARE

SEQ ID NO: 8403 - protein, 55 aa, Artificial Sequence
  Synthetic sequence.
KVLERVKRELKKAADRSRDIIRRVARETEEALRTSREIAKRVEDELRRVLEEVRK

SEQ ID NO: 8404 - protein, 59 aa, Artificial Sequence
  Synthetic sequence.
KELEDVVKRVREEVRRSLEHVAKAVKESEDSVRELKEEVDRVVKESEDIVRELEKLKRE

SEQ ID NO: 8405 - protein, 55 aa, Artificial Sequence
  Synthetic sequence.
KRLKEVDKELKRALEESRKIIKKVKEETKDVLRRVRDILRRSVRTSEKVLKEVKD

SEQ ID NO: 8406 - protein, 59 aa, Artificial Sequence
  Synthetic sequence.
SKVERVVEESRENAKRDLDRVDKVVKDSRRSVEEDLKEVRDVVKEVDDMLREAEELMRR

SEQ ID NO: 8407 - protein, 56 aa, Artificial Sequence
  Synthetic sequence.
EKVIREVAKESEDAFRESERRLREVLKRSAEALKRSRDILKTVRERVKRVIDEVRR

SEQ ID NO: 8408 - protein, 60 aa, Artificial Sequence
  Synthetic sequence.
REVEEVVKRSEKSVKEMEDKSRETVKKSRKSAKEDIDKVEEVVRRVEKVLREAKKLADDG

SEQ ID NO: 8409 - protein, 56 aa, Artificial Sequence
  Synthetic sequence.
KDVIEEVRKKSDEVLKRVRKINKEVTEESERAFDESRRILETVAREVKRVIDEVRR

SEQ ID NO: 8410 - protein, 59 aa, Artificial Sequence
  Synthetic sequence.
DAVEREVRKAEKIVEDDLRRVAKVVDESRKSVEKNEEDVRRVVEELRKILEEIDRLKRN

SEQ ID NO: 8411 - protein, 56 aa, Artificial Sequence
  Synthetic sequence.
ERVLRRVKKKLEDAVEDSRRILTELAEEVKTVVERSKRILDTVRDELKKALERVKK

SEQ ID NO: 8412 - protein, 60 aa, Artificial Sequence
  Synthetic sequence.
DEVDEVVEKLRRLLEDTIRLVREAVDYLRRNLEDLRRKIREIVERLKRLLEELRKLVKDT

SEQ ID NO: 8413 - protein, 56 aa, Artificial Sequence
  Synthetic sequence.
EKRVRDAADEVRRMNEEVKKIIDDARKELERVHRDVKREIDRVARELDEEIRRVEK

SEQ ID NO: 8414 - protein, 60 aa, Artificial Sequence
  Synthetic sequence.
DEVREMVKTLTDLLRRNRELVKRVVEELRKLLEETRKLVEDMVKELEDLLRELEKLARDT

SEQ ID NO: 8415 - protein, 56 aa, Artificial Sequence
  Synthetic sequence.
EKVVEEVARKVARANEDSNRILDEARKEVEKVNEEVRRIIKEVTDRLEKKVREVEK

SEQ ID NO: 8416 - protein, 59 aa, Artificial Sequence
  Synthetic sequence.
SKAERLDEEVDKIVRDLRRLVDELEKRIEKIVRDNRELVKRVRESNKRIVETLRRLKEN

SEQ ID NO: 8417 - protein, 56 aa, Artificial Sequence
  Synthetic sequence.
KREVDKIEKKLRDVVREVEEIVTRVDKRLKDVLKESREILKEVNDETKKVLDEVKT

SEQ ID NO: 8418 - protein, 59 aa, Artificial Sequence
  Synthetic sequence.
SEAEKVVRDVREIVERLRDIVRKVVEENEEIVKRLRKLVTDLVEENKRTVEALRDLKRR

SEQ ID NO: 8419 - protein, 56 aa, Artificial Sequence
  Synthetic sequence.
EEILRRVEEEARRAAKEVEERIRTVNRRTEKVLEEVRKIVKDATDTSEKALREVRE

SEQ ID NO: 8420 - protein, 59 aa, Artificial Sequence
  Synthetic sequence.
SRVEEVLRKVEEIVKRNEDLARKVVDESRKTVDKLRTLVEKVLRESRETVKRLIDLVRR

SEQ ID NO: 8421 - protein, 56 aa, Artificial Sequence
  Synthetic sequence.
EDLLTRVTDVLRKLRDRSREIIKRVVDETRRVLEEVKELIKRVLEETERVLREVRR

SEQ ID NO: 8422 - protein, 59 aa, Artificial Sequence
  Synthetic sequence.
SEVDEVVDRSRKTVKKMIDDVREVLERSRKNVKEDIERVRKVVRESEETVKTARRLKEE

SEQ ID NO: 8423 - protein, 56 aa, Artificial Sequence
  Synthetic sequence.
EEVLRRVREVTERATREVEELLKRSDEESERALKTSTDVLREVLERSDKVEEEVKT

SEQ ID NO: 8424 - protein, 60 aa, Artificial Sequence
  Synthetic sequence.
KEVEEAVRRVEESVRRLEEEVDRVVKENRKLVKDLIELAEEVVRRVKELVDRLRETVRRA

SEQ ID NO: 8425 - protein, 56 aa, Artificial Sequence
  Synthetic sequence.
KDVVTEVKKRAEDVDRRVERVIEEAEEVSREALKRVRDIIDTVRKVAETVLKEVKD

SEQ ID NO: 8426 - protein, 59 aa, Artificial Sequence
  Synthetic sequence.
KEKEVMDEVERVLEKVKEDNRRVVREVEDVLRRVEKENKEIVDEVKDVARKVLEEVRRR

SEQ ID NO: 8427 - protein, 55 aa, Artificial Sequence
  Synthetic sequence.
ERVLEKVKDVVRRSRDIVRRILEDAKDVVRKSREIAKKILEEVTEVVKRAREKVK

SEQ ID NO: 8428 - protein, 60 aa, Artificial Sequence
  Synthetic sequence.
SKLEELLKRSEKSVREAKRLVEELKRRSEETVRRNKELAERLEDESRKTVELLKRIVDSN

SEQ ID NO: 8429 - protein, 55 aa, Artificial Sequence
  Synthetic sequence.
KLLEEVEKESRKVVEDVRRVIEDVKRRSDEALKESEDIIRDVRRKSEKALRDVEK

SEQ ID NO: 8430 - protein, 60 aa, Artificial Sequence
  Synthetic sequence.
SELEDLLRRSKESVDRLRELIRRLEDESRKTVETLRDIVKKLKEENKKTVDDLRDIVRRR

SEQ ID NO: 8431 - protein, 55 aa, Artificial Sequence
  Synthetic sequence.
ELLERVREVSDKVLEELKKIIDEIRKRSEKVAEEVKDVIRKVNELSKKVLKDVKK

SEQ ID NO: 8432 - protein, 60 aa, Artificial Sequence
  Synthetic sequence.
RKLEELLKRSERSVEELRRKVTRLLEENDDTVRRLRELVTKLTDDSRKTVTRLRDIVRKD

SEQ ID NO: 8433 - protein, 55 aa, Artificial Sequence
  Synthetic sequence.
KLLEEVTKVSEKVAEEVRRVIKTVNDKSTEVLREVKRVIETVRRESEDVLEKVEK

SEQ ID NO: 8434 - protein, 60 aa, Artificial Sequence
  Synthetic sequence.
SKLEDLLRRVTEIVKRLEEIVRKLEERSRRTVKRLEELVDTLRKENEDTVRRLEKIVRDR

SEQ ID NO: 8435 - protein, 55 aa, Artificial Sequence
  Synthetic sequence.
ELLKEVRDVLETVVKRVREIIEKVRKESEDALRKVDKDIREVNRRSEKALEDVKT

SEQ ID NO: 8436 - protein, 59 aa, Artificial Sequence
  Synthetic sequence.
SEAEKIEREVDKVVEDHRRLVRADLERVERVVEEHRRLVKEDLDRVDEVVKRLRKLKED

SEQ ID NO: 8437 - protein, 56 aa, Artificial Sequence
  Synthetic sequence.
EDVLRRVRELLKTVHEEVKKVIKTSDDILRTVHDEVRKVIKTSEKILREVAEEVER

SEQ ID NO: 8438 - protein, 59 aa, Artificial Sequence
  Synthetic sequence.
KELEDATREVETVADEHRRVLEEDKRDVKEVVERHRRLLEDLRRKLEKVVRDLRKLLKD

SEQ ID NO: 8439 - protein, 56 aa, Artificial Sequence
  Synthetic sequence.
EDVLRRIEKKLKDVTDDLRRVIKESKDRLTKLHKEVEDALRRLRDRLRELEDEIRR

SEQ ID NO: 8440 - protein, 61 aa, Artificial Sequence
  Synthetic sequence.
RELEEAVKEVEKKIRELRERLKEVVERSTKKMDDLRKENEKVMRESSELVTELVKEIKDRA

SEQ ID NO: 8441 - protein, 56 aa, Artificial Sequence
  Synthetic sequence.
LKDLRKKVDDVARKVDKILEDLERESDTVLDRVKKVLERSRRDSEDVARRVEEKVR

SEQ ID NO: 8442 - protein, 60 aa, Artificial Sequence
  Synthetic sequence.
SELDELRKMVKEVLDRVRDLLKKLEDEARKVAEDNKRLLERNKREIEAALRRVEEIIRRR

SEQ ID NO: 8443 - protein, 58 aa, Artificial Sequence
  Synthetic sequence.
KRVREVLREVEKRIKELEDLVRKVLDKIRELIERLKRETDKVLEESKKLIKELSERLE

SEQ ID NO: 8444 - protein, 59 aa, Artificial Sequence
  Synthetic sequence.
DELEDVRKEIEDVRKENEDTVRESKDEIRRLEDTNRKTLKESRDDIEKARERVKKERRD

SEQ ID NO: 8445 - protein, 59 aa, Artificial Sequence
  Synthetic sequence.
EKDVRKVLKEVEEEARELVKLNRDVLEELRRRVRKLVEDNKDVTREVEDILKKLEEELK

SEQ ID NO: 8446 - protein, 57 aa, Artificial Sequence
  Synthetic sequence.
SMDETIRKLAEDNRRRSDETVERIERLAKKLDEDNRRVVEKSERLAKEVADKVRRVK

SEQ ID NO: 8447 - protein, 55 aa, Artificial Sequence
  Synthetic sequence.
ERVIKEVEDISRDLERKNKEVVERARRIVEKVKETNKRVLEEVEKIVRKLKEELK

SEQ ID NO: 8448 - protein, 60 aa, Artificial Sequence
  Synthetic sequence.
SVEEVVEEVRRVAEKVEEDVTRVIKEDEDIARELEKRIDDVIKESKTVADELLERLRRAG

SEQ ID NO: 8449 - protein, 59 aa, Artificial Sequence
  Synthetic sequence.
EEELERLLREVEELIERVKERHKRLVEDSKRLLDEVDKRLKDSNREVRERIEEIKRRVD

SEQ ID NO: 8450 - protein, 56 aa, Artificial Sequence
  Synthetic sequence.
DELEKIREEVREIVERSKREAKELLDRNKEIVKDLERKAREILRENRDRVRRLAEK

SEQ ID NO: 8451 - protein, 56 aa, Artificial Sequence
  Synthetic sequence.
SEVLDELRRIIETSEKLNRDVLRESKEVNRDLTRKLEEVLRRSKEDNKRLSEKIKE

SEQ ID NO: 8452 - protein, 56 aa, Artificial Sequence
  Synthetic sequence.
DELEAIKDEVRRIVRESEERAKKILRDVERMLDEIRKKLKEILDRNREVVDELKRQ

SEQ ID NO: 8453 - protein, 56 aa, Artificial Sequence
  Synthetic sequence.
SEVLKELRRIIEESKRRNKRVLDEIRKRAEDLRRVIKEVLDRSREINKRLSDEIRK

SEQ ID NO: 8454 - protein, 56 aa, Artificial Sequence
  Synthetic sequence.
DELEKIVREVREIVKESKEEARRILEENKKIVEELRRRLRKILEENEDMVRKLEKK

SEQ ID NO: 8455 - protein, 56 aa, Artificial Sequence
  Synthetic sequence.
SRVLEELERIIRESEEANKKVLEDSRRVNKKLSEELKRVLDESRRRNEELSKRIKD

SEQ ID NO: 8456 - protein, 60 aa, Artificial Sequence
  Synthetic sequence.
DELRDLEREIRRIVEESERHLKEVLERNHEASKRNRDDLKRMVDDIRRKVEEVRKLREEG

SEQ ID NO: 8457 - protein, 60 aa, Artificial Sequence
  Synthetic sequence.
AETVDRVLEKLKRIVEDSERRVKEVLKELEENSKRIKDETKDVLRKVEEIVERLRKEIER

SEQ ID NO: 8458 - protein, 60 aa, Artificial Sequence
  Synthetic sequence.
DELEELKEEVKRAVDENRETNKRALDRNHEISKDSEDHLRESSERIRRRIEELARLVEAG

SEQ ID NO: 8459 - protein, 60 aa, Artificial Sequence
  Synthetic sequence.
RETVKKVLKELREEIERVKRESEKVVKAVRDNSKRSEEKVEEVLERNKRIVDDVLRKIKK

SEQ ID NO: 8460 - protein, 60 aa, Artificial Sequence
  Synthetic sequence.
DELKEAEDRVREVVRENEERLRKALEENHKISRDSEKHLRDLERTIKEIVKRVRDLRRRG

SEQ ID NO: 8461 - protein, 60 aa, Artificial Sequence
  Synthetic sequence.
KDTVEKVLRDLRRIIKEVKERSREVLKRVRENSDRSLKKVEEVLKRLEDIIRTVKEEIKK

SEQ ID NO: 8462 - protein, 60 aa, Artificial Sequence
  Synthetic sequence.
EDAERALKKIEEIVRRLTEELKRVLDANRESVDRLRRELEEVLKRNRELVRKLEKILEER

SEQ ID NO: 8463 - protein, 56 aa, Artificial Sequence
  Synthetic sequence.
REVVERLKKIIADLDRVVEEVIRTSRKVIKELEDTVRRVIEELKRVSDELKKKVED

SEQ ID NO: 8464 - protein, 59 aa, Artificial Sequence
  Synthetic sequence.
DKLEELLKRVEELVERLKEESERVLRRNHELSEKLRRILEEILKRNHDLSRDLEDRLRK

SEQ ID NO: 8465 - protein, 56 aa, Artificial Sequence
  Synthetic sequence.
DEVVKRVEDIIEKVREDLERSDEKLNDNVRRLEREVREVLKAVEDNARRLAEKTKT

SEQ ID NO: 8466 - protein, 59 aa, Artificial Sequence
  Synthetic sequence.
SEAEKLLEEVKDLVRRLKKDLERVLRDNHRLSEELRRRLREILEENKKLIDTLREIREK

SEQ ID NO: 8467 - protein, 56 aa, Artificial Sequence
  Synthetic sequence.
KEVAEKMRKIVEELRKEVEEVLKALKENLDRLRREVEKVVERIEDTLRELKKRATD

SEQ ID NO: 8468 - protein, 60 aa, Artificial Sequence
  Synthetic sequence.
SEAEKVLEEVKRLVEDIERKLREMLRRDNEISRKVRDDLRKILEENNELSRRVEEEIRRI

SEQ ID NO: 8469 - protein, 56 aa, Artificial Sequence
  Synthetic sequence.
EEVVEALEKVVRDVARRLEDVIRRVAENAKRLEDDLRKVEEELKENADRLEERAKK

SEQ ID NO: 8470 - protein, 59 aa, Artificial Sequence
  Synthetic sequence.
SEVEKLLEKLRELVERVEREARRILEENKELIKESLKRIRDLLEDNKRLIREVKEILRR

SEQ ID NO: 8471 - protein, 56 aa, Artificial Sequence
  Synthetic sequence.
KDVVKRIRDIAEKVRRDLKRVIDAVRDTSRESDRRLRDVIREVDESSRELVREIER

SEQ ID NO: 8472 - protein, 59 aa, Artificial Sequence
  Synthetic sequence.
SDMERLLRELEELVKELRERLRRLLEENKDLIRRSLDRARKLVRRIEELVRKVKEDLDR

SEQ ID NO: 8473 - protein, 56 aa, Artificial Sequence
  Synthetic sequence.
EDVLRKIEETARRLVKEIEDVIREVERTSRESDKKLEDVIDKLRKIVRKVLEELRT

SEQ ID NO: 8474 - protein, 59 aa, Artificial Sequence
  Synthetic sequence.
SEVEDLVRELERLVREAKKALDDLRRKLEELVRDSLRKAEELLKENHDLSREVKKLLED

SEQ ID NO: 8475 - protein, 56 aa, Artificial Sequence
  Synthetic sequence.
KKVADELRRIAKRLVEELERVIRELEKIAKESDERLKEVIDRLRENVERLVRELRR

SEQ ID NO: 8476 - protein, 60 aa, Artificial Sequence
  Synthetic sequence.
KELEDLDRDVRRVVEELREELRRLEEEDKRSVEENEERLERLERRLRKKVKELEEKRKRI

SEQ ID NO: 8477 - protein, 60 aa, Artificial Sequence
  Synthetic sequence.
REEVRRVLEELREKIKRVLEEIEEVLRRSREINKRLRDRTRTVAKRLKEIVDDVLRKVET

SEQ ID NO: 8478 - protein, 60 aa, Artificial Sequence
  Synthetic sequence.
RELEELLKEVEKAVRENTKLLKDLLDKDKKSVKENEETLRDLERKLREVVERLKRELKDI

SEQ ID NO: 8479 - protein, 60 aa, Artificial Sequence
  Synthetic sequence.
EKRVRDVLKRLREIIDTVKKVTKEVMERSEEINRRLLKRTKDVLRELEKIVKTVLDEVRK

SEQ ID NO: 8480 - protein, 56 aa, Artificial Sequence
  Synthetic sequence.
SEVDKVREDVKRLIEDAERVSDDVDRRVKRLAEALKETSDKVKEDVERLVRDIKRE

SEQ ID NO: 8481 - protein, 59 aa, Artificial Sequence
  Synthetic sequence.
EETLRRVLRKVEDVIRRNKEDNEKVLKDAKRVVEEDKRENEKALERIERIVRKLKEDTR

SEQ ID NO: 8482 - protein, 56 aa, Artificial Sequence
  Synthetic sequence.
SEAEEVVRRVEKLAEDIKRVIDKSLEDVERLVRDAKRRSREVLREVEKLVEDITRR

SEQ ID NO: 8483 - protein, 59 aa, Artificial Sequence
  Synthetic sequence.
EEILRRALEKVERVITENKKENEDALRDAKRKIDKDKEDNKKVLDDVRRIIEELKEETR

SEQ ID NO: 8484 - protein, 61 aa, Artificial Sequence
  Synthetic sequence.
DEVDRVAEEVKKLIDDVKRVSDEMLKRSEDLIREVKKTSDDVLETVERLIRDVERKVEERV

SEQ ID NO: 8485 - protein, 59 aa, Artificial Sequence
  Synthetic sequence.
DEVLKRLLDKIREDAKRNKDDNKRNLDESKKEVDRNKDENRRVLEKVKETVKRLKDEVK

SEQ ID NO: 8486 - protein, 61 aa, Artificial Sequence
  Synthetic sequence.
KEVEEMLKEVKKLIEKVKRRSDDVLRRSEELARDLKKMSDDVLREVKKLIDDVKRTVDERV

SEQ ID NO: 8487 - protein, 59 aa, Artificial Sequence
  Synthetic sequence.
REFLKEVLDRVRERVEENERRNDENLKKSKKRIDENKEKNERVLRKIREIARRLKEELR

SEQ ID NO: 8488 - protein, 61 aa, Artificial Sequence
  Synthetic sequence.
SEVDRVLKTVEELIRRVKRISDRVLTEVKKLVDDVRRVVEKSRRDVEELVKEVKRSVDERV

SEQ ID NO: 8489 - protein, 59 aa, Artificial Sequence
  Synthetic sequence.
KEMLERALKEIKEEVKRNEDDNRRMLREIEELAKRNKEENKRVLDEVRDIVRRLAEEVK

SEQ ID NO: 8490 - protein, 61 aa, Artificial Sequence
  Synthetic sequence.
EEVERVREEVDKLLKTLKEVSDRVLKASKDLLDRVKEIVEKSLRDVKRLIDDVKRKVDERV

SEQ ID NO: 8491 - protein, 59 aa, Artificial Sequence
  Synthetic sequence.
KEVLERLLKKAEEIIRKNKKENDDNLEESRKEIEKNEEDNRELVKRIEDEVRRLKKEVE

SEQ ID NO: 8492 - protein, 61 aa, Artificial Sequence
  Synthetic sequence.
SEVEEVLRRVRELIERVKRIVDESEKEVRRLIEEVKKIVEESLKRVEELLRDVKRRVDERV

SEQ ID NO: 8493 - protein, 59 aa, Artificial Sequence
  Synthetic sequence.
RKMLREVLEKIKKIVKDNEDDNRRALTEVRERVRENVEENKKVVDRVRKIAEDLRKEVE

SEQ ID NO: 8494 - protein, 61 aa, Artificial Sequence
  Synthetic sequence.
SEVERVLEEVKKLIEDVKRVVKESEEEVEKLIRDVEREVERSKRTVDELVKDVKRAVDRDV

SEQ ID NO: 8495 - protein, 59 aa, Artificial Sequence
  Synthetic sequence.
REVLTKVLREVEEAVRRNKERNKRALEEVKKTVDRNREDNKRMVDKVRETAKRLKDEVR

SEQ ID NO: 8496 - protein, 56 aa, Artificial Sequence
  Synthetic sequence.
SSIEKVREDVKELIRDVERAVKRVKEESKKLVDDLRRAVKRVEEESRKLLKDLERN

SEQ ID NO: 8497 - protein, 59 aa, Artificial Sequence
  Synthetic sequence.
DDDVRRVLREIERIVKEVKDDLKRVLEESERSIRRVKEELRRVLEDNRRLLKEVKDRAR

SEQ ID NO: 8498 - protein, 60 aa, Artificial Sequence
  Synthetic sequence.
SEVEAVLREVEERVDRVRKESEKTLREVERLVREAKRRSKKSLDDVKKKVEEVKKKIRDI

SEQ ID NO: 8499 - protein, 55 aa, Artificial Sequence
  Synthetic sequence.
EEVKREIEKLVEDVRRVSDRVVEEIKELVKDVERMSRKVVEDIKRLAEDVRREAE

SEQ ID NO: 8500 - protein, 60 aa, Artificial Sequence
  Synthetic sequence.
DEVERVLEEVKERVDRVKRESEKSLKEVEKLVRTNERLSERTLKEVRDLVEDAKKKIDDI

SEQ ID NO: 8501 - protein, 55 aa, Artificial Sequence
  Synthetic sequence.
EEVRREIEKLVEDVKRVSDKVVEDIRRLAEKLRRDNKRAEDEIRKLVRDVERRAK

SEQ ID NO: 8502 - protein, 60 aa, Artificial Sequence
  Synthetic sequence.
DDLERVLEEVRKLVKELKERSRKSLEDVRRSNERNETESRRTLREVRELVKKVKEVIDRT

SEQ ID NO: 8503 - protein, 55 aa, Artificial Sequence
  Synthetic sequence.
EKVKEDIRRLVEEVERVSREVVERIKKLADESRKKNKKVIDEIKELVKRVRDRAK

SEQ ID NO: 8504 - protein, 60 aa, Artificial Sequence
  Synthetic sequence.
REMEEVLKEVEKRVRDIEDESRKTLERVDKLVKKNKRDSERTLKEVEDLVREVKKEIRRI

SEQ ID NO: 8505 - protein, 55 aa, Artificial Sequence
  Synthetic sequence.
EEVKREIKKLADRVREVSERVVREIEKLVRDIKRRNEEVIDEIRKLVEDVKREAK

SEQ ID NO: 8506 - protein, 60 aa, Artificial Sequence
  Synthetic sequence.
KEVEDVLEEVKELVKELKRVSEETLRRVEKSNRENEEKSKTTLKEVEDRVERVKEEIKKT

SEQ ID NO: 8507 - protein, 55 aa, Artificial Sequence
  Synthetic sequence.
EEVKREIKKLVEEVRRVSEEVVREIKKLVDKSRRVNEKVIEDIKELAKEVEEAAR

SEQ ID NO: 8508 - protein, 60 aa, Artificial Sequence
  Synthetic sequence.
SELEEILERVRKMAEDAERISEETLRRSEELIRRVKDLSRESLERVERLIRKVKKEIEEI

SEQ ID NO: 8509 - protein, 58 aa, Artificial Sequence
  Synthetic sequence.
EEVLRVIKAIEDLLRRVERVSREASKTSEELLKDITRVSEKSKEDIKRLLDDVRRKVK

SEQ ID NO: 8510 - protein, 60 aa, Artificial Sequence
  Synthetic sequence.
SELDEVLKTVEELVRRIKEKLKEILDRSRKLVEEARKLSEDSLREVKRVIDEIKREAERQ

SEQ ID NO: 8511 - protein, 58 aa, Artificial Sequence
  Synthetic sequence.
EEVLKLVEDVRRLVEDVDRTVERMSRESKKLAEDIKRVSEKSKRDIERLLADVERTVR

SEQ ID NO: 8512 - protein, 60 aa, Artificial Sequence
  Synthetic sequence.
DELDEVLKEVEELIKRVKRESERTLKENRDMVREIKRRSEESLREVRELIERVKDELRRT

SEQ ID NO: 8513 - protein, 58 aa, Artificial Sequence
  Synthetic sequence.
ERVARVVRRVEELLEDVERRSREVLKEMDKTAKEVKKASEKSEEDIKRLLEDVERTVR

SEQ ID NO: 8514 - protein, 60 aa, Artificial Sequence
  Synthetic sequence.
KEAEDILKEVEDIIREAKKLSERTLDENRKVIRKAKEDSRRSLEEVRKIIEDVKEELDRI

SEQ ID NO: 8515 - protein, 58 aa, Artificial Sequence
  Synthetic sequence.
ERVLRVIREIEKLLEDVKRVSERSVKEMKKTLDDVRRASKRSEEEIERLLRDVERRVT

SEQ ID NO: 8516 - protein, 60 aa, Artificial Sequence
  Synthetic sequence.
RSLEEVLKEVEELIRRAKEESKRTLDDVRKLIEEVKRESERSLRDVREMIERAKDRIRRI

SEQ ID NO: 8517 - protein, 58 aa, Artificial Sequence
  Synthetic sequence.
EEVRKVVEDVERLLRDVERMSKEVEKRIRELLDDIRRVSERSRREIERLLEDVERTAR

SEQ ID NO: 8518 - protein, 60 aa, Artificial Sequence
  Synthetic sequence.
DELEEILKRIEDRIREIKERSKKTLDDIRKVAERVEERSRESLKEVREVVEEIKDRIRRI

SEQ ID NO: 8519 - protein, 58 aa, Artificial Sequence
  Synthetic sequence.
REVLKVIRDIEELLREVAEVSERSRREIEKLLEDVERVSREAIKRIKDLLRDVERTVK

SEQ ID NO: 8520 - protein, 60 aa, Artificial Sequence
  Synthetic sequence.
KEIEELLDEIRRLMERSKENVRRSLKKSKDLIEEAKRRLEKSLEDSRELIRRIEDRIRRI

SEQ ID NO: 8521 - protein, 55 aa, Artificial Sequence
  Synthetic sequence.
KEVLEEIRRLLEDLRRMNEKSIEDSKRLLEDVARAVKRSIDESRKLLEKIERDVD

SEQ ID NO: 8522 - protein, 60 aa, Artificial Sequence
  Synthetic sequence.
KEMEDLLREAEELIRRSVENVKRSLEESEKLIRESKKNVERSLRRSEELAKEIKDEIRRI

SEQ ID NO: 8523 - protein, 55 aa, Artificial Sequence
  Synthetic sequence.
ERVLREIRRLLRELEEINEKSIRDSKRLLEEIERVNRDSIRRSKELLEDVERTVR

SEQ ID NO: 8524 - protein, 60 aa, Artificial Sequence
  Synthetic sequence.
SEVEDLLRRAEELIRRAKERLERSLRRVEKLIDDVRRKLERNNETVKRLVEEIKEKIKRI

SEQ ID NO: 8525 - protein, 55 aa, Artificial Sequence
  Synthetic sequence.
EEMLKEIERLLEDIERVVRETIDTTRRLLEKIEREVREVIKSNRELVADLERTVT

SEQ ID NO: 8526 - protein, 60 aa, Artificial Sequence
  Synthetic sequence.
DEVERLLEEVKRLIDRAREELKKSLDRVRRLVRENEEAVRKNNEDVADLIRKIKEKIEKI

SEQ ID NO: 8527 - protein, 55 aa, Artificial Sequence
  Synthetic sequence.
KKVLDDIRRLLKDIKDIVDKTIRDTKELLRDIEEKNRRATKSNKDLLEEIRETVR

SEQ ID NO: 8528 - protein, 59 aa, Artificial Sequence
  Synthetic sequence.
DEVEKLLRRVEKEVDRIKRELEDNLRRVEKLVKEIHEENEKLMRKARKLVEDIKRIIDR

SEQ ID NO: 8529 - protein, 59 aa, Artificial Sequence
  Synthetic sequence.
SEEVKKAEKEIRRLLDELRRVVEEVTKKTKELLRRLKKSSDELRKTIKELLRELEEKVR

SEQ ID NO: 8530 - protein, 59 aa, Artificial Sequence
  Synthetic sequence.
KEVDEILRELEELVKEIKKRLEELTREVKRLVDKIHKDNEDNLRDMARLVEEIKEIIRR

SEQ ID NO: 8531 - protein, 59 aa, Artificial Sequence
  Synthetic sequence.
SKEVERVERDVERLLDELRRVVKEVLDRIRRLLEELERSSKRVKEETERLVKEVREAAK

SEQ ID NO: 8532 - protein, 59 aa, Artificial Sequence
  Synthetic sequence.
SEVDKILEDLRELVERIHKKNKRIVEEDRELVKEIHRKNEENLKTMERLVEEIEKIIRR

SEQ ID NO: 8533 - protein, 59 aa, Artificial Sequence
  Synthetic sequence.
SEEVKRVRKDVDRLLKELEDSSREVKERSRRTLEELERSSREVKERTERLLRKLEKAVE

SEQ ID NO: 8534 - protein, 59 aa, Artificial Sequence
  Synthetic sequence.
DRLEEILKELRELVETIHRRNEEIVRKVAELVKRIHDHNEENTRRVEELVRRIKDIIRR

SEQ ID NO: 8535 - protein, 59 aa, Artificial Sequence
  Synthetic sequence.
SEDVERAKRDVDRLLKELEESSERVLRTIEKLLKELRESSKRVRDETKRLLDELREAVR

SEQ ID NO: 8536 - protein, 59 aa, Artificial Sequence
  Synthetic sequence.
SELDEILKRLEKLVEDIKRKLEKLVRDLERLVKRIHDHNEENLKTVKKLVDEIKDIIRR

SEQ ID NO: 8537 - protein, 59 aa, Artificial Sequence
  Synthetic sequence.
SREVDRVREDVRRLLEDLKRVAERVKRDIERLLKELKESSDEVKKRTEELLEELERAVR

SEQ ID NO: 8538 - protein, 59 aa, Artificial Sequence
  Synthetic sequence.
DEVDDILRRLRELVERIKKHLEDNLRELEELVKRIHDHNKRNVEEVKKLVEEIKKIIAD

SEQ ID NO: 8539 - protein, 59 aa, Artificial Sequence
  Synthetic sequence.
SEEVRRVKEEVERLLEEVRRVVRKVKEESKRLLEELRRSSDRVKKETERLLEELERAVK

SEQ ID NO: 8540 - protein, 59 aa, Artificial Sequence
  Synthetic sequence.
SEAEALVEEVKRIVEESKRRLEKVVEESRKLVEEVKKRLRDMLKTIEDLVKEVKELLDN

SEQ ID NO: 8541 - protein, 55 aa, Artificial Sequence
  Synthetic sequence.
EEVKRKVERLLEEDRRVLEEVKESAKRTSKEVRDELREVSKRVEKLLKDVRDAAR

SEQ ID NO: 8542 - protein, 59 aa, Artificial Sequence
  Synthetic sequence.
DEAEDLVRRVRDIVRKSREELKRVVEESDRLVEEVKRRLKKVVEDSKRLVDEVRKLREG

SEQ ID NO: 8543 - protein, 55 aa, Artificial Sequence
  Synthetic sequence.
EEVKREVERLLEDDERVLREVAKRSRETLETVRKVLEEVERRSRKTLEEVEKTAR

SEQ ID NO: 8544 - protein, 59 aa, Artificial Sequence
  Synthetic sequence.
SEMDELVDRARRIVEESRRLLEEVVKRSKDLVKDVKKKLEDALRRVEEIVRRLDEELKG

SEQ ID NO: 8545 - protein, 55 aa, Artificial Sequence
  Synthetic sequence.
EEVKDEVRKLIEEDKKVLDDVRRKSERTLREVEDVLRRVEEEVEKLLRKVEESAK

SEQ ID NO: 8546 - protein, 59 aa, Artificial Sequence
  Synthetic sequence.
DEAEKLVEDVRRIVEKIRKELEDVVEESRELVERIRRELERVVEESERLVEELRKELEK

SEQ ID NO: 8547 - protein, 55 aa, Artificial Sequence
  Synthetic sequence.
EEVKEEVKKLLEEVRDVLRKVKKASEETLRDVRRVLEEVKRRSEETLKRVREEAT

SEQ ID NO: 8548 - protein, 60 aa, Artificial Sequence
  Synthetic sequence.
SEVEDIVRDVKRLVEENHRRNEEIVRRDEDLVRRNNELNKRILEEVEELVRRLEDVARKI

SEQ ID NO: 8549 - protein, 55 aa, Artificial Sequence
  Synthetic sequence.
EEALRTAEELIKRLEDSLREVKDRSKRSLDEMKKSADDVRREIERLIKRVRDTTK

SEQ ID NO: 8550 - protein, 60 aa, Artificial Sequence
  Synthetic sequence.
SEVEKIVREVEEVVERIRKKSEDSLREVRRLVEEIKRRSEKTVEDDEKLVKDAKDELRRI

SEQ ID NO: 8551 - protein, 55 aa, Artificial Sequence
  Synthetic sequence.
EDAKRRIEELMKEVRDVSRRALKEIKDLLREVEEVSKKALKRSKDTVDEVREEVR

SEQ ID NO: 8552 - protein, 60 aa, Artificial Sequence
  Synthetic sequence.
DEVEEIVKEVARVVDEIRRLSKESLDRVRKLVEDIERELRKIVKTDRDLVEEAKRVLKDI

SEQ ID NO: 8553 - protein, 55 aa, Artificial Sequence
  Synthetic sequence.
REVEKEIRRLVEEVKEVSRKVRKEIEELMRRVEEVVKTVKEESKKTVREVEETAR

SEQ ID NO: 8554 - protein, 60 aa, Artificial Sequence
  Synthetic sequence.
DEADEIVKRVEEVVRRAKETLERILKRVEEMLDRIRKESEKTVREDEKLVEEVKDRLRKI

SEQ ID NO: 8555 - protein, 55 aa, Artificial Sequence
  Synthetic sequence.
ERLLREIKRLLKEVEDEVRRVEKAIKELVDRVKEVSDRALERSKRTVREVEERVR

SEQ ID NO: 8556 - protein, 56 aa, Artificial Sequence
  Synthetic sequence.
SEVEEVKEDSKRTLKELKDVAKKVDDDSKRLLEELERVARKSIEDSKRLLDELRER

SEQ ID NO: 8557 - protein, 59 aa, Artificial Sequence
  Synthetic sequence.
EKELRRLVEDDRRLVEEVKRDSERLLDEIRKLVEEIKERLRRSVEELRRRVEEIKKTTT

SEQ ID NO: 8558 - protein, 56 aa, Artificial Sequence
  Synthetic sequence.
SSVEKVKRDSERTLREVEKVIEKVDRDSERLLRDVERVITEADERSKDLLRRLEES

SEQ ID NO: 8559 - protein, 59 aa, Artificial Sequence
  Synthetic sequence.
DTDLRRLVEEDRKLVTRVKEESKRLLEELRRLVETVRKRSEDLLREIKKRVDEILRRTK

SEQ ID NO: 8560 - protein, 60 aa, Artificial Sequence
  Synthetic sequence.
DEIKEVIDRITKVLEDNERVVRKLSEENKKVLDDIRRRAEEIIRRNEEVLRRIKELAKRN

SEQ ID NO: 8561 - protein, 55 aa, Artificial Sequence
  Synthetic sequence.
EELKKALDDILRRLEESNRKNIEDSRRILEDVERIVRRVVEVSKDIVRKAEEDVR

SEQ ID NO: 8562 - protein, 59 aa, Artificial Sequence
  Synthetic sequence.
SEVEEVIDELRKVLEENKRRVEELSRENDDVLRRIEERLKKIEDELEKILKDVRDLKDN

SEQ ID NO: 8563 - protein, 55 aa, Artificial Sequence
  Synthetic sequence.
ERLKEEITRILEELTRINEENKRRSEEILDRVRKDVERVLKRVEDILKEIEDELR

SEQ ID NO: 8564 - protein, 60 aa, Artificial Sequence
  Synthetic sequence.
SSVEELEERLRRVLERSERHLRKLEKKVEEVLDESRKNLTRLLRDVERVLRDVEETVRRE

SEQ ID NO: 8565 - protein, 59 aa, Artificial Sequence
  Synthetic sequence.
ERKARELKRTVKRLAEESRKILREVEEKVRKVAEDSERILEEVERTVKRVVEEIDRTVR

SEQ ID NO: 8566 - protein, 60 aa, Artificial Sequence
  Synthetic sequence.
SKVEKLLRELEEVLKDSERHVREDSDRLRRVLEDSERHVRKVLRDVEKVLREVEDMVRKR

SEQ ID NO: 8567 - protein, 59 aa, Artificial Sequence
  Synthetic sequence.
EEKARRLEERVEEIVRESERTSRENNKKSRDIIKTSEDILREAADRVREVVERIRRTLT

SEQ ID NO: 8568 - protein, 60 aa, Artificial Sequence
  Synthetic sequence.
KEVEEVIERSKKSNEENERRLRKILEEARRINEENEKLLRKILEEAKRVVEEVRRILKDN

SEQ ID NO: 8569 - protein, 59 aa, Artificial Sequence
  Synthetic sequence.
KEELDKLREESKKILRHSERLLKEVEEEVKRILEHSEELLRRVEDKVRRLLKEIEDALR

SEQ ID NO: 8570 - protein, 60 aa, Artificial Sequence
  Synthetic sequence.
DEVEEVEKKVDKIDKENEDLLRKVIRDAERINEENTRLLEDILRKAKKMVDDVREILKDR

SEQ ID NO: 8571 - protein, 59 aa, Artificial Sequence
  Synthetic sequence.
EEEVRRVAERVKEVVKHSRELLKRVEDMVRRIVEHSKRLLDEVRERVKDLLRKIAEARK

SEQ ID NO: 8572 - protein, 59 aa, Artificial Sequence
  Synthetic sequence.
DEVREVVRRLEEIVRDVNKKNRESVREAERLVDRLREILEETSRRLKELVDRVKELIKG

SEQ ID NO: 8573 - protein, 59 aa, Artificial Sequence
  Synthetic sequence.
EKEARELEDAVRKLIERLKRSAEEVKKRVEELDEEIRRVVEEDRRTIKELKEEIDRADK

SEQ ID NO: 8574 - protein, 59 aa, Artificial Sequence
  Synthetic sequence.
DEVEEAVKRIEDLVERLRELLEKTSREIEKILKESEDKLRESSDRIRRLLDELKKLIEN

SEQ ID NO: 8575 - protein, 59 aa, Artificial Sequence
  Synthetic sequence.
EEKLRKAEDTVRRVIKDVRKMLEDDRRTVEEVIRRDREALEKDRKTVDDVIEDVKRVAK

SEQ ID NO: 8576 - protein, 59 aa, Artificial Sequence
  Synthetic sequence.
SEVDEAVEEIKRILEESKKRLDETSEEIKRILEDSERRLRESSKRIRELVKELKKRIDG

SEQ ID NO: 8577 - protein, 59 aa, Artificial Sequence
  Synthetic sequence.
KDKLTRIREVVDKVVKEDEDALREDERTVREVIKRDRDLLEEDRRTVEDVIRKVRETAR

SEQ ID NO: 8578 - protein, 59 aa, Artificial Sequence
  Synthetic sequence.
SDAEKVVKRIKEIVEDSTRKVRDTSRDIRRILDESRKMLEDVVREIKDLVRRLEELIRG

SEQ ID NO: 8579 - protein, 59 aa, Artificial Sequence
  Synthetic sequence.
KDTLDKVREDAERVLEEDKKVADDDRKTVEDVIREDKRLLKRVEEEVKRVIKEVDDAAK

SEQ ID NO: 8580 - protein, 59 aa, Artificial Sequence
  Synthetic sequence.
SEVDRAVETIRRILEESEKIIRKVVREIEEILDRSRRLLEKSSEEIEDLVRRLKELIEG

SEQ ID NO: 8581 - protein, 59 aa, Artificial Sequence
  Synthetic sequence.
ERLLREAEKDVRRVVEEDEKVLRDVARRVEEVIKADKKLLREDEKTVREVIERVKETAR

SEQ ID NO: 8582 - protein, 59 aa, Artificial Sequence
  Synthetic sequence.
DEFREAVRRIKEIIDDSRRKLEKNVKENEELLKRSDDELRKSSEDIKKLLEELRRLIEG

SEQ ID NO: 8583 - protein, 59 aa, Artificial Sequence
  Synthetic sequence.
EKSLREVEERVERLLEDDRRLLEENARRVEDLIRKDKEALDRDRKTVEDVKREVEKDAR

SEQ ID NO: 8584 - protein, 59 aa, Artificial Sequence
  Synthetic sequence.
SEVDEVVKRIAEIVKTSKDELREAVKRIEDIVRRSEKMVRDNLRENERLVRELDKLAKG

SEQ ID NO: 8585 - protein, 59 aa, Artificial Sequence
  Synthetic sequence.
KEKLDRVTETVRRLIEEDKRALEDVERKVEDVIRRDREVLERNRREVERLIKEIEDKRR

SEQ ID NO: 8586 - protein, 59 aa, Artificial Sequence
  Synthetic sequence.
KDAERAVEEIRKILEDSKEKMERNVRENEKLVRDSRRKLEENVERNEKLVRDLKRLKEG

SEQ ID NO: 8587 - protein, 59 aa, Artificial Sequence
  Synthetic sequence.
KDTLKRVTDEVRRVVEEDKRVLEENRRRVEKLIEEDKRALDENRERVRKLIEDIDKDAT

SEQ ID NO: 8588 - protein, 59 aa, Artificial Sequence
  Synthetic sequence.
DEVEDAVEKLKRLVDELERLLREAVRRIEKILEDSTRKVRKNLEENKELVKRLRELIKN

SEQ ID NO: 8589 - protein, 59 aa, Artificial Sequence
  Synthetic sequence.
KDLLRKVAEVVRRLEEEIRRLLEEAKRVVDEVIKKDRTVMERNREEVERLIREIEETAR

SEQ ID NO: 8590 - protein, 59 aa, Artificial Sequence
  Synthetic sequence.
SEVDEVVERIRRIIKKSKEELDKAVRDIEEILRRLEKELRDNVRENEKLVEDVRRAIEG

SEQ ID NO: 8591 - protein, 59 aa, Artificial Sequence
  Synthetic sequence.
KDKLERVSREAKRVLKEDEEALRDVEKKVTDVIEAVKKMLEDNRDRVRRLIEEIKRRAT

SEQ ID NO: 8592 - protein, 59 aa, Artificial Sequence
  Synthetic sequence.
DEIREAVKRIRRLLEESHRENKEIVDRLRKLVEESHRKNEKLKRELEELVKKLKEIIDK

SEQ ID NO: 8593 - protein, 59 aa, Artificial Sequence
  Synthetic sequence.
SEDLKRAEEEIRKVSEDNKRSVDRVREVVKRLSDENRRSLEEVREVVKRLIREVEEARR

SEQ ID NO: 8594 - protein, 59 aa, Artificial Sequence
  Synthetic sequence.
DEIRKVVKEITDLLKKSNDKNRKVVEEIRDLLRKSKKLADELVERLRKLVEDLRRRIDK

SEQ ID NO: 8595 - protein, 59 aa, Artificial Sequence
  Synthetic sequence.
SEDLKRVEERAREVSRRNEESMRRVKEDADRVSEKNKEVLDRVREEVKRLIEEVRETLR

SEQ ID NO: 8596 - protein, 59 aa, Artificial Sequence
  Synthetic sequence.
DRIRDVAREIRELLKRSNDENRKVVEEVRRLLKESNDTNKRVVDEVRELLERLKEIARR

SEQ ID NO: 8597 - protein, 59 aa, Artificial Sequence
  Synthetic sequence.
SEDLKRIRREVEKVSEDNKRSAKEVEDEARKVSEDNERSVRDVKEKADRVIKEVEDEDR

SEQ ID NO: 8598 - protein, 60 aa, Artificial Sequence
  Synthetic sequence.
DEERKIKRVLDEVDKHSKRVIAEAKRVVDEVLREVEKVVRRNKEVLDEILREVKRILDEG

SEQ ID NO: 8599 - protein, 55 aa, Artificial Sequence
  Synthetic sequence.
EELIKTIRKVNKEIEDRVRDLIKTVRDILRRIEEEVRKSIEDSKRLLRELEARAE

SEQ ID NO: 8600 - protein, 57 aa, Artificial Sequence
  Synthetic sequence.
SVVEDLKRTVEEVVKKSEEILKEDRKTVEKVVEEVKKSDKEDRDDVDRVVKEVRKRI

SEQ ID NO: 8601 - protein, 59 aa, Artificial Sequence
  Synthetic sequence.
KDLADKVKKDAEEVLKRSKEHVDRSIDRTREILKRLRETNEESIKRTRDILRKIAEEAR

SEQ ID NO: 8602 - protein, 57 aa, Artificial Sequence
  Synthetic sequence.
SVSEELKKKVEKVARDVERSLERDATEVTKVVEEVKKSDRKDEETVKRVVKRVDELI

SEQ ID NO: 8603 - protein, 59 aa, Artificial Sequence
  Synthetic sequence.
REVAEKVIRDAEKVLDDIRRMNEESIRDTRRVLEENKRKNEESIRKTEEILRRIEEESR

SEQ ID NO: 8604 - protein, 60 aa, Artificial Sequence
  Synthetic sequence.
SEVDEVLKELERINRENHREVEELLRRLERILRESKKHIKEVIEDLRRRLKELEDEVRRR

SEQ ID NO: 8605 - protein, 59 aa, Artificial Sequence
  Synthetic sequence.
EKKVRELEEEARRVKRSTEEVIKRLRDSVEKLVKDSERVLRELKKEVERVVEEIDKMIK

SEQ ID NO: 8606 - protein, 60 aa, Artificial Sequence
  Synthetic sequence.
DEVEKALEESKKSNEENHRKVKKVLESAKDINRRNHDLVRDVIRKLEEILRRIEKVVREG

SEQ ID NO: 8607 - protein, 59 aa, Artificial Sequence
  Synthetic sequence.
DKEVTELRESSRRSIESTREAVRTLEEAVREVIKSTDEAVKRLEATVKRIEEEIRKSMK

SEQ ID NO: 8608 - protein, 60 aa, Artificial Sequence
  Synthetic sequence.
DDVERVLKKSRDSNRENHEKVKRVIEKSDRSNEDNHRLVEDAIRKAEEILEEVERLVTAG

SEQ ID NO: 8609 - protein, 59 aa, Artificial Sequence
  Synthetic sequence.
KEEVDELRKSSEDSIRSTEDVVRKLEETSKRSIRSTEDVARKLEEAVRRIERRIRERTR

SEQ ID NO: 8610 - protein, 59 aa, Artificial Sequence
  Synthetic sequence.
SEVEEVLKRSKESVERVDRDVRRVLRELEDLNRKNHKRVEEVIRDAERILREVEDMVRR

SEQ ID NO: 8611 - protein, 59 aa, Artificial Sequence
  Synthetic sequence.
DKEVDELRKSSEKSVEDIKRVVDRLRDSARKIIKSTEDVVKELERRVREVIKRIKEEAT

SEQ ID NO: 8612 - protein, 58 aa, Artificial Sequence
  Synthetic sequence.
SEIEEIIKRIEKLLRDDEKKIRDSIKRSEDLLREANRENKESIDRVRELLEKVKRLRE

SEQ ID NO: 8613 - protein, 61 aa, Artificial Sequence
  Synthetic sequence.
KAEEEVRRLEKRVRDVLRELEKTLKRVTEVHKETTKENEKSARRVKREVEKVIEEVERTRT

SEQ ID NO: 8614 - protein, 58 aa, Artificial Sequence
  Synthetic sequence.
SEIEEIIRRIEELEERLKRELDRSIRTSEKLLEDAREINKESIRRVEKLLEEIRRVVD

SEQ ID NO: 8615 - protein, 61 aa, Artificial Sequence
  Synthetic sequence.
KAEERVRALEKAVKDVLESLKRLLDEVRKRHKESSEDNERSLKRSKEEAEKVIKAVEDERR

SEQ ID NO: 8616 - protein, 60 aa, Artificial Sequence
  Synthetic sequence.
SEIEDIIRRIRKLLEEDKEKIERSIRESRRLLEEAKRINEKSIEDVKRLLREIEDVVDKI

SEQ ID NO: 8617 - protein, 59 aa, Artificial Sequence
  Synthetic sequence.
REKVERLREDVDRVRKELEKTLETVTRSHKRSSEENKRSLEESERTARKVIEDIRRRDR

SEQ ID NO: 8618 - protein, 60 aa, Artificial Sequence
  Synthetic sequence.
KDIEEVLKRIKDLLEDIRRRLKESEERSRKLLEEAREINERSIERVRRLLEEIRRLKEEI

SEQ ID NO: 8619 - protein, 62 aa, Artificial Sequence
  Synthetic sequence.
EEMERKVRELERAVREVIKEVEKLLTDVARKHKKVSRDNKESLRRSEEEARRVIRAVEETDR

SEQ ID NO: 8620 - protein, 57 aa, Artificial Sequence
  Synthetic sequence.
STLETVEKKVEEVIRENEKSMRESEEKVDRSTKRIEDVLRRLEETIRKTSDDIAKDV

SEQ ID NO: 8621 - protein, 59 aa, Artificial Sequence
  Synthetic sequence.
REDATRVIEEAKRILDEARKLNEETIRRSEELVRRIERVIEEIIKRSEKLLEDVRRESK

SEQ ID NO: 8622 - protein, 57 aa, Artificial Sequence
  Synthetic sequence.
SVLDDVRKKVEEVLDRNRELADRSRRTVEEVLRENERVMEESKRTVDEVIKRVAEKL

SEQ ID NO: 8623 - protein, 59 aa, Artificial Sequence
  Synthetic sequence.
REDAERMIERLKRILDRVEEENRRAIEELREVLERVRDDNRRTIEELERILKRVEEESR

SEQ ID NO: 8624 - protein, 57 aa, Artificial Sequence
  Synthetic sequence.
STVETVREEVERVLKHSDDLIKEVEDVNRRVEEEIKRVIRELEEENERLVREVRKKV

SEQ ID NO: 8625 - protein, 59 aa, Artificial Sequence
  Synthetic sequence.
EEEAREIIKRLREVNKRTKEKLDELIKHSEEVLERVKRLIDELRKHSEEVLEDLRRRAK

SEQ ID NO: 8626 - protein, 57 aa, Artificial Sequence
  Synthetic sequence.
DEVERVAKEVEDVLREVEKLIRDVRRKVEEVLKHSEEVAKRVRDTNRELVKEVERDI

SEQ ID NO: 8627 - protein, 59 aa, Artificial Sequence
  Synthetic sequence.
EKELRDIIRRLKEVLDKLKKDLEDIIRRLEEVNRESERLAREAIRHSEEVLDKLRKDSK

SEQ ID NO: 8628 - protein, 60 aa, Artificial Sequence
  Synthetic sequence.
REVEEVKKRIREALEESERVIRENKKKNEELLDRVRKEIERNKKKNEEVLKRAKEVTKAG

SEQ ID NO: 8629 - protein, 55 aa, Artificial Sequence
  Synthetic sequence.
EDVKRKIDRMVEESRKLVEDLKRESDRVEEEVRKLVKTIKDEITRSLDEVRKDAE

SEQ ID NO: 8630 - protein, 60 aa, Artificial Sequence
  Synthetic sequence.
SEVDEVRKDIERILRKSERDIRRNKEENKRLLDEVRRRIEENRKENEDLLKRIEELRRAG

SEQ ID NO: 8631 - protein, 55 aa, Artificial Sequence
  Synthetic sequence.
EEVKKEIDKAVEDSKRLVEDAERVSDEVRERVRRLVERLKEESDRVEREVEKRTT

SEQ ID NO: 8632 - protein, 60 aa, Artificial Sequence
  Synthetic sequence.
SEVEEVLRRAEKLSEDNKRENDESLERLRRIVEKVREENEESVKTLEKILKEVEEVVRRN

SEQ ID NO: 8633 - protein, 59 aa, Artificial Sequence
  Synthetic sequence.
KEVIKRLEDEVRRLEEDNKRSIKKSEDEIRKLVERLKRSAERSDEVIRKLEKDAEDLIR

SEQ ID NO: 8634 - protein, 59 aa, Artificial Sequence
  Synthetic sequence.
DEVERILEDSKRLVDELRERVERVIEESKRLLDDLRRKVEEVVRRLEKIVEDLKRMIEG

SEQ ID NO: 8635 - protein, 59 aa, Artificial Sequence
  Synthetic sequence.
EDKVRELKETADRSNEEIKRVLEKIKRMIEDTNRKIKKLLEEIRDVARRVLEEVREVAR

SEQ ID NO: 8636 - protein, 59 aa, Artificial Sequence
  Synthetic sequence.
KEVEDVLRESKRLVEDLERRSERSIEESKRLLKELEDLVEEVIRRSEESIDRLRELIKG

SEQ ID NO: 8637 - protein, 59 aa, Artificial Sequence
  Synthetic sequence.
EKKVRDAEREARDSNDKIRRSLEKVERVVRETNRRIKELLEKIERVIRDTDRKIAEEAK

SEQ ID NO: 8638 - protein, 59 aa, Artificial Sequence
  Synthetic sequence.
SEVEKIVRDSEKLLEDLKRELEKVIKDSDDLVRELKKRVTEVLERLRRIVEELRKLIEG

SEQ ID NO: 8639 - protein, 59 aa, Artificial Sequence
  Synthetic sequence.
EEKVRRLEKEARRTNEEIRKLLEKVDEVARRSNERIKAVLEEIKREIEKLKREVEKDAK

SEQ ID NO: 8640 - protein, 59 aa, Artificial Sequence
  Synthetic sequence.
SEIEEVLKKSKKLVDDLRKEVEETIRESKKTVDDLDKEIKEVVRRSEESLDRLKKLIDG

SEQ ID NO: 8641 - protein, 59 aa, Artificial Sequence
  Synthetic sequence.
ERKVDEIRRAVEETNEEIKRVVDEDNKAVKRSLEEIERVAEEIKRVAEETLKAIEDARR

SEQ ID NO: 8642 - protein, 59 aa, Artificial Sequence
  Synthetic sequence.
DEVEELVRRLEELVKRSRDTNRKIIKEIRELSERLKRELEKIARELEKLVEDLKEEVKR

SEQ ID NO: 8643 - protein, 56 aa, Artificial Sequence
  Synthetic sequence.
VEKIEDVVRRLLEENERVLRRTEEEARRVLETNRDLLRKIREVVDRLEKEIREAEK

SEQ ID NO: 8644 - protein, 58 aa, Artificial Sequence
  Synthetic sequence.
SDADRVAEELKKLVEDSRRENERVIEESKRLVKENEDRNRELIERLKKLVDKLRDILE

SEQ ID NO: 8645 - protein, 56 aa, Artificial Sequence
  Synthetic sequence.
VDKVRETVKRLLEENKRVMEKTEEVAKKSSEDIKRVADETRRRAEELLKEVDELRK

SEQ ID NO: 8646 - protein, 59 aa, Artificial Sequence
  Synthetic sequence.
SEADEMLRRLKELVDRSRDTNRKILKRSEDLVRDSKKKNDDIIRELRRLLEELRELARR

SEQ ID NO: 8647 - protein, 56 aa, Artificial Sequence
  Synthetic sequence.
TDDVRREVERLLRDNKRVLDETRKAAEESTRRNKKVLEESREVVKDVLKKIEDTDR

SEQ ID NO: 8648 - protein, 59 aa, Artificial Sequence
  Synthetic sequence.
DEVREVAERLRRLVDESRKRNEEVIKESEALVDRVRKTNEEVMKRLRELIDKLEKDIRR

SEQ ID NO: 8649 - protein, 56 aa, Artificial Sequence
  Synthetic sequence.
VETIERVVRELLEENKEVLRKTEEMVKRSTETNKRLLERSKEVADRLRERIKEAAK

SEQ ID NO: 8650 - protein, 59 aa, Artificial Sequence
  Synthetic sequence.
DEVDELLKRLRKLVDEVRKENDKMVKESKRLVEDLKRKIDEIIERIERLLEELEKILKD

SEQ ID NO: 8651 - protein, 56 aa, Artificial Sequence
  Synthetic sequence.
VEDIEREAERLLRENEELLRRSEEVIRRSTEKIKKVLRDAEERAREILKRVEDAAK

SEQ ID NO: 8652 - protein, 60 aa, Artificial Sequence
  Synthetic sequence.
DEVEEVKKKLREIVKRDRDLIERVREELKEILDRNREINRRAIEDLKRILEEVDELVKRG

SEQ ID NO: 8653 - protein, 59 aa, Artificial Sequence
  Synthetic sequence.
EELIRDVERVVREVLRRIEKSIRDLDRVIRDVLDKSRELIKRSEDVAKRVVDTLREKAR

SEQ ID NO: 8654 - protein, 61 aa, Artificial Sequence
  Synthetic sequence.
DEVETVKKELKELADEVKERNERSIRDSERLLEEVKRRNEKSIRDLERLVEELEDVLRKRG

SEQ ID NO: 8655 - protein, 59 aa, Artificial Sequence
  Synthetic sequence.
EKKVKEVTDEVKKVLDEIRELDKRSRDAVRRTNEEIKRLDKESKDVVDRVKKKVEDAVR

SEQ ID NO: 8656 - protein, 61 aa, Artificial Sequence
  Synthetic sequence.
REVEEIIERLKKLLKEIAERNTESIKELEELVRRIAEDNKRIIEELRRLLEELADVVRKKG

SEQ ID NO: 8657 - protein, 59 aa, Artificial Sequence
  Synthetic sequence.
EKKVREVRKVAEEVLRAIEELDKRSRDAVRRVTKRVKDLDEETKRVVEDVLRRIEELMK

SEQ ID NO: 8658 - protein, 61 aa, Artificial Sequence
  Synthetic sequence.
SRVEEIIEDLRRLLEEIRKENEDSIRRSKELLDRVKEINDTIIKELERLLKDIEKEVREKG

SEQ ID NO: 8659 - protein, 59 aa, Artificial Sequence
  Synthetic sequence.
EDKVRKVREVAEKVLRDIDKLDRESKEAFRRTNEEIRKLDEDTRRVAERVKKAIEDLAK

SEQ ID NO: 8660 - protein, 61 aa, Artificial Sequence
  Synthetic sequence.
SEVEEIIRRLEELVREVAKRNEDIIKRSRDLIRKVKEDNRRSEEELRDLSRRIADIVRKKG

SEQ ID NO: 8661 - protein, 59 aa, Artificial Sequence
  Synthetic sequence.
ERKVREVRRVAKKVLEDVKTLDDKTREVARRTNEDIKRLDEKSRKVIEEVRREIEELKR

SEQ ID NO: 8662 - protein, 61 aa, Artificial Sequence
  Synthetic sequence.
SEVDEIIKELERLLREIARENERIIRESRKLADEVRKRNEDAIRKLEELVRRLADMVRRKG

SEQ ID NO: 8663 - protein, 59 aa, Artificial Sequence
  Synthetic sequence.
KDKVTKVKKVADDVLREIKKLDDETRRVIEDTNKKIKDLDKKTRDVVRKVLEEVKKLEK

SEQ ID NO: 8664 - protein, 61 aa, Artificial Sequence
  Synthetic sequence.
SDVEDVIRKLETLVDDLRRKVERIKERSRELIKRIAEENRKVIEELERLLEELADVVRRKG

SEQ ID NO: 8665 - protein, 59 aa, Artificial Sequence
  Synthetic sequence.
EKKVRDVRRVAEKVLREVRRLMEEVERVARKTNRDIERLDEETRRVVEKVRKEIEDLRR

SEQ ID NO: 8666 - protein, 57 aa, Artificial Sequence
  Synthetic sequence.
SAKDKIAEVAKRVLTENKKLLEESEEVARRTSEESKRLLKESEDVVRRVLDEIRREI

SEQ ID NO: 8667 - protein, 59 aa, Artificial Sequence
  Synthetic sequence.
ERLIEEVIRRLEELLKEVKKKNEEVIRRSKELIDRDRDLNRRSIEELERLIREVRKESK

SEQ ID NO: 8668 - protein, 57 aa, Artificial Sequence
  Synthetic sequence.
SAKEKIKEVAERVEKRNKELLEESERVIKEVSERSERLLDESRKVVKRSTEEIRDKI

SEQ ID NO: 8669 - protein, 59 aa, Artificial Sequence
  Synthetic sequence.
EELIREVIERLKELVDRVEKENRKAIETSRRLLKEDEDLNRESIKRSEELVKDVRRRST

SEQ ID NO: 8670 - protein, 57 aa, Artificial Sequence
  Synthetic sequence.
DARKELEEVVRRVEEEIRRLLKDIEDVAREVNRRSEKLLRETEEVIRRSTEEIKRDV

SEQ ID NO: 8671 - protein, 59 aa, Artificial Sequence
  Synthetic sequence.
RERVKEIIERLRRLVEELKKLVDEVRKRLEDVVRELKERNKKVIDDSKDLVRRAREESR

SEQ ID NO: 8672 - protein, 59 aa, Artificial Sequence
  Synthetic sequence.
DFSERLDEVLRKVRTDIKKLVEKVRRVVEDSRRRVEKLVEDVRRSSEEVLKTVKELLDR

SEQ ID NO: 8673 - protein, 59 aa, Artificial Sequence
  Synthetic sequence.
DEVVRRLEKRLRDALKEAEDKVRRDEERNREVLERLEKIVRDLHRENEKAVEDVADRAR

SEQ ID NO: 8674 - protein, 59 aa, Artificial Sequence
  Synthetic sequence.
DLSEEVKRVIEEVRKRIEELVDEVRKSTEEVIKRVRRLVEEVERVVEDSRRKVDKLLKE

SEQ ID NO: 8675 - protein, 59 aa, Artificial Sequence
  Synthetic sequence.
EEVVRRLKEELEKALRDAERIVKELHEENRKVLEDVKRMVDEDKKKNERVVDEVRRDAK

SEQ ID NO: 8676 - protein, 60 aa, Artificial Sequence
  Synthetic sequence.
SLSEEVKKVIREVEEDVKRLVRELRESSERVLKEIKKLVDEVRRVLEESKERVKKLEREG

SEQ ID NO: 8677 - protein, 59 aa, Artificial Sequence
  Synthetic sequence.
DEVVRRLKKRLKEALDRLRDIARKLDKENKEALDEARRIVEENKRRNEKVVEDVERRAE

SEQ ID NO: 8678 - protein, 60 aa, Artificial Sequence
  Synthetic sequence.
DEVEELKKDLKRVLEEVRKIVEDIHRTNEEVLREVEKIVEDIHRENKEVLEKVEKIMREL

SEQ ID NO: 8679 - protein, 59 aa, Artificial Sequence
  Synthetic sequence.
EELVREVKRVVDELEKEVRDLLRRLKESTDKLREDVRRLAERLRDSLREMERDVREKTR

SEQ ID NO: 8680 - protein, 60 aa, Artificial Sequence
  Synthetic sequence.
DEVERLKRELETVLRDVERIVEEIHRENKKNLDKVKKIVEEIHKENREVLEKVRKIMEEL

SEQ ID NO: 8681 - protein, 59 aa, Artificial Sequence
  Synthetic sequence.
KKLVEEVEEVVKRVEEAVEELARRLEKSTRDVVEESKKLARELEKSLEEVKEEVRKLIT

SEQ ID NO: 8682 - protein, 60 aa, Artificial Sequence
  Synthetic sequence.
KELEELIKRLKRVLEENRDIVRKIHEDNERNLDELRKIVERIHKENKRVLEEVKKIFEEL

SEQ ID NO: 8683 - protein, 59 aa, Artificial Sequence
  Synthetic sequence.
ERVVREVERVIKKLEDDSRKTVRDLEESTKEVEKRSKELADELEKSIEDLERRVDEDTK

SEQ ID NO: 8684 - protein, 60 aa, Artificial Sequence
  Synthetic sequence.
REVEELKKELERVLKKVADLVEENERRNRKNLEDLRRIAEEIHRRNEEVVKRVRDTLERL

SEQ ID NO: 8685 - protein, 59 aa, Artificial Sequence
  Synthetic sequence.
EKLVRDVERVVEKVERDVKRLADRVREVLKESSDRSRELVERLRESLRKAREEVRKAIE

SEQ ID NO: 8686 - protein, 59 aa, Artificial Sequence
  Synthetic sequence.
KDVDEVLKRLRELIDELRKTNERVKRELKKLVEDLERKNKDVERRLRELIRTLEEIARK

SEQ ID NO: 8687 - protein, 59 aa, Artificial Sequence
  Synthetic sequence.
KDMVKKVRDVIEDLKREVERLDRETKEVVERVKRKIEKTNRDSKKVIDDLRREVERLRK

SEQ ID NO: 8688 - protein, 59 aa, Artificial Sequence
  Synthetic sequence.
SEAERIVEELRKLIEDLRRKNEEVKERLKRLVREDEKRNEEVLKELEDRADELRKLVEK

SEQ ID NO: 8689 - protein, 59 aa, Artificial Sequence
  Synthetic sequence.
KDVVDRLRRVIEDLKRTVEKSNEDSDRVIKEVKKRIDDSLKRVEDVIRRVKETIDRLEK

SEQ ID NO: 8690 - protein, 59 aa, Artificial Sequence
  Synthetic sequence.
SDVDRVAKDLEKLIRDLEKINRDVSRENKELIEKDKKINEDVLRELDRLVEELERLVRE

SEQ ID NO: 8691 - protein, 59 aa, Artificial Sequence
  Synthetic sequence.
KEMLEKIRKVAERLRREVERSNEESKKSADEAEKTIRKSLKEVEERIREVEKKIRDLKR

SEQ ID NO: 8692 - protein, 59 aa, Artificial Sequence
  Synthetic sequence.
SEVDRVLKELDELIRTLEELNKKVSRENRELIKEDKKRNDEVVKRLEDLIRELKERVDK

SEQ ID NO: 8693 - protein, 59 aa, Artificial Sequence
  Synthetic sequence.
KDALKKVREVIERLKEEVERLDRETKKSADEAKEAIKRSLEEVEDVVRKIREKIKKAEE

SEQ ID NO: 8694 - protein, 59 aa, Artificial Sequence
  Synthetic sequence.
DEVERAKEELEKLVRKDEEDNDRVRKRLEELIRRLKEENDRVLEELRRLSEELDRLAKE

SEQ ID NO: 8695 - protein, 59 aa, Artificial Sequence
  Synthetic sequence.
KEALDEVRRVIEEVKREIERSLRESREVIKELKERVKELDERTREVVRKVKEEIDELER

SEQ ID NO: 8696 - protein, 59 aa, Artificial Sequence
  Synthetic sequence.
SEVDDVLRRLDKLVKDDKRTNDRIVTRDRETVKRVKEVNREIVERLERLVDRVREIVER

SEQ ID NO: 8697 - protein, 59 aa, Artificial Sequence
  Synthetic sequence.
EDALRKVREVIRRVEEDIKRSLRDSERVIEEVVTRNEKVDRETKKVVDEAKREIDERAK

SEQ ID NO: 8698 - protein, 60 aa, Artificial Sequence
  Synthetic sequence.
SELEKLIEELERVLKRIEEVSRELDKELETVLDEIRRASKRLNDELRRALEEIARAATEN

SEQ ID NO: 8699 - protein, 58 aa, Artificial Sequence
  Synthetic sequence.
KLLERAEDVIRRVREALEELVRTNRESLERVERAARELNRRNEESLERARREVEKLRR

SEQ ID NO: 8700 - protein, 60 aa, Artificial Sequence
  Synthetic sequence.
DEVRELIDRLRKALEEITRESRRLDEELRKVLEEVERRVEELSRRNKEMLDRVREKVTRR

SEQ ID NO: 8701 - protein, 59 aa, Artificial Sequence
  Synthetic sequence.
SRLLEELKRVIDEVRREVERLNKKNKESLDRARRRVEDLLRRLEESVRRVEEELKKLST

SEQ ID NO: 8702 - protein, 59 aa, Artificial Sequence
  Synthetic sequence.
SELERVIRESERTVEESHKHVREVIRKLRDIVRRSHEHVREVIERSKESVERVRDLVRR

SEQ ID NO: 8703 - protein, 59 aa, Artificial Sequence
  Synthetic sequence.
EELVRRLKKVLDESEKAVTRNIEEIKKVLEDVVRKAEKNIREIAEVLERSTRAAKKDTD

SEQ ID NO: 8704 - protein, 60 aa, Artificial Sequence
  Synthetic sequence.
ELEKRIDEVLKRVEDEIRKSIRENEEVLKDVERAVKELIKENERVLEEVREEVRKIIERV

SEQ ID NO: 8705 - protein, 59 aa, Artificial Sequence
  Synthetic sequence.
EDIVREVEKELEDILRDNRRLVRESIESLKDVVRRVAELVERSIRELKKMVDEIRKEAE

SEQ ID NO: 8706 - protein, 60 aa, Artificial Sequence
  Synthetic sequence.
KLEERIEKVLEDAERDVRRSEEEIRRVLKEVEDRVRRLLRENEDALRRVEEEVKKIIDRV

SEQ ID NO: 8707 - protein, 59 aa, Artificial Sequence
  Synthetic sequence.
EKIVKRVIETLRELLKENRKLVKDVIEDLKRIVKEVEELVRESIERLKDMVRRISEKAK

SEQ ID NO: 8708 - protein, 59 aa, Artificial Sequence
  Synthetic sequence.
KEVEEIIETLKRLSEDLERKVREIIERLKRLSERLERENKEVIKELERLIDELRKLVED

SEQ ID NO: 8709 - protein, 59 aa, Artificial Sequence
  Synthetic sequence.
SEDLRKLDRVVKESERTIRDLLRKLDEVAKRSDDTIERVNDETAKVIERVKRKIEELEK

SEQ ID NO: 8710 - protein, 59 aa, Artificial Sequence
  Synthetic sequence.
REVEEMIKELEELLKDLKEKNERASKRNRELVRRLEEENKRVIEELKKLVKELEDLVRS

SEQ ID NO: 8711 - protein, 59 aa, Artificial Sequence
  Synthetic sequence.
SEKLKELRDVIKEVKKRIDELDEYTRESIRRAKKEIERLNRETKKVIEEVVKRIEEERK

SEQ ID NO: 8712 - protein, 56 aa, Artificial Sequence
  Synthetic sequence.
SEKEEVRRVIEELRRILKRVLEDLRRVVKENEDRLRELKKENEKSLRELEERARRI

SEQ ID NO: 8713 - protein, 56 aa, Artificial Sequence
  Synthetic sequence.
VEDLKREIDRVAKEVEEVLEENRRRNEKSVEELRRDSKRNHERNEEVVKEAEDAAR

SEQ ID NO: 8714 - protein, 56 aa, Artificial Sequence
  Synthetic sequence.
SEEERVRKALEELKRELDKVHENNKRSLRENEETLKKLLEDNERSLRELEEEMRRV

SEQ ID NO: 8715 - protein, 56 aa, Artificial Sequence
  Synthetic sequence.
VEELIKTLRRVAKEVRERSEENDRRNKKSVDELREDSKRNHDENDKVLKKLEKAAE

SEQ ID NO: 8716 - protein, 56 aa, Artificial Sequence
  Synthetic sequence.
DEVEKLEEDSERSLEELRKTVEEVKKRSEDSLRDLERKSRENEKESRRTLRELREK

SEQ ID NO: 8717 - protein, 59 aa, Artificial Sequence
  Synthetic sequence.
ERVRKRVKDAAEKSRRVIEDLLREIKRVADDSRREAKRLLDRNKEVLERSKETADREKK

SEQ ID NO: 8718 - protein, 56 aa, Artificial Sequence
  Synthetic sequence.
DEVEKLAEDSKRSLEKLRREVEKVKRESRESLKRLKEESEKNVRDLRRLLEELRRR

SEQ ID NO: 8719 - protein, 59 aa, Artificial Sequence
  Synthetic sequence.
ERLLKRVKDVMDESRKVIRELLELIKEVIRESKETVKRLLDENKRVADEVRKVVDELRK

SEQ ID NO: 8720 - protein, 60 aa, Artificial Sequence
  Synthetic sequence.
SEVEEVEREVKEVIEELDEIVKRVKEENDDSVRKSKRSLDEIEAEVRRVLKELTDRVTKR

SEQ ID NO: 8721 - protein, 59 aa, Artificial Sequence
  Synthetic sequence.
EEVLERLTRLIEKLKDVIRRLRERLKKSADDSRDVIRRTLEAIKEIIERLKEVIDRLDK

SEQ ID NO: 8722 - protein, 60 aa, Artificial Sequence
  Synthetic sequence.
DEIEKLREDVKKTLEESRKSVEDLERRSEDSIRRSRESVERLKREVKEVIDRLRDARRRG

SEQ ID NO: 8723 - protein, 59 aa, Artificial Sequence
  Synthetic sequence.
KRVLDEIKKLADEDNKTVTDSLKRIRDSAKKVDEVVRESLERIRKVAEEITKVVEDVKR

SEQ ID NO: 8724 - protein, 59 aa, Artificial Sequence
  Synthetic sequence.
SELETLEKSLRDVLKESRDSVEKLRKEVEDTIKESEDSVTKLLKEIEDVIRRLEDLRRR

SEQ ID NO: 8725 - protein, 59 aa, Artificial Sequence
  Synthetic sequence.
EDVLRRIRRAAEEVRKVAKESVDRIRDLAARDNEVVERSLKKIEEVLRRIKKVADDVAR

SEQ ID NO: 8726 - protein, 60 aa, Artificial Sequence
  Synthetic sequence.
SEIERLEREVREVIKESEESVRRLKKRVDDTVRENEELVKRLEDRVRRMKERLEDARRRG

SEQ ID NO: 8727 - protein, 59 aa, Artificial Sequence
  Synthetic sequence.
DDVKRKIRKVMEEIKKRADDSRRKIEDVARKDNKAVERSLRRIERLLEEITRVVEEIKK

SEQ ID NO: 8728 - protein, 60 aa, Artificial Sequence
  Synthetic sequence.
SELEKLDKESRDSIRKSEDSVRRLEEESEESIERSKRLVEELKRLADEVIRRLEDMARRG

SEQ ID NO: 8729 - protein, 59 aa, Artificial Sequence
  Synthetic sequence.
EDVLRAIEESMKRARKAVEDSLRRIRESLEKVKEEVRRSNEKIKKIVKEVREVVERIAD

SEQ ID NO: 8730 - protein, 60 aa, Artificial Sequence
  Synthetic sequence.
DELEDLEREVREVIEESKRLLEELEKRVKEVIKTSRDSVRRLKERVDRVIKELRDAKRRG

SEQ ID NO: 8731 - protein, 59 aa, Artificial Sequence
  Synthetic sequence.
EDVLRKIRELLEEIRRVIEETNRRIKKLLEEIKRVADDSRRRIRKVAREVEEEAKEIEK

SEQ ID NO: 8732 - protein, 60 aa, Artificial Sequence
  Synthetic sequence.
SVRERIDELEKKIKRVVEKVLKENKDSLKRVEERVRRLLEENKRSLDEVREAVERVLSEV

SEQ ID NO: 8733 - protein, 56 aa, Artificial Sequence
  Synthetic sequence.
VEKLERDVEKVIEDARRTSEEVKRENDKALKDLDRLSEEVEKENRKALEDLKRTSD

SEQ ID NO: 8734 - protein, 60 aa, Artificial Sequence
  Synthetic sequence.
SVRETIDKALKKIRDVAEDLKRRNDELLKEIEEVARDSSEKIRRALEEVERRVREVLKRV

SEQ ID NO: 8735 - protein, 56 aa, Artificial Sequence
  Synthetic sequence.
VEKLKKDIERIIRELEELSDRLKKIIEEVIKKSEDLVRRLRESLERVLREIDKTTK

SEQ ID NO: 8736 - protein, 60 aa, Artificial Sequence
  Synthetic sequence.
SVREEIDRILREIEEVVKTSSERIKRLLEKIEEVVKRLIEENRRVLKRTDEEADRLLKEV

SEQ ID NO: 8737 - protein, 56 aa, Artificial Sequence
  Synthetic sequence.
VDTLRKEVKEVIDTSEDLVRRLEEEVRKAAKRLKDLVDDSRRLNTEILRTLRERRR

SEQ ID NO: 8738 - protein, 60 aa, Artificial Sequence
  Synthetic sequence.
DDLKRLEEDVRRIIEENDRIVKDIAEKSKKSIEDNRRLLKRLRDESERTIDDIRRLKEEG

SEQ ID NO: 8739 - protein, 55 aa, Artificial Sequence
  Synthetic sequence.
EEIRRLLKEITDVVRESNRRIKRINETAHEVVRRSNTETTKVNKKAHDVVEEVKR

SEQ ID NO: 8740 - protein, 60 aa, Artificial Sequence
  Synthetic sequence.
SLIEKIREIVKEIIKRSDDSVEEVKRRNEESIRRSEESVKDNRRRIEDIIRKLKRLKEEG

SEQ ID NO: 8741 - protein, 59 aa, Artificial Sequence
  Synthetic sequence.
DDMLRKIEALAREVTEVSKRALEEIRKLMEESTEVSKRALERIEASVEEVRRVAEEVKR

SEQ ID NO: 8742 - protein, 59 aa, Artificial Sequence
  Synthetic sequence.
SLLEEIEKEVREIIKRSRKSLEEVKRRNDDSIRKSEKLVEDNKREIEEVKERARKLKED

SEQ ID NO: 8743 - protein, 59 aa, Artificial Sequence
  Synthetic sequence.
KRVLEEIDRLAKDVKRVSDEVLEEIKRLAKESKEMADRSNEEIKKSVEEVRRVVEEVEK

SEQ ID NO: 8744 - protein, 59 aa, Artificial Sequence
  Synthetic sequence.
DEIEELEKLIRKAIKDSRDLVRKLEEENKRSIDTSRELLKELERMLDEVRRRLEDLKRK

SEQ ID NO: 8745 - protein, 59 aa, Artificial Sequence
  Synthetic sequence.
EELLREIKKLLDTIRRVIEESSERIKKLAEDSREVVKESSTEIKRLLETITEVVDRVTK

SEQ ID NO: 8746 - protein, 59 aa, Artificial Sequence
  Synthetic sequence.
DEVEEAEKLIRKVIKDSEKLLRDLADLNRKSIRRSEKLVEDDRRANEDVIRKLEELRRN

SEQ ID NO: 8747 - protein, 59 aa, Artificial Sequence
  Synthetic sequence.
EELLRRIKKLLDEIKKAIEDSSREIKRLLEESERVAKRSSEDIKRTLDDTRRVVEEVRR

SEQ ID NO: 8748 - protein, 60 aa, Artificial Sequence
  Synthetic sequence.
DVEETVRKLIEDVKRVMERVRKSNTDLIRRSKEVLKDARRLHEELTKEVKDVLRRLEEEV

SEQ ID NO: 8749 - protein, 59 aa, Artificial Sequence
  Synthetic sequence.
REVVKRVEEDVRKKLEESTKDSKRVERESEENLRRAKEKSKRVLKKLKDDLRRLEEESR

SEQ ID NO: 8750 - protein, 60 aa, Artificial Sequence
  Synthetic sequence.
SVKETVKDLEREVREVLKKLRDDVRKLIEESDKALKRLKKIHDDLSRDVRRVLEDLRRRV

SEQ ID NO: 8751 - protein, 59 aa, Artificial Sequence
  Synthetic sequence.
KKMIDDVVRRVRKKLKEIDEKVKDVERKSRENLKRLKEKSDRVAEDLKKILDELREEVR

SEQ ID NO: 8752 - protein, 60 aa, Artificial Sequence
  Synthetic sequence.
SVEETITELIKEVRKVAEEVKKSNKEVIEESEEALKELERTHTELSEEVRKVLRELEEEV

SEQ ID NO: 8753 - protein, 59 aa, Artificial Sequence
  Synthetic sequence.
KEVVTEVVKEVKKRLEESKDDSRRVMEESRRNLKKLREESKRVVEELRRELRRLKEEVR

SEQ ID NO: 8754 - protein, 60 aa, Artificial Sequence
  Synthetic sequence.
DVEETVRKLIEKVKRVLERLEEEHKRLSDDSRRVVKKLKDDVEDLIRRVEEVLKELERRV

SEQ ID NO: 8755 - protein, 59 aa, Artificial Sequence
  Synthetic sequence.
RKAVDEVRKEVDRRLEELKRDSERVVKKSEENLRRLEEEVRKVEEKVRRTLKRLKEEAK

SEQ ID NO: 8756 - protein, 60 aa, Artificial Sequence
  Synthetic sequence.
DKLEKVLEEIKRRLEENERLLRKVERDLKRLSKENEDRLRKMLEDLRKLSEDLLRSVEKD

SEQ ID NO: 8757 - protein, 55 aa, Artificial Sequence
  Synthetic sequence.
EKVDELLKEVEEIIDRSRKEIDRTRKDNERSVKRSEDAIRKTLDENEKSLREATR

SEQ ID NO: 8758 - protein, 60 aa, Artificial Sequence
  Synthetic sequence.
SDVEEMEKRIRDRLRENRRIVEDVAKKLRDLSRRLEEEVKKVAEELRRLSDELRKRVTRR

SEQ ID NO: 8759 - protein, 55 aa, Artificial Sequence
  Synthetic sequence.
ERVKDLLREVKRVIDESKKTIRDTLEENEDSIRRLRERIDETLKENEKSIKELKD

SEQ ID NO: 8760 - protein, 60 aa, Artificial Sequence
  Synthetic sequence.
SSVEEVKKELDKILEELKEKSERSKEEVERVLKKLREKSDRVEREVRKAEERLRRKVKDI

SEQ ID NO: 8761 - protein, 56 aa, Artificial Sequence
  Synthetic sequence.
DETVERLLKKLKDVLEELRRRHEEVSKRLEKVLKELVDRHKKVTEDLKRVLDELRK

SEQ ID NO: 8762 - protein, 60 aa, Artificial Sequence
  Synthetic sequence.
SLEETLKKLIEEVEEVLRRSEEIAREAIRRSERVLEELERRHKKVTDEIKEMLRELRERI

SEQ ID NO: 8763 - protein, 59 aa, Artificial Sequence
  Synthetic sequence.
EELVERVLDKVRRDLEDSRRHLEEVKRKSEESLKKLKKETKDALDTIREKLKRIADELR

SEQ ID NO: 8764 - protein, 60 aa, Artificial Sequence
  Synthetic sequence.
SMEEKVKRIIKKVDDVLKDSERRITELIKKSRDVLRELEKRHEELTKRVKDVLDDLRRKI

SEQ ID NO: 8765 - protein, 59 aa, Artificial Sequence
  Synthetic sequence.
DRAVDTVRKEVEKALEENRKTVRDVEEESDRSLRRLREKTDEVRRRVEEILKRLKERVD

SEQ ID NO: 8766 - protein, 60 aa, Artificial Sequence
  Synthetic sequence.
ELEERIKELIKKVRDVLRKSKEEVDKVIRKSEEVVRETEKLVEDIIRRVEKVLDEVRKRI

SEQ ID NO: 8767 - protein, 59 aa, Artificial Sequence
  Synthetic sequence.
KELVRTLERRVEEVLRRNEELVKRVREESDRSIDRSRRSLERAEEDVDRVLKEVKDRTT

SEQ ID NO: 8768 - protein, 60 aa, Artificial Sequence
  Synthetic sequence.
DLEKKVEDVIREVEKVLRELRRRHEELTKRSEDAVKETKDRVKEIEDEVRRVVDKVRKDI

SEQ ID NO: 8769 - protein, 59 aa, Artificial Sequence
  Synthetic sequence.
DELVKELKRDVERVLKRLKERSDEVRKESEKSIKKSKDSLEKAEREVREMLRDLDRETK

SEQ ID NO: 8770 - protein, 60 aa, Artificial Sequence
  Synthetic sequence.
SMEERVKELIRRVRKVLEDTERRAKEIIEDVERVLEELKKRHEDLTRKVDKVLKELKKEI

SEQ ID NO: 8771 - protein, 59 aa, Artificial Sequence
  Synthetic sequence.
EKLVTKVEEDAERALRESEESLRKVEREVKRVLEELKRKTEKVARELDKILKELKDRTR

SEQ ID NO: 8772 - protein, 60 aa, Artificial Sequence
  Synthetic sequence.
SLEDELRKLIEDVKRVAKETEDRVREILKRSKDVLDELKKEHDKLTREVERVLDELAKEI

SEQ ID NO: 8773 - protein, 59 aa, Artificial Sequence
  Synthetic sequence.
EELVKKVKKEVEDVLRRSKESLKKAEEDSRKSLEELKKKTEDLKREVKEILDRLKERVR

SEQ ID NO: 8774 - protein, 60 aa, Artificial Sequence
  Synthetic sequence.
SELEKLKREVDEVLKRNKELVDELRKRVRKALEESRRSVEEVERRVEEVLKRLEDDLRRE

SEQ ID NO: 8775 - protein, 59 aa, Artificial Sequence
  Synthetic sequence.
EELKEKVRRILKEVRRVLDESRRDVERVLREVEKVMRESIKKARDAIRKVEEVLRELER

SEQ ID NO: 8776 - protein, 60 aa, Artificial Sequence
  Synthetic sequence.
RELDDARRKVEEVLKTNKDLVDKIRKEVEETLERLDRSSRKVREIVRRVLEELTRRATER

SEQ ID NO: 8777 - protein, 59 aa, Artificial Sequence
  Synthetic sequence.
EELKRLVEKLIKEVEDVLEESRKAVEDVIREDKRRMEESKREADELIREVKKVLDDLRK

SEQ ID NO: 8778 - protein, 60 aa, Artificial Sequence
  Synthetic sequence.
KELEDLEREVREVLKRSDESLKRLEEEVRRVLDENDKEVKRVKEKVKKVLDELREIVTRR

SEQ ID NO: 8779 - protein, 59 aa, Artificial Sequence
  Synthetic sequence.
EELKREVERLIREVEEVLKKSEEAVRRLIEEVDRALKRSREEFTKAREEVKKVLEDART

SEQ ID NO: 8780 - protein, 60 aa, Artificial Sequence
  Synthetic sequence.
DEIDKARKDIEDMLRRLRDLVRKLEDLNRKVVEELKDLVRKDRKLNEDIVRRLERLVRER

SEQ ID NO: 8781 - protein, 59 aa, Artificial Sequence
  Synthetic sequence.
EEVKRRIEELLRRVDKVADEVRREVERTNRESEEVVREVEEDVRRSLEEIDKVIKDVRT

SEQ ID NO: 8782 - protein, 60 aa, Artificial Sequence
  Synthetic sequence.
SEIDELRKRVEEVLRRLDELVKRLKEENDRVVKKAEDLIRRLEETNREILKKLRKLVKDD

SEQ ID NO: 8783 - protein, 59 aa, Artificial Sequence
  Synthetic sequence.
RDVLEKIKDLLRRVKEVADEVEKKIRELNKKTEDVVRELEERVRKLDEDVKRVIEEVKR

SEQ ID NO: 8784 - protein, 60 aa, Artificial Sequence
  Synthetic sequence.
SELDEIRERIERIEKDLERLVEEVKRVNDTIVERIKKLIDEVRKENEKVIKTLRDLVREV

SEQ ID NO: 8785 - protein, 59 aa, Artificial Sequence
  Synthetic sequence.
EKVEREIRRLLERVKEVIERVKDRVRRVDKKSRDVVREARRAIEEVDRRVRKVVREAEK

SEQ ID NO: 8786 - protein, 60 aa, Artificial Sequence
  Synthetic sequence.
DEIKKLEDEVKKILDDLRELIRKLEETNRDVERRLRELIAELRKRNDEVVKRLRDLVRRS

SEQ ID NO: 8787 - protein, 59 aa, Artificial Sequence
  Synthetic sequence.
EDVKRKIEEILRRVEEEIRRLKKEVERLDRESKRVIRELREDVKRTNTDVKRVVDEVRK

SEQ ID NO: 8788 - protein, 60 aa, Artificial Sequence
  Synthetic sequence.
SLVERLEERVKRIIDELRRILEENRRRVKKVSDENRDLLRRLEEENKKIIEDLRDLKRKG

SEQ ID NO: 8789 - protein, 59 aa, Artificial Sequence
  Synthetic sequence.
EKAKDKLRRLEEEIRKVAKEVEDELRRSTEYVKKSLEDAKRKLEELTKRTEDVAEEVER

SEQ ID NO: 8790 - protein, 60 aa, Artificial Sequence
  Synthetic sequence.
DLVERVEEKVEDIKRKLRRILEEVDRRNKEVSKENKELLDRLEEENERIIRELEKAKRDG

SEQ ID NO: 8791 - protein, 59 aa, Artificial Sequence
  Synthetic sequence.
DRAREKLKRLVEDIDRVAEEVKRTLEELSRYTDKSLEDAERSLERLTKETDEVLKRVTT

SEQ ID NO: 8792 - protein, 56 aa, Artificial Sequence
  Synthetic sequence.
SIVERLKKLAEDVIRRLERLSKELAKRNKEVIERLKELSKRLEDKNRRVIEELRRT

SEQ ID NO: 8793 - protein, 59 aa, Artificial Sequence
  Synthetic sequence.
EEVKRAIEELRDRIRKVIEDSERTIRKLNDDTRKVVEDSRRTIEELNRTTDKVIEEVRR

SEQ ID NO: 8794 - protein, 56 aa, Artificial Sequence
  Synthetic sequence.
RKVDELRKEVKRVIDELRELSERLRKENERVIKTLEDLVRRLEKLLERVERELERT

SEQ ID NO: 8795 - protein, 59 aa, Artificial Sequence
  Synthetic sequence.
EEVKKEIDRLRRELDRVIKESEDTIRRLNDETRKVIEKVRRAIEELLRRIEEVIKKVEK

SEQ ID NO: 8796 - protein, 56 aa, Artificial Sequence
  Synthetic sequence.
SIVEELRELVKEAIKRLKKLSDDLRRKNEEVIRTLKELLDRLKRKNEEVIKRLEDT

SEQ ID NO: 8797 - protein, 59 aa, Artificial Sequence
  Synthetic sequence.
EEVKREIEKLKRDVERVIEDSRRTIEELNRKTEEVIERVRRTIERLNEETKKVIDRVRT

SEQ ID NO: 8798 - protein, 56 aa, Artificial Sequence
  Synthetic sequence.
REVDELRKRVEEVIRELEKLSEDLAERNRRVSERNKELVETLARLNKRVIDELRRT

SEQ ID NO: 8799 - protein, 59 aa, Artificial Sequence
  Synthetic sequence.
EEVKKAIDDLRRELEEVIKRSKKTIDDLNRYTKKSIEDVREAIKKLNKETDDVAREVKK

SEQ ID NO: 8800 - protein, 56 aa, Artificial Sequence
  Synthetic sequence.
SIVEELKKLVEEAIRKLEKLLEELEEKNRDAIRRLKELSDELRKKNEEVIERLKRT

SEQ ID NO: 8801 - protein, 59 aa, Artificial Sequence
  Synthetic sequence.
EEVKRMIEKLRRDVEKVIREVRDEIRRLNDTTRRVIDKSRKTIEELNRTTEEVIERVKR

SEQ ID NO: 8802 - protein, 60 aa, Artificial Sequence
  Synthetic sequence.
DEEEVMRELKKEIDEALERSKEINDRLRKEIRDVLEKLERIVREVKERSERVLEDVRRKV

SEQ ID NO: 8803 - protein, 55 aa, Artificial Sequence
  Synthetic sequence.
KEAVDEIRRILREALEEDKKSVEDIRRDLDKIEKDVKKVLEDNERLLKRLREEVK

SEQ ID NO: 8804 - protein, 58 aa, Artificial Sequence
  Synthetic sequence.
DEEEVMKELEDRIREVDKKIEDRLRELKERSDRVLDRSRRINKKLKDEIEDALRRVRR

SEQ ID NO: 8805 - protein, 55 aa, Artificial Sequence
  Synthetic sequence.
KEAVDTIERKLRKLEEDLKKVERDNKKLLDDMERDDRRSLEEIKRILDELLEKVR

SEQ ID NO: 8806 - protein, 58 aa, Artificial Sequence
  Synthetic sequence.
REEEVMKELDREIEEVLERSREIVERLRREIEEVLKENKKIVETLKREIKKVLREVRE

SEQ ID NO: 8807 - protein, 55 aa, Artificial Sequence
  Synthetic sequence.
EEAVKRIRDILEKDERDVREVVRRIREILKASLEDSERSVEEIRRILDELRKEVE

SEQ ID NO: 8808 - protein, 58 aa, Artificial Sequence
  Synthetic sequence.
REEEVMERLRREIEKALRESHEIDDRLRKRIEDVLRDSERKLEELRRRIKKVMDDVRR

SEQ ID NO: 8809 - protein, 55 aa, Artificial Sequence
  Synthetic sequence.
EEAVRKIREELERMKEENDRVLKEIDKDLKDDDRKIEEVVERIERILRELRERVR

SEQ ID NO: 8810 - protein, 60 aa, Artificial Sequence
  Synthetic sequence.
DEKEVADELERKIDEALKESHEIDKRSDDHDKEVLKKSEKRLRELDEEIKDVLRKLEKKV

SEQ ID NO: 8811 - protein, 55 aa, Artificial Sequence
  Synthetic sequence.
REAVETIERILKRMIERNRAVVETNKKLNKEDEDKIREVVKRIREKLRKADEEVR

SEQ ID NO: 8812 - protein, 60 aa, Artificial Sequence
  Synthetic sequence.
ETEDKVRELLKRIRDVAEKAREKVEELVRRNEEVLKRARETVERLVRKNEEVLREVAERA

SEQ ID NO: 8813 - protein, 56 aa, Artificial Sequence
  Synthetic sequence.
KKELEDTVRKVLEDLERKLERLEEESREVERRVKKVLDELKRKSEESEKRLEEAAR

SEQ ID NO: 8814 - protein, 60 aa, Artificial Sequence
  Synthetic sequence.
DAEEVVRKLEEELKRLIDKLRKVMEESLKRVKESMDRSRKRIEELVRRLEKILRDLKRDR

SEQ ID NO: 8815 - protein, 59 aa, Artificial Sequence
  Synthetic sequence.
EDVLRKLKETVERVRRKVEEVIKKSRESVKRVEETNTRSLRELEETVREVEKRVREESR

SEQ ID NO: 8816 - protein, 59 aa, Artificial Sequence
  Synthetic sequence.
SEVEKLLKDLKELLEEVKRRAEESHRDLRRLLEEVRKRVEDSNRELERELRRAEDLVRR

SEQ ID NO: 8817 - protein, 59 aa, Artificial Sequence
  Synthetic sequence.
RKMERVVEEIRREVKKVLEDLRRILKESEDAARKVLRDLERLVKHSKDTAREVLKRLKK

SEQ ID NO: 8818 - protein, 59 aa, Artificial Sequence
  Synthetic sequence.
SEIEKLLRDLERLLEEVKRKAEKTNRDLEKLLEEVKRKVEDSHRKLKKVLDEVKDLVRR

SEQ ID NO: 8819 - protein, 59 aa, Artificial Sequence
  Synthetic sequence.
ERVKRLVEDVRRRVKEVLDDLRRIIEHSRRRAEKVLRELEKLVRESETKAREVLKDLKK

SEQ ID NO: 8820 - protein, 56 aa, Artificial Sequence
  Synthetic sequence.
SEAERLLEDSKRVLDEIREDLKRLLKESEDVMREIEKTLEKLVRDVERVLDEVRKS

SEQ ID NO: 8821 - protein, 56 aa, Artificial Sequence
  Synthetic sequence.
ERVLRTIKDLHRRLSEEVKRVLDEAEELHRRLSERVREVLEDIRRLVEELIEEVRK

SEQ ID NO: 8822 - protein, 56 aa, Artificial Sequence
  Synthetic sequence.
SEAEDLLRRSKERLDEVRKRLDELRRRSERVVEEIRRLLKELLDDVERVRKEVKEA

SEQ ID NO: 8823 - protein, 56 aa, Artificial Sequence
  Synthetic sequence.
DRVLRTIEDTHRRLSEDVKRVLKEAEELHRRVTEEVKDVLRKIRETAERLEEEVKK

SEQ ID NO: 8824 - protein, 56 aa, Artificial Sequence
  Synthetic sequence.
KEAEELLDTSRRVSEEVEKRLEKLLRESERVAEEIRKRLEELLRRVEKVLDELRKA

SEQ ID NO: 8825 - protein, 56 aa, Artificial Sequence
  Synthetic sequence.
EKVLKTIEDEHRRLSESVERVLRTAKRLHDEVSKEVRDVLEEIRRTVEKIIREVRT

SEQ ID NO: 8826 - protein, 60 aa, Artificial Sequence
  Synthetic sequence.
SVEEVLKTLEDLARESSEEVRRVAEEIERSNRRVVKEVEKVLREIEELNRKILEEVERDL

SEQ ID NO: 8827 - protein, 59 aa, Artificial Sequence
  Synthetic sequence.
EEVLRELLKEVAKVVEDTRRKLEELLKENEEMDRDLKRKLDELLERNREVLERLKRKVD

SEQ ID NO: 8828 - protein, 60 aa, Artificial Sequence
  Synthetic sequence.
SVEEVLKELEKLVRDSSREIKKVLEEIDKSNTDLLREVEDALRRIEERVKEALESVDRTV

SEQ ID NO: 8829 - protein, 59 aa, Artificial Sequence
  Synthetic sequence.
REMLERLLDTLRRRLEETRKELERLLTENKKKDDEVKEKLKRAEEELEDVRRRLEEKLR

SEQ ID NO: 8830 - protein, 60 aa, Artificial Sequence
  Synthetic sequence.
SAEEVLRRLKEAIKRLIRDSERVLEEIRRTNEELIKRTEEVLRRVREKAERLIDDVRRRL

SEQ ID NO: 8831 - protein, 59 aa, Artificial Sequence
  Synthetic sequence.
DEALRRIEKEVRDVEKRSKETLEDSKRDSERVRKKSEDTLREIETRVEDVRRKAEEEVR

SEQ ID NO: 8832 - protein, 59 aa, Artificial Sequence
  Synthetic sequence.
SESDRIRAIVKKVVDESKESLKRLKEETERVKRELDRVLKENKDKVRRLKEKAEEMKKL

SEQ ID NO: 8833 - protein, 56 aa, Artificial Sequence
  Synthetic sequence.
SDVLREVAERVTRLIRDSERVLEELAREHEKASRKVKKVLDESKKIVDDVIRRVDR

SEQ ID NO: 8834 - protein, 59 aa, Artificial Sequence
  Synthetic sequence.
SESEEIERTVEDVKRKSDKSLEESRRNVERLKEESEESLERNKDLVRRVAEKVEEVKRD

SEQ ID NO: 8835 - protein, 56 aa, Artificial Sequence
  Synthetic sequence.
SEAADRVREEVTKVIKKSEDVLRDSERLHREVIKTSRDVLDKSRRLVEEIIRRVRR

SEQ ID NO: 8836 - protein, 59 aa, Artificial Sequence
  Synthetic sequence.
SDVERVLREVEEIIRKARDRSREWLERVKKIIEKVKEDSKRWLDEVRKLIRDVEDIRRR

SEQ ID NO: 8837 - protein, 58 aa, Artificial Sequence
  Synthetic sequence.
ERVREVIDRIRKLLKDIIDEARDVNKKVRDLLKRIVEEVTEVNKRVKELVEEIVRRIK

SEQ ID NO: 8838 - protein, 59 aa, Artificial Sequence
  Synthetic sequence.
DELREALKRVADIVRTIEEAVRKSLEDSKRIVDDIRRASKEALEEVEKIVRTLVEIVRN

SEQ ID NO: 8839 - protein, 58 aa, Artificial Sequence
  Synthetic sequence.
KEVRDVIREVEKLLREVEKIVRDVNRESERLAKEVRDDATEVNERVKELLKRAEAAVR

SEQ ID NO: 8840 - protein, 59 aa, Artificial Sequence
  Synthetic sequence.
SVVEELRRTVKELLDEIKRRDDRLLKEVEEVAREVERKDDELRKKVEEILRRIKELRDR

SEQ ID NO: 8841 - protein, 55 aa, Artificial Sequence
  Synthetic sequence.
DRVLKELKELMDEAKKNSERVNKKVEDLLRRLDESSRRVNEEIEKRLTELLKAVE

SEQ ID NO: 8842 - protein, 59 aa, Artificial Sequence
  Synthetic sequence.
SVVEELLKRVRERLEDVDRVLRTWLEEVERLAEEVKRLDRELEKDVKRILDTIEELKRQ

SEQ ID NO: 8843 - protein, 55 aa, Artificial Sequence
  Synthetic sequence.
DKALEDIKRLLEELRKRVEDVSRRVNKLLRDLEENSKRVNDELRKRVETLVERVR

SEQ ID NO: 8844 - protein, 61 aa, Artificial Sequence
  Synthetic sequence.
REIEKVLKELRDIVRELEKLLEDVVRKIRKIVEETRKLLEDVVRESDKIHRDAKELMERAG

SEQ ID NO: 8845 - protein, 56 aa, Artificial Sequence
  Synthetic sequence.
EDELRKRIAELAERVKRMVKKLDEHAKRDFRRVEEEVRRLRENVKRVKDEVDEAVR

SEQ ID NO: 8846 - protein, 61 aa, Artificial Sequence
  Synthetic sequence.
SEIEKVLEELRRRVEELEERLKTVVDELKKIARRTEEKLDKVREEIERIYREAKDLLRRAG

SEQ ID NO: 8847 - protein, 56 aa, Artificial Sequence
  Synthetic sequence.
SDELRKAIAELERRVDKMLKELRDHITRDEDRVRRILEELRRHVERSLKRVREEVN

SEQ ID NO: 8848 - protein, 62 aa, Artificial Sequence
  Synthetic sequence.
SELEKVLEDVERRLRELKERNDRVLEEITKIHEDAKRENDEVLKEISRAHKEATEELERKIG

SEQ ID NO: 8849 - protein, 56 aa, Artificial Sequence
  Synthetic sequence.
LEELRRKLKELEERSERHLEELRRSAETVLRESREHLRRLEDSLRRVRKKVKEETD

SEQ ID NO: 8850 - protein, 62 aa, Artificial Sequence
  Synthetic sequence.
SEIETVLRDVKDKLEKLKRDNDKVLDEITKIHEEAMRRNDKVLEDIRRALEELKKRLEEKIG

SEQ ID NO: 8851 - protein, 56 aa, Artificial Sequence
  Synthetic sequence.
LEELKKELKKLEDESRKHLEELRRSLEEVTRRSDKHLKELKDRLEELRRKVEAATD

SEQ ID NO: 8852 - protein, 62 aa, Artificial Sequence
  Synthetic sequence.
SELEKVLEEIRRELEKLERANKKVLDDAKRIHDKAKEDLRRVLEEIKRRLEELEKRLEEAIG

SEQ ID NO: 8853 - protein, 56 aa, Artificial Sequence
  Synthetic sequence.
VEELRKELEDLRRESEEHLERLRDSARRVLEKVRRILKELRDRLRELAEEVKRATD

SEQ ID NO: 8854 - protein, 62 aa, Artificial Sequence
  Synthetic sequence.
DELETVLKRVEDLLRRLAEELRRVLEEARETLERLKAANEKVLEEITRTHEEAKRRLDRDIG

SEQ ID NO: 8855 - protein, 56 aa, Artificial Sequence
  Synthetic sequence.
VEELDKEAKDLVKEVDEILKRIREELKKLKEDNDKHLEELKESLKRVKDEVDEARR

SEQ ID NO: 8856 - protein, 62 aa, Artificial Sequence
  Synthetic sequence.
SELEDVLRDAERIIREAKEDNERVLRRLKETVEKLIKDNDEVLKKLTESHKKLTKELKDAIG

SEQ ID NO: 8857 - protein, 56 aa, Artificial Sequence
  Synthetic sequence.
VEELKEEIKDILRRNREHLEELKRRIDELRKENEKHLRDLEESIKEVEKEVRESRR

SEQ ID NO: 8858 - protein, 61 aa, Artificial Sequence
  Synthetic sequence.
SEIETVLEDAERKIRELKKRLEDVLRRLAEIYTRAKELLKRVLDELRKIYEDLKKKLEEKV

SEQ ID NO: 8859 - protein, 56 aa, Artificial Sequence
  Synthetic sequence.
VEELKKRLDEVARRVEKVLRENEEEIKESLKEVEKMLRRNRKEIKDSEKEVDDEVK

SEQ ID NO: 8860 - protein, 61 aa, Artificial Sequence
  Synthetic sequence.
DELERVLEDAETKIRDLKRKLKEVLDKLRRIYEELEERLKRVLEEIEEIYRRAAEALRRKV

SEQ ID NO: 8861 - protein, 56 aa, Artificial Sequence
  Synthetic sequence.
VEELKRELEEVAKRVEEILRRNEEEIKKSEEKIRKVLRDNREKAKRSLDRVREALK

SEQ ID NO: 8862 - protein, 61 aa, Artificial Sequence
  Synthetic sequence.
DELKKVLDDARETSDRLKKENETVFRELEEIYRRLEKELRRVLRELEEIYRRAEDKLTKSV

SEQ ID NO: 8863 - protein, 56 aa, Artificial Sequence
  Synthetic sequence.
VSELDKRIRELERRNRESVKENRDRLKESADDVKRALDRNREELEESERRVKKAVD

SEQ ID NO: 8864 - protein, 61 aa, Artificial Sequence
  Synthetic sequence.
SELEKALRDAEEIIKKAKKLLKEALDEAEKIYREAAKLLDDALREAEKIYREAADALDKKV

SEQ ID NO: 8865 - protein, 56 aa, Artificial Sequence
  Synthetic sequence.
AKELRDRAKEAADRAKRAAEENRKKARESLERAKRAAEDNRKKAEESLKRAEETAR

SEQ ID NO: 8866 - protein, 61 aa, Artificial Sequence
  Synthetic sequence.
SEIEDVLRRAKEISDRLKRENDRVLDELRRSYEDLERELEEVLRKLEETYRRAKEELRKKV

SEQ ID NO: 8867 - protein, 56 aa, Artificial Sequence
  Synthetic sequence.
VSELRERIERLKERNRKSLEKNKRDIARSEEEVRKALERNEDEIRRSEEEVKKALK

SEQ ID NO: 8868 - protein, 61 aa, Artificial Sequence
  Synthetic sequence.
RELEKVLEDIREISERLEKRNRDVLKELEDIYREAKKRLDDVLRKLKETYDRAEEELRRKV

SEQ ID NO: 8869 - protein, 56 aa, Artificial Sequence
  Synthetic sequence.
VSELRKDLRKLAEDNRRSLEENKKEITESLKEVEKVLERNKDEIRKSKERVDKALE

SEQ ID NO: 8870 - protein, 61 aa, Artificial Sequence
  Synthetic sequence.
SELERVLDEMRKIIERLEEELRKVLEDLRRIYEELKRKLDDSLRESERRVRELKEELDRKV

SEQ ID NO: 8871 - protein, 56 aa, Artificial Sequence
  Synthetic sequence.
VEELKDTIDKVKKRVEDALEKNRRDIDESRKEVDDELRKDEEKAERLAREVEKAKE

SEQ ID NO: 8872 - protein, 59 aa, Artificial Sequence
  Synthetic sequence.
SSDETVKEKVKKVARDVDRHVEKLRKALEEMEREVREHVKRLEDELRRMDEEVKRVREE

SEQ ID NO: 8873 - protein, 55 aa, Artificial Sequence
  Synthetic sequence.
EKVLRDAERIVRELERKLDKVDTEIAETVKRLEDTIRDVNRKIKDRVDKLRKELE

SEQ ID NO: 8874 - protein, 59 aa, Artificial Sequence
  Synthetic sequence.
DSDEKVKRVLEELRKEVKEHVERLRARAEDMSREVKDHVRKLKEDLERMERDVERVKRK

SEQ ID NO: 8875 - protein, 55 aa, Artificial Sequence
  Synthetic sequence.
EEVLERVRTEVERLKRELDKVNEDIRKRVEELKKELDEVDDEIRKEVDRLEEALK

SEQ ID NO: 8876 - protein, 59 aa, Artificial Sequence
  Synthetic sequence.
SSDEEVKKKLEEVKEEVKRHVERLKRALEKADRDVKDHVRRLKEVLKRMADEVEKVRRE

SEQ ID NO: 8877 - protein, 55 aa, Artificial Sequence
  Synthetic sequence.
EKVLKDVEEKIRRLEKELDEVNEDIERKVRELEKELRAVDEEIKRIVDRLRKELE

SEQ ID NO: 8878 - protein, 59 aa, Artificial Sequence
  Synthetic sequence.
SSSERVKTELDRMRKEVKRHVEELEKELKRLTEKVKRHVEESKKNAEEITRKVEDVRRK

SEQ ID NO: 8879 - protein, 55 aa, Artificial Sequence
  Synthetic sequence.
EEVLREVTREVTRLREELDEVNKRVEKRLEELERELDRSDEEVTRIVEELVDELR

SEQ ID NO: 8880 - protein, 59 aa, Artificial Sequence
  Synthetic sequence.
SSEEDVRRKLEKMRKEVDEHVRKLEEDLKRLAEEVKRHVEDLERVAKEVADRVEEVRRQ

SEQ ID NO: 8881 - protein, 55 aa, Artificial Sequence
  Synthetic sequence.
KKVLDTARDILRKLEKKLDDVDEKIERIVEKLKRELDEVNKRATETVERLIRELK

SEQ ID NO: 8882 - protein, 59 aa, Artificial Sequence
  Synthetic sequence.
RSDEELEKKLKELKEEVDEHVKRLEETARRLDKEVRRHVEESKRNLEEMDREVKEVRRR

SEQ ID NO: 8883 - protein, 55 aa, Artificial Sequence
  Synthetic sequence.
DKLLERAERTVRELERRLDEVNDRIRRIVEELKRKLDRSNEEVTRKVRELSKELE

SEQ ID NO: 8884 - protein, 61 aa, Artificial Sequence
  Synthetic sequence.
DELERVVEEVRKRIERLKEELRRVHERSREIVDRLRKELEKSLEEVRRIVEDLKRKLRERG

SEQ ID NO: 8885 - protein, 56 aa, Artificial Sequence
  Synthetic sequence.
EEDLERMADKLRKDVERAVRKNETDADKLRREVEEVVRRNKKTAKELEDEVRKELT

SEQ ID NO: 8886 - protein, 61 aa, Artificial Sequence
  Synthetic sequence.
SEREKVAKEATDIVEELKKTLKDVHRRSKEIVERLVKKLADVNKDSRDKAEELKKRLDDRG

SEQ ID NO: 8887 - protein, 56 aa, Artificial Sequence
  Synthetic sequence.
EEDVKRIAKKLEEDVRRVVRKNEEEIKKLAEEVDRVVEDNKRLVEELKRRVDEALK

SEQ ID NO: 8888 - protein, 59 aa, Artificial Sequence
  Synthetic sequence.
DADDELRKIVEEADRRSKESVREIEELLRKLEREVEDIVRRIKKLSDDTRKRIDDLRKE

SEQ ID NO: 8889 - protein, 55 aa, Artificial Sequence
  Synthetic sequence.
EEVLKRVEEIIKRLEEENRKVLEELERSVRKLEEDIRKVLEDNDRVVKELARRID

SEQ ID NO: 8890 - protein, 59 aa, Artificial Sequence
  Synthetic sequence.
SAVEKLEELVERVARRIDELVKKIKELLDDVERKSEKTVRDLERLSEETKRSIDDLRRE

SEQ ID NO: 8891 - protein, 55 aa, Artificial Sequence
  Synthetic sequence.
EEVLKRVRETLERLERKIKKVLDELKKRVEELRKKNEDVVRRNEEVVKKLVEDIR

SEQ ID NO: 8892 - protein, 59 aa, Artificial Sequence
  Synthetic sequence.
SVEDVIRDLRRVITESRELSERVLERIEETTRRSKEESKRVADKVKKSSDDLREAVERI

SEQ ID NO: 8893 - protein, 59 aa, Artificial Sequence
  Synthetic sequence.
DEKAKELLRRVKEVVDRNKEKLDRDLERNKRRIDENRRKLEEDLRRNRKVVEELRKRLE

SEQ ID NO: 8894 - protein, 59 aa, Artificial Sequence
  Synthetic sequence.
SVEDVAREIREVLRRLEESVRKVAEDNRRNNEELRRLVEEVLKRIRDSSDRLRKVVEDI

SEQ ID NO: 8895 - protein, 59 aa, Artificial Sequence
  Synthetic sequence.
DEVLERLLRRVREAVKELEDELERSSREDNRRSRELEEELKKDLKRNEDEIRDVERALK

SEQ ID NO: 8896 - protein, 59 aa, Artificial Sequence
  Synthetic sequence.
SVEEVLRRAEEILTRSKEESRRVFEEIRETTERSKEVSKDVARRNKEILDDLKRKIEEV

SEQ ID NO: 8897 - protein, 59 aa, Artificial Sequence
  Synthetic sequence.
DDVLRRLLEKIEEVVRDNERELKEDLDRNRKVIEENRKKLEDHLRRTEEEVDDIRRKLK

SEQ ID NO: 8898 - protein, 59 aa, Artificial Sequence
  Synthetic sequence.
KVEEVSKKLKDVLRELEELVERVLERNRENNERLRDKVRKVLEENKEVLDRLKKEVDDI

SEQ ID NO: 8899 - protein, 59 aa, Artificial Sequence
  Synthetic sequence.
EEDLRRLLEKIKREIDRLAKELEDSSRDDNRISRELDEELKRHLEETRRAVREISEKLR

SEQ ID NO: 8900 - protein, 57 aa, Artificial Sequence
  Synthetic sequence.
SRAEEVLKKVEEEVKKLEDELRRSSERNNRESRRLEDELKKVLDKNRKLVEDLRRAR

SEQ ID NO: 8901 - protein, 56 aa, Artificial Sequence
  Synthetic sequence.
KEVVDELRRVLERLRRVIEDVIRRNKEDTDRLEREIERVRKELKDINKKLEEDVRR

SEQ ID NO: 8902 - protein, 60 aa, Artificial Sequence
  Synthetic sequence.
DEAETLLRDVERKVEELKRRSEKLLRDVEELVRRLLRSNEESLKKVKEDLKRLKDLVRRG

SEQ ID NO: 8903 - protein, 56 aa, Artificial Sequence
  Synthetic sequence.
DEVLREVDRVIDDVRRALKKVNEEIEEVIRRLKRESERVNKEAEEIIRTLEDALRK

SEQ ID NO: 8904 - protein, 57 aa, Artificial Sequence
  Synthetic sequence.
DDLERVLEEIRREIERIRRELEESNEENKDIVRRIEEELKELLKDNKRIVETVTKAN

SEQ ID NO: 8905 - protein, 56 aa, Artificial Sequence
  Synthetic sequence.
REVLERLEKELDRLRKDIERVADENRKINDTLRKRIEEVMARLDEINTDLKDRVET

SEQ ID NO: 8906 - protein, 56 aa, Artificial Sequence
  Synthetic sequence.
SSDEVLKEIEEIIRRLEEEVRRVNKEVNKSTEDLRREVEEVLRRTNELIEELERRV

SEQ ID NO: 8907 - protein, 59 aa, Artificial Sequence
  Synthetic sequence.
EEALRKAIKDVRDIVKKVKDELKEWRDRNKELVDRLSEELKEWLKDVERVLKELTDKDR

SEQ ID NO: 8908 - protein, 56 aa, Artificial Sequence
  Synthetic sequence.
SLEEVLERIKRIIDELKREAKRVLDETNTLIREVKKRLEDVNRDVNRLIEELRERV

SEQ ID NO: 8909 - protein, 57 aa, Artificial Sequence
  Synthetic sequence.
MVRDLERRIREVVKRLKEDLERWKKEVEDEIKRLEDRLKEWLDRVREMLEKLREEDR

SEQ ID NO: 8910 - protein, 56 aa, Artificial Sequence
  Synthetic sequence.
SSEEVLKTIKDIIDELRKEAEEVLRRTNESTKELEERAEEVNKRVNDSTRELAKKV

SEQ ID NO: 8911 - protein, 59 aa, Artificial Sequence
  Synthetic sequence.
EEMLDEVKKRAEKVVEDLRRELRKWLEDNKRLVEKLEKELRDWLKENKELVKELEDRDR

SEQ ID NO: 8912 - protein, 56 aa, Artificial Sequence
  Synthetic sequence.
SSEEVLDTLRKLIEDLRRRAEEVLERTNRSTDELRKRVEKVLEETNRLIKKVEDDI

SEQ ID NO: 8913 - protein, 59 aa, Artificial Sequence
  Synthetic sequence.
EDMLREALERIKEIIDRLERELEEWIKTNEDLVRRLTEDLERWLRTVAEILKRLKDEDD

SEQ ID NO: 8914 - protein, 60 aa, Artificial Sequence
  Synthetic sequence.
DELERVEEEIKKLSDDSRRVIEEVRRRLEESNKDLERRLREVEKRLKELTDDIKRTAERN

SEQ ID NO: 8915 - protein, 59 aa, Artificial Sequence
  Synthetic sequence.
RELLRKLLDDVRRVVERNKRKLRKDLEDNKREIERVKREADKDLEDHERVIRKLKEDIR

SEQ ID NO: 8916 - protein, 60 aa, Artificial Sequence
  Synthetic sequence.
DELERVVEEIRELSRDSERAIEEVRRELKRTNDENRESAKRVAEELKKLTDKIKEEADRN

SEQ ID NO: 8917 - protein, 59 aa, Artificial Sequence
  Synthetic sequence.
RELLRELLKEVRRVVEENKRRLEEDLKKNRKKIDDSNKELRKDLEDHRRVIEKLEREIR

SEQ ID NO: 8918 - protein, 58 aa, Artificial Sequence
  Synthetic sequence.
DELEKVKEDIKRLLDDVRREVEKVNRDSRRLLEDLRRVVKEVSDRSKELAEDLERKVG

SEQ ID NO: 8919 - protein, 56 aa, Artificial Sequence
  Synthetic sequence.
VEDVLREVKRLAEEVKKETKRVLDEIKKLVEDVARELERILEDSERLIREVEKRAT

SEQ ID NO: 8920 - protein, 58 aa, Artificial Sequence
  Synthetic sequence.
DEIEDVLRRAKKLLDDLRRVVKKANDDSRRLLKKLKDKVEEVSRRSRRLAEDLERTVG

SEQ ID NO: 8921 - protein, 56 aa, Artificial Sequence
  Synthetic sequence.
VEDVLREVRKIIEDVKRASEKILEESRKLIEDVERRLEEILKRSEDLIRTVKERKR

SEQ ID NO: 8922 - protein, 60 aa, Artificial Sequence
  Synthetic sequence.
DELERVLEEIKRLLDDVHRESKRVNEESERLVKKLHDDSRRVLTEIKKLLDDVRRVVEEL

SEQ ID NO: 8923 - protein, 58 aa, Artificial Sequence
  Synthetic sequence.
EKVEEILRRVRELVKKWKTELERALEENEREVERWKRDLDRILEEVRRVVERVEREIR

SEQ ID NO: 8924 - protein, 59 aa, Artificial Sequence
  Synthetic sequence.
DELEKLLEDIRRELKRVREDDKRHNDKVKETLDRVRELIKRLLELIKKVADEIRSLKRR

SEQ ID NO: 8925 - protein, 58 aa, Artificial Sequence
  Synthetic sequence.
REVEEVKRRIEEILKEAEETNRRSHEKAKRVLEELKDIVRKVLEELRRLLRELEEEVR

SEQ ID NO: 8926 - protein, 59 aa, Artificial Sequence
  Synthetic sequence.
EELERLREEIKKILDEARERDETLLREIRREHEKNKRADEEHNRRVEETLERIERLAER

SEQ ID NO: 8927 - protein, 58 aa, Artificial Sequence
  Synthetic sequence.
EEVRAVERELRKILDEIRKTNKEVHDRIRELLERSKRSNDESHKKVEDVLRELKKRVD

SEQ ID NO: 8928 - protein, 59 aa, Artificial Sequence
  Synthetic sequence.
SETDEVRKELRKLLEDSRRAVEEVKKKLDDSNKEVRDRVRRIREELKKLEKEVREIKRK

SEQ ID NO: 8929 - protein, 55 aa, Artificial Sequence
  Synthetic sequence.
EELLKELEEVLKRLRELHKRTIDEVEKSAREVKDEIRRLEEELDRVLKKLEDALR

SEQ ID NO: 8930 - protein, 59 aa, Artificial Sequence
  Synthetic sequence.
SLDEDVERLIKELKDEARKLNEEMKEYVRDSERKVRRLNEEIRRLIEELKRKAEELKRG

SEQ ID NO: 8931 - protein, 55 aa, Artificial Sequence
  Synthetic sequence.
DRVKERLERVLDEAEKSNEETLRELDDVSRRIEESNRRTLAELEKVLRDIEKDVT

SEQ ID NO: 8932 - protein, 60 aa, Artificial Sequence
  Synthetic sequence.
SELEKLVEDLRRAAKESHERNEKLLDESRKTVEDVKRKLEEILRRSEEVVREIKKKKKDI

SEQ ID NO: 8933 - protein, 55 aa, Artificial Sequence
  Synthetic sequence.
EEVRRRVEKLIEENRRSSRRVEEEDKRLLKELKDAIKRVEEEDKKLVEELRRSEK

SEQ ID NO: 8934 - protein, 60 aa, Artificial Sequence
  Synthetic sequence.
KEVEDLVKEVKERIEESHKENKRILDKARRVVERVETDLRRILEESKRTVEDIERRKERI

SEQ ID NO: 8935 - protein, 55 aa, Artificial Sequence
  Synthetic sequence.
EEMKKAVDELIERNKRSSDRVREEAKKLIDRLEEVIEKVERDDEKLVRDLEEELR

SEQ ID NO: 8936 - protein, 61 aa, Artificial Sequence
  Synthetic sequence.
SSLETLEKIARDLLREVKETLDRVREESRRLLEEVRRVAEESRKEVERLLKELEEVIRREV

SEQ ID NO: 8937 - protein, 59 aa, Artificial Sequence
  Synthetic sequence.
DELLRELAERVRRVVKKIKDELRDDLRRTREEVERLKERHKELVKRVKEAVDKIREEIR

SEQ ID NO: 8938 - protein, 60 aa, Artificial Sequence
  Synthetic sequence.
KEVEEILRDVARLVEDNRRVLERILREVEKLIRDNEERLKEILERSKDLVRRIEELIRRG

SEQ ID NO: 8939 - protein, 55 aa, Artificial Sequence
  Synthetic sequence.
EEVRRAIEELLKDVERAYEEVVRRIEKLLDDLRRKYEEVKKENERLNRRVEEAAR

SEQ ID NO: 8940 - protein, 60 aa, Artificial Sequence
  Synthetic sequence.
DDVEDILRDVERLVEENRRRLEEIVRESEDKVRKNDETLKKILEDVKREVERVERAIERG

SEQ ID NO: 8941 - protein, 55 aa, Artificial Sequence
  Synthetic sequence.
KDVVRAIEELLKDVEEKYRRVSERNKELNKRVEDTYREVMKEIRRLLERVDRRAR

SEQ ID NO: 8942 - protein, 57 aa, Artificial Sequence
  Synthetic sequence.
TEVERLVERVKEIVEEHRKKLEELARRSEELVERHEKKLRDLLRESRELVERAKKEN

SEQ ID NO: 8943 - protein, 54 aa, Artificial Sequence
  Synthetic sequence.
EIKERLKELLREAEEVSRRVNKRNEDLLRRLEKVSREVNERNEDLLEELDRTVN

SEQ ID NO: 8944 - protein, 56 aa, Artificial Sequence
  Synthetic sequence.
DEVERLVEEVEKLVEEWIRDLERILDESRRTVEEWKKELKRLLDRSKRLVEDAKRK

SEQ ID NO: 8945 - protein, 54 aa, Artificial Sequence
  Synthetic sequence.
DIERRLERLMEELHRVSKEVLDADRELLKELHDVSREVNKRNEELLDELRKTVT

SEQ ID NO: 8946 - protein, 57 aa, Artificial Sequence
  Synthetic sequence.
DEVEETVKRVREEVERWKEELKRIADEVRRLVEKVKDDLRRLLDESRKLVEEVRREN

SEQ ID NO: 8947 - protein, 54 aa, Artificial Sequence
  Synthetic sequence.
EIKRRLEELLKELHKVSKDLDKILEELLREVEEVVRRVNETNKKLLKELDETVR

SEQ ID NO: 8948 - protein, 57 aa, Artificial Sequence
  Synthetic sequence.
SEVEELVKRAAELADEARKRLERIMEEVKRLVDEWEKELKKLLDESKELVEKVRREN

SEQ ID NO: 8949 - protein, 54 aa, Artificial Sequence
  Synthetic sequence.
KVREDLRRLLDTLRKVVEELKRRLRELLKKLHDVSRKVNEENERLLRELEETVR

SEQ ID NO: 8950 - protein, 57 aa, Artificial Sequence
  Synthetic sequence.
DEAEKLVDEVRELVRRHKETLKEILERVKELVKRWKDTLDKLLRDSEELVRRVKEEN

SEQ ID NO: 8951 - protein, 54 aa, Artificial Sequence
  Synthetic sequence.
RVKEELKRLLKELKEMSKRLTEELRRLLKELHDRSREVNERNKRLLEEVDRTVK

SEQ ID NO: 8952 - protein, 56 aa, Artificial Sequence
  Synthetic sequence.
DEIREVEERNRRSNEEMKKAVREVEKDIERVAREIRKRAEEVSKRNEDINREIRKT

SEQ ID NO: 8953 - protein, 59 aa, Artificial Sequence
  Synthetic sequence.
DETLRRVIRKSEELLKRLKDRLDEVRKRVEEILKRAEERLREVIKRSEELLEEVKRESD

SEQ ID NO: 8954 - protein, 56 aa, Artificial Sequence
  Synthetic sequence.
SLLEEVEKTLRKIVEDSDREIKRVSKKNKETVKRLEELMREVNRRSTEIVKRIRDS

SEQ ID NO: 8955 - protein, 59 aa, Artificial Sequence
  Synthetic sequence.
KEMLDRIIEEAKRLHEENKRKLEEVERRSEELLKELKRRLEELIKRNDDLLREVEERKR

SEQ ID NO: 8956 - protein, 60 aa, Artificial Sequence
  Synthetic sequence.
DEVEEVIRRAEELVKEVKKRLEELIRESEALLERVKRRLERLIEESRRRLEEVKKKVSSG

SEQ ID NO: 8957 - protein, 54 aa, Artificial Sequence
  Synthetic sequence.
EIKKRLRKLLEEIKKVVDDVRETNKRTLERLEELARRVNEENKKILDDLEEAVR

SEQ ID NO: 8958 - protein, 60 aa, Artificial Sequence
  Synthetic sequence.
KEVDEVVKRAEDLLREVKKRLDEVIEDSERLLREVRKRLEEIIRESEKLLEDVRKVVERG

SEQ ID NO: 8959 - protein, 54 aa, Artificial Sequence
  Synthetic sequence.
EIEKRLEEILREIKKLVEEVNRRNEDILRRLEREVEKVRRVNEKTLERIEETVR

SEQ ID NO: 8960 - protein, 60 aa, Artificial Sequence
  Synthetic sequence.
SLVEDIRRDVKRILKEIDKLVKDIEEENRRASRESERLVETIRREVKEVLDRIRKLVRDV

SEQ ID NO: 8961 - protein, 59 aa, Artificial Sequence
  Synthetic sequence.
RKLIEEIRRRLKKALEDIRRLIEESRKRVEESLTRSRKLAEDIRRELEDVLRKVDEDAK

SEQ ID NO: 8962 - protein, 56 aa, Artificial Sequence
  Synthetic sequence.
SRVKEVADRVRDIVRRIKDEIKEHVDRLRDVIRRIKEKLEEHSRRLREIVERIRAS

SEQ ID NO: 8963 - protein, 59 aa, Artificial Sequence
  Synthetic sequence.
EELLKRLEDIIRKLLEDIKRVVKELEEVSRTLLREIEELLEENRKSMEKLLRDIEEEAR

SEQ ID NO: 8964 - protein, 56 aa, Artificial Sequence
  Synthetic sequence.
SKVDEVVKRLEDAVREIKKEIDKHSKELADEVEKIKKELKDVSDRNREVVRRIREA

SEQ ID NO: 8965 - protein, 59 aa, Artificial Sequence
  Synthetic sequence.
EKKAEELRKRVDDLLEEIRRLLEENKRTVDKLLDEIKRVLEDHRRSVEELLREIDKDAK

SEQ ID NO: 8966 - protein, 56 aa, Artificial Sequence
  Synthetic sequence.
SEVDEVLREAKRIVDEVHKDNERATEESRRLVKKVHEENEEMVKDIERIVKEVKDA

SEQ ID NO: 8967 - protein, 55 aa, Artificial Sequence
  Synthetic sequence.
KELEREVEKLLKRIEESLRRHRKENKRLLEELDRSLRELAKIVKEVLDEIRERTR

SEQ ID NO: 8968 - protein, 56 aa, Artificial Sequence
  Synthetic sequence.
SEIEDAVRRIEKRVEEVHRENKKLTDESRKLVREVDEENKKVSRESKKLVEDARRR

SEQ ID NO: 8969 - protein, 55 aa, Artificial Sequence
  Synthetic sequence.
RELSEKVREVLEKIKKSLEDHRKANEDLLREIRDSLKKHRDENRRLLKELEETRK

SEQ ID NO: 8970 - protein, 57 aa, Artificial Sequence
  Synthetic sequence.
SDLDRVAKELTEIVERIIRELERLTEKSRDIVRKVHKENEDAVRKIRKIVEEVKRKK

SEQ ID NO: 8971 - protein, 55 aa, Artificial Sequence
  Synthetic sequence.
RELEKRVRDLLRRVEEALRRHKEENRKLLEDIKRSLEEVAKEVERVLKEIKDTAR

SEQ ID NO: 8972 - protein, 57 aa, Artificial Sequence
  Synthetic sequence.
SEMDDVLKKLAETVKRIIERLKKLTDDSRRLVEEVHRRNDKLSKESREAVRKAEERN

SEQ ID NO: 8973 - protein, 55 aa, Artificial Sequence
  Synthetic sequence.
RELSEEVKKLLDEVRKALKRHKDENDKLLKEIEDSLRRHKEENDRLLEKLKESTR

SEQ ID NO: 8974 - protein, 57 aa, Artificial Sequence
  Synthetic sequence.
DEAREILKEIRDIADELRKRLERLTERSERIVREVDKENRRVVEEIREIVERVKKAK

SEQ ID NO: 8975 - protein, 55 aa, Artificial Sequence
  Synthetic sequence.
RELKKEVERVLEEIRRLLEEHERANRKLLKEIRDSLRELKKRVEEVLREIKEATK

SEQ ID NO: 8976 - protein, 57 aa, Artificial Sequence
  Synthetic sequence.
SEAEEMLERIKRRVEEVNKENKKMTDESKKIAEDVDRDNREVLREIKRIVDEVRKRN

SEQ ID NO: 8977 - protein, 55 aa, Artificial Sequence
  Synthetic sequence.
KELEKEVERVLKEIKDSLRRHRKENEDILREIKESLDELDKEVKRVLKEIRDTAR

SEQ ID NO: 8978 - protein, 57 aa, Artificial Sequence
  Synthetic sequence.
SELEEVAKELRKTLEDSTRENKKHTDDVRRIVDEVDKRNRKAVEDIRKIVDEVRKRK

SEQ ID NO: 8979 - protein, 55 aa, Artificial Sequence
  Synthetic sequence.
RELEEIVKRLNERDKEVLEKDAEDVKRVLEEIKESLERVARDVERVLEDIKRATD

SEQ ID NO: 8980 - protein, 61 aa, Artificial Sequence
  Synthetic sequence.
SALEDLERKVEELIRRLDELLREHRETLERLIRELDKLLTDHHRRNRELLERIKDVVRKAG

SEQ ID NO: 8981 - protein, 59 aa, Artificial Sequence
  Synthetic sequence.
EDKLRKIVEELERLVDEVRRSLEKASKRLKDLVKEVKKRLEDITRESEELVRRVEERTR

SEQ ID NO: 8982 - protein, 61 aa, Artificial Sequence
  Synthetic sequence.
SALEELKKEIKRVIEELKRALERHHKENEELRKRIDEVLKEHHDANRRLLEEIKELVRRAG

SEQ ID NO: 8983 - protein, 59 aa, Artificial Sequence
  Synthetic sequence.
EEKLKEIVKEIRKKVEELKDDLRRMSEESRRLVEELEERLRRLTERSKRLVEDVRRRVT

SEQ ID NO: 8984 - protein, 56 aa, Artificial Sequence
  Synthetic sequence.
SEKEELDRKIEDVRKKVEETSRKLKRVNDESKKEVKRTSDELRKKSKEVNEAVERE

SEQ ID NO: 8985 - protein, 56 aa, Artificial Sequence
  Synthetic sequence.
VEEAIRRLKETLDRHREEVEDLIRKSREVLKRHEERVRELIKRHEDTLRELKKRAK

SEQ ID NO: 8986 - protein, 60 aa, Artificial Sequence
  Synthetic sequence.
SEVDELMKRLKDEAEDIKEKVERLIREWEEAARKIAERVEKLVRDWERVIETLRDLKKRV

SEQ ID NO: 8987 - protein, 59 aa, Artificial Sequence
  Synthetic sequence.
KDLAERLRRVLREVERLVRTVNKKHREVLEEIRKEVERVNDEHRRVLEEIKRRVEKDVK

SEQ ID NO: 8988 - protein, 60 aa, Artificial Sequence
  Synthetic sequence.
SAEEKLDTEVRRIAEEVKRIIDELRKVTEEVEKRIREINKTSEDTSREVKKTIREVLKRL

SEQ ID NO: 8989 - protein, 59 aa, Artificial Sequence
  Synthetic sequence.
EDTVEEVLERLRRALEKADKLVKDHIKRLKDVLRAIEEDHRRHLERLRRMLEEIKKEVT

SEQ ID NO: 8990 - protein, 60 aa, Artificial Sequence
  Synthetic sequence.
SVEEKLTREAERLLKRIEEVIRRLRDANRRSADRIRRIDEKTRREVEKLKKKIRELAKRV

SEQ ID NO: 8991 - protein, 58 aa, Artificial Sequence
  Synthetic sequence.
DLVEKVIKTMRKIVEDLERDVRKVIRDDEELVERLRRENEEVIKKLREIVKRLEDETR

SEQ ID NO: 8992 - protein, 60 aa, Artificial Sequence
  Synthetic sequence.
SLIERLREVAEDLKRRIRKVLEDLRRANEESAKRIRDIDRRTREANRESNERIKEIAKRV

SEQ ID NO: 8993 - protein, 58 aa, Artificial Sequence
  Synthetic sequence.
EKVKKVIDDMERIVREIEEKIKRVIERDKKLVKKLEEDNRRVIKKDKDLVRRLEERTR

SEQ ID NO: 8994 - protein, 57 aa, Artificial Sequence
  Synthetic sequence.
SLKERLRDDAKRLLDEDRKVLEDLERRAKEINDRNEEIVKKLRDKVREILERIDREV

SEQ ID NO: 8995 - protein, 59 aa, Artificial Sequence
  Synthetic sequence.
EEVIRRILEELRELVERSERTVRDIERELDELIDKSRRDVEEIIKDLERELEELKRKTK

SEQ ID NO: 8996 - protein, 57 aa, Artificial Sequence
  Synthetic sequence.
RVREELEKAAEEVRRRDRRVLEELEKEVRRINEDNKRVHETSREVVERILETIDRRV

SEQ ID NO: 8997 - protein, 59 aa, Artificial Sequence
  Synthetic sequence.
EDVIRKIVRELEELVRESKETVDDIIRRLEELIRKSREDNRKIVEELKKLLDDLTREEK

SEQ ID NO: 8998 - protein, 57 aa, Artificial Sequence
  Synthetic sequence.
SLKETLEEVVKRVLETDKRLLEKNDRTVREVNERNRRVHEESRRAVERILEEIDREV

SEQ ID NO: 8999 - protein, 59 aa, Artificial Sequence
  Synthetic sequence.
EDTIRRIAKEADDLLEDSRRKVEDNSRRLKRLLEESKKSNEEIVRRLEDLLRRLKKESE

SEQ ID NO: 9000 - protein, 57 aa, Artificial Sequence
  Synthetic sequence.
SLKEELEEDVKRINDRNEEVLKRLREVAKKLLDDDRKLLKELKKVVEDVLRDVDREV

SEQ ID NO: 9001 - protein, 59 aa, Artificial Sequence
  Synthetic sequence.
AEVIKKILEELEKLIKDSEDTAREIIKELKELVERSKRKVEEILKELEDLLEELKRRAD

SEQ ID NO: 9002 - protein, 57 aa, Artificial Sequence
  Synthetic sequence.
SMEEKAEEVIKEVDEENKRLIEEAEKVIEDVEREDRRLVDELRKVIEKVERTIERDL

SEQ ID NO: 9003 - protein, 59 aa, Artificial Sequence
  Synthetic sequence.
KDVIEEIIERLRRHVEDSEEKIRRIIRRLEEVLKRSKEDIERIIEELERLLDEMRERAR

SEQ ID NO: 9004 - protein, 58 aa, Artificial Sequence
  Synthetic sequence.
DMDRKLKEEIKRAERRDKELVKDIERVIEEVLRANKELIERIEKVIDDVRREIEKRLK

SEQ ID NO: 9005 - protein, 59 aa, Artificial Sequence
  Synthetic sequence.
KDVIEEIIERIKDILRESEREIRRIIKELREHLKKSADRIEKIRRELERLLEKLEDDAR

SEQ ID NO: 9006 - protein, 61 aa, Artificial Sequence
  Synthetic sequence.
SEIEKILRELEEHIKDSEREHRELVERLRDHIRRSKEEHRDLIRKLEERIREVERRVRKDG

SEQ ID NO: 9007 - protein, 59 aa, Artificial Sequence
  Synthetic sequence.
KELKDRLKRVSEEHKRRIEDLLRRTKRVSERHREEIRKLLETTERAIKKARETIERLRK

SEQ ID NO: 9008 - protein, 61 aa, Artificial Sequence
  Synthetic sequence.
SEIDRLLERLEDHIRKSAKRHRDLVEELREHAERLKRDIERLLEELEKTVRDIEKEVRERG

SEQ ID NO: 9009 - protein, 59 aa, Artificial Sequence
  Synthetic sequence.
EDMKRKLEKVSEEHERKIKELLDRTKRASEEHDERVKRLLDELRRVLKEAEERLRELKR

SEQ ID NO: 9010 - protein, 61 aa, Artificial Sequence
  Synthetic sequence.
ERIDRIIKELEDLVDESRKRNDDLVRELKKHIKESKDEHDRLVEELDRFVEEVRKRVEKDG

SEQ ID NO: 9011 - protein, 59 aa, Artificial Sequence
  Synthetic sequence.
EDAIRKLEDVLRKVRETHERLLDKSRDVSRKHREDIKELLKKTKTVIDRVRKRIKELRK

SEQ ID NO: 9012 - protein, 60 aa, Artificial Sequence
  Synthetic sequence.
SEVERIEEELRREIEKVDRDNKKIVDEARRSIDELRKDVEDILRDLRRLVDEVEKMARRG

SEQ ID NO: 9013 - protein, 59 aa, Artificial Sequence
  Synthetic sequence.
EELLKRVEDVVDEVRKRLERIDEKTRKAVKEVTDRNDELLKRVREVVKEVRARLEEIRR

SEQ ID NO: 9014 - protein, 56 aa, Artificial Sequence
  Synthetic sequence.
SEKEKVDKVVKKVAKRIKDLLDEIKRVADESNERLERLLRRLEEASKRSKKKLKDD

SEQ ID NO: 9015 - protein, 56 aa, Artificial Sequence
  Synthetic sequence.
VDTLIKELEDRIDEVEKRIRELIERDKRLVEEVERRIAELIRRDERLVEELKKREE

SEQ ID NO: 9016 - protein, 56 aa, Artificial Sequence
  Synthetic sequence.
SEKEKLKDVVRDVERLIKELMERLERVHERTNREITRLLEDARRAMERSNKKLTDL

SEQ ID NO: 9017 - protein, 56 aa, Artificial Sequence
  Synthetic sequence.
VDDLLRRLKELIERVRKLIEDSIKELRDIVKEVKDRIKTLIERDKELVKRLEDRAR

SEQ ID NO: 9018 - protein, 57 aa, Artificial Sequence
  Synthetic sequence.
SEVDKLVRDLERHIEEAKRRVEELLKEIKKLVEDTKREAKKLLDTLRKKVEDVEREN

SEQ ID NO: 9019 - protein, 59 aa, Artificial Sequence
  Synthetic sequence.
EEMLRKMREVSERHKKTIDELRKELKKVLDEWRRRSEKIFEELDEVLKRVEERVKEVER

SEQ ID NO: 9020 - protein, 57 aa, Artificial Sequence
  Synthetic sequence.
SEVDELVRRLREHIRRAKERVEELIKRIKTLAKETTDRARKLIEDLKRHIDDARRKN

SEQ ID NO: 9021 - protein, 59 aa, Artificial Sequence
  Synthetic sequence.
REVLKKIKEVSDEHRKEIERLRKRLEEVLREWEDTSREVLERLKEVSKRHRDEIREVAR

SEQ ID NO: 9022 - protein, 57 aa, Artificial Sequence
  Synthetic sequence.
SEMEDLIRRLREHIEDVRRKVEELIRELEDHIRRAEESVKKREDDLRRHIEEVRKRN

SEQ ID NO: 9023 - protein, 59 aa, Artificial Sequence
  Synthetic sequence.
KEVLDEARRVSKEHKDTLEKLLRKAEEASERHKREIERLLKELKEVSEEHRRRIDEVRR

SEQ ID NO: 9024 - protein, 55 aa, Artificial Sequence
  Synthetic sequence.
SEVEELIEDLKRHLKEVADRVEELERELRKHLEEHHRRVREIIRRLEDLLRKAEE

SEQ ID NO: 9025 - protein, 59 aa, Artificial Sequence
  Synthetic sequence.
EDLKRRIEKVSRDHERTVEKLVRDLERVSREHERTVKENKERIKKVLDDARKRVDEVKK

SEQ ID NO: 9026 - protein, 59 aa, Artificial Sequence
  Synthetic sequence.
SEVEKLVRELEDVLRKIERKVRELSKDNKRVLDENKKRVEDVSRDNERAMREIEELRRK

SEQ ID NO: 9027 - protein, 55 aa, Artificial Sequence
  Synthetic sequence.
EELKKVLEDVKREVEKLLEEIKRSLEEARKTVKESNDEIRESLERLEEKVRRIEK

SEQ ID NO: 9028 - protein, 59 aa, Artificial Sequence
  Synthetic sequence.
DEVKDLVKRLEEVIKRIDEVVKEVDRRNREVLERNRELVERSIRELREVLDRIRRRKKD

SEQ ID NO: 9029 - protein, 55 aa, Artificial Sequence
  Synthetic sequence.
SELDKVLEDVKRKVEEILRRIKRSLDEVERDVRRSNEENKKVTKEVREAAEEIKR

SEQ ID NO: 9030 - protein, 59 aa, Artificial Sequence
  Synthetic sequence.
DEVEELVRRLREVLEEIRELVERVNDRNRRVLEENRELVTRSIEELRRALERIERLSKD

SEQ ID NO: 9031 - protein, 55 aa, Artificial Sequence
  Synthetic sequence.
EKLKKVLEEVERRAKKLLRDIEESLRRVAREVERSNEENKKVTKEVADAVREIER

SEQ ID NO: 9032 - protein, 57 aa, Artificial Sequence
  Synthetic sequence.
DEEKKARDVLERWRKRSEDLLRKAEDVLREWRERSERSFKRLRDVLEEARKRVEELN

SEQ ID NO: 9033 - protein, 55 aa, Artificial Sequence
  Synthetic sequence.
DELVREIEEVVKETEKRVEELIKEIREMVKKNEREVREIERRLEETLEKIDRDRK

SEQ ID NO: 9034 - protein, 57 aa, Artificial Sequence
  Synthetic sequence.
SEEEEIEKALRDWREELKRLLETIERLLREWKRRVEELKKRIEEALKELKKILDDKG

SEQ ID NO: 9035 - protein, 56 aa, Artificial Sequence
  Synthetic sequence.
VEEVKKKLEKEIKKNRENVDRLRRRLEEEVKRNERSVEEIKRRLDEIARELDERKK

SEQ ID NO: 9036 - protein, 57 aa, Artificial Sequence
  Synthetic sequence.
SEDEEIKEALKEWRDEVRRLEEKIRRVLEKWERDVRRLKEEIKKSNEDLRRRLEEKG

SEQ ID NO: 9037 - protein, 56 aa, Artificial Sequence
  Synthetic sequence.
VEEVKKRLKRLIEENRKNVKRLEERIREAVKKNEKSVEDSERENRDIARELDEKRK

SEQ ID NO: 9038 - protein, 60 aa, Artificial Sequence
  Synthetic sequence.
EEVERLKERLERLSERSKEIAKRVHEENKKLSEESRKLVEDVHRENEEAAKRLEDVARRN

SEQ ID NO: 9039 - protein, 59 aa, Artificial Sequence
  Synthetic sequence.
RELLERLRRVLEEHREVNERILEEIKRSLDEHKDTNRKLLEEIEKSLRDLEEIVRRLEK

SEQ ID NO: 9040 - protein, 60 aa, Artificial Sequence
  Synthetic sequence.
REIEEIEKEVRDVSKESEDIVRTVHDENRRASERSRELVKRVDEENRKAVEDLERVAREN

SEQ ID NO: 9041 - protein, 59 aa, Artificial Sequence
  Synthetic sequence.
DELLRRVRKLLEDHKRVNERLLEEIEKSLKRHREENERLLEEIRKSLEDVERVVEEIKR

SEQ ID NO: 9042 - protein, 60 aa, Artificial Sequence
  Synthetic sequence.
SELEELEKRLRKAVRDLEEIVDRVRKDLERASDDSRRIVEEVHRENRKVAKELKEVRDRN

SEQ ID NO: 9043 - protein, 59 aa, Artificial Sequence
  Synthetic sequence.
EELLEALERLLRELEKIVRKLLRELEEMLRRHEKTNRELLERIRRSLEELAKIVEDLET

SEQ ID NO: 9044 - protein, 60 aa, Artificial Sequence
  Synthetic sequence.
DEIEEIKKELDELSKRSEKIVRDLERELREASKESERLVRKVHDDNRKALEELRDVRRRN

SEQ ID NO: 9045 - protein, 59 aa, Artificial Sequence
  Synthetic sequence.
DELLKEVRRALEEHERVNRELLERIRRVLEEHKRVNEELMREIDRSLKELAEIVKRLKD

SEQ ID NO: 9046 - protein, 60 aa, Artificial Sequence
  Synthetic sequence.
DELEELRKELKKMVDEIEEIVRRVDKENRDASRESEELVERIVEEVRKAVTELKELKKRN

SEQ ID NO: 9047 - protein, 59 aa, Artificial Sequence
  Synthetic sequence.
DELLKEVRKALERLKEEVKRVLEDIRRSLEEHRKVNERALRRIEEVLRDLERIVEEVKT

SEQ ID NO: 9048 - protein, 60 aa, Artificial Sequence
  Synthetic sequence.
SEVERLKDELRKASEELKKEVEEIEKRLREMSERSRKLVEELKRTLKEIEKELKDIVRKD

SEQ ID NO: 9049 - protein, 59 aa, Artificial Sequence
  Synthetic sequence.
DRLKEEVERVLREHEKSLERLRERLKELLERHHKTNEELLREIKEALERLEKIVKDLTD

SEQ ID NO: 9050 - protein, 60 aa, Artificial Sequence
  Synthetic sequence.
DEVEDAERRLREMSERIEDLVRRVEERLRRMSEESKKLVEDVKRENDKSVEELDRIVRRD

SEQ ID NO: 9051 - protein, 59 aa, Artificial Sequence
  Synthetic sequence.
DRLKERLEKLLRDHRRSVEEVIKKLDRLLKEHHKVNEKLLRDIDKSAKEVKKVVEDKTR

SEQ ID NO: 9052 - protein, 60 aa, Artificial Sequence
  Synthetic sequence.
SEVEEAEKELREMSKTSTRLVEELEERLRRASETLKKLVDDVKRELDKRLEDIDRRVARN

SEQ ID NO: 9053 - protein, 59 aa, Artificial Sequence
  Synthetic sequence.
DRLKERVDRLLEEHHKVNKRLLERIEEVLRRHETTLRELIKEIDKLLRDLKKRIDDVKK

SEQ ID NO: 9054 - protein, 60 aa, Artificial Sequence
  Synthetic sequence.
DEVREVKKELKKIAEELRKLIEEVREELRKMSKRSEELVRELKKRNEKSVRDLERIVRKD

SEQ ID NO: 9055 - protein, 59 aa, Artificial Sequence
  Synthetic sequence.
DKLKEELKEALKDLERELKELIEELKRLLDEHHKRNEDLLREIDKSVRKVEEDVRRLKK

SEQ ID NO: 9056 - protein, 60 aa, Artificial Sequence
  Synthetic sequence.
SEVDEVRKELERLVREIKKLVEDSKRNLDRLSKELEERVRDLERDARRLVKELRDLLKEN

SEQ ID NO: 9057 - protein, 59 aa, Artificial Sequence
  Synthetic sequence.
KEVRDDVRRLIREVDEELKKAKEDLDRAHEEHEKSTERLRERIKEVVDRVREDIERTKN

SEQ ID NO: 9058 - protein, 56 aa, Artificial Sequence
  Synthetic sequence.
DEERRIEKVLKEWEKRTRDLARELERVNREHKKTSEDVLKKLEEINREVRRVVKEE

SEQ ID NO: 9059 - protein, 56 aa, Artificial Sequence
  Synthetic sequence.
VEKLRRLIEEVIREDERRVERVKRNNKRLSEETEKLVEDVRRNNERLVKEVRDRSR

SEQ ID NO: 9060 - protein, 56 aa, Artificial Sequence
  Synthetic sequence.
SEEEEIKKVLDEWRRRTEELRKDLDRVLEEDRRSVEEVKRRLDKVNEELRRRIDEL

SEQ ID NO: 9061 - protein, 56 aa, Artificial Sequence
  Synthetic sequence.
VERAKEEIKKVIKEDEDLVRRVRKYIEENSDELRRLVEEARKNNTRIAKEAEDTSR

SEQ ID NO: 9062 - protein, 56 aa, Artificial Sequence
  Synthetic sequence.
SEKEEIDKVLKEWEEMTRRLVEELKKSHDEDRESVKRLLERLRDVNRELKEIIDRA

SEQ ID NO: 9063 - protein, 56 aa, Artificial Sequence
  Synthetic sequence.
VEKAKETVRKVIKEDRDLVREFKKYNEENSDRMRKLVKDIKENNRRIVEEARERSR

SEQ ID NO: 9064 - protein, 56 aa, Artificial Sequence
  Synthetic sequence.
SKEEKLREALKKVRKDVKDLERHIDRSVKRNKEEVDKAKRELERSLEELRRRLEEL

SEQ ID NO: 9065 - protein, 56 aa, Artificial Sequence
  Synthetic sequence.
VEELLERLERTLRRMREKVRKLDKENKDHTEKVKEDVKRVHDENDKVREDVDRKDK

SEQ ID NO: 9066 - protein, 60 aa, Artificial Sequence
  Synthetic sequence.
REVEELVKEIERVLEETKKRSEDTKREVEKVLEDTKRLVERLRKTLEELLRELDKRVRSG

SEQ ID NO: 9067 - protein, 59 aa, Artificial Sequence
  Synthetic sequence.
EELRRTLEKVLREWRDVNRKVNDTDRKVLEDWERVNRTVNEELKEVLERAKEDIDRVAT

SEQ ID NO: 9068 - protein, 60 aa, Artificial Sequence
  Synthetic sequence.
DEVERLVEEIKKRIDETRKLLEELKKRIRKVLEETKDLVRRLLKRLRELLKELEERRRRG

SEQ ID NO: 9069 - protein, 59 aa, Artificial Sequence
  Synthetic sequence.
EELRRELKRVLDEWKKANDEVRRAMEEILKEWEEVNRKVNKDLRDVLEEVKERLREVAK

SEQ ID NO: 9070 - protein, 60 aa, Artificial Sequence
  Synthetic sequence.
SEVEKLKKRLRDLLEELKRLSRRTKEDVRRVIKETRDRSKKTKEELEKLLREIRELRKRG

SEQ ID NO: 9071 - protein, 59 aa, Artificial Sequence
  Synthetic sequence.
EDLRTEIKKILEEVKREIDRVRETDEKVLRDWKKANDEVRETDREVLRKIREDLKEVAR

SEQ ID NO: 9072 - protein, 57 aa, Artificial Sequence
  Synthetic sequence.
RERETIEKVLDENRKSLEEVTETVKRVLDRWDETLKRLEEEVRRVNDKTRKVLEDLL

SEQ ID NO: 9073 - protein, 56 aa, Artificial Sequence
  Synthetic sequence.
VKELKKRVKELSEKLREVLEELERRVREIVKRNKETVDESRKRNEELIKRAEDAAK

SEQ ID NO: 9074 - protein, 60 aa, Artificial Sequence
  Synthetic sequence.
SEIDEVRKRVEKHSRDAKRLVDELREKNDRAIKTLERLLRELEKRNKKVIRDLEDVRTKN

SEQ ID NO: 9075 - protein, 59 aa, Artificial Sequence
  Synthetic sequence.
EDMVRELRRVLKENDESVRRLKREIEEVHKETERVVKEVLEEIRRVDEELKDVARKVET

SEQ ID NO: 9076 - protein, 60 aa, Artificial Sequence
  Synthetic sequence.
REIEEVIKELKRHSEELEKELDRLRRENKEAIRTSKKLVEDLRRENTRAKEELEDVKREN

SEQ ID NO: 9077 - protein, 59 aa, Artificial Sequence
  Synthetic sequence.
ERALERLRRVVRENEESVERVLKKIDDIHEETKRVSDRSEKEIEDVDRDLKRKVEEVEK

SEQ ID NO: 9078 - protein, 63 aa, Artificial Sequence
  Synthetic sequence.
REREKIKRILDELRKRVEELNRRNEELLRRLDKVVRDVNRTNKRLLEKLRKVADDVRRKLKDE

SEQ ID NO: 9079 - protein, 56 aa, Artificial Sequence
  Synthetic sequence.
VDKVERTVEEIEKELTRLVEESEKEVKRIIEELKELLERSRKSVEDIIREVRKLAE

SEQ ID NO: 9080 - protein, 60 aa, Artificial Sequence
  Synthetic sequence.
SEEEKLDRLLEELKKVAEEVNRENEKLLEDLERVVRDLNEKNKAALKKLEDAVRRLKEAI

SEQ ID NO: 9081 - protein, 56 aa, Artificial Sequence
  Synthetic sequence.
VDRVEERLREIIKTLRKLLEDSKESVRKIIEELKRLVDRSIEDLERIIKELEDKVR

SEQ ID NO: 9082 - protein, 60 aa, Artificial Sequence
  Synthetic sequence.
DRERRIETVLRKLKKVVEEVNRRNEKLLDDLRKVVTRLLEEDRRLLEKLRRAAERLKEEL

SEQ ID NO: 9083 - protein, 56 aa, Artificial Sequence
  Synthetic sequence.
VTRVKEKIEKIIEELKKLLKDSKKRVEEIIRELEKLVDDSRREVEEIIKELKDRSR

SEQ ID NO: 9084 - protein, 60 aa, Artificial Sequence
  Synthetic sequence.
DMREELERILKTLRDVSRESRRELKRLLDENEKTIREVKKRVDEILEKLRKVIDDVRRQG

SEQ ID NO: 9085 - protein, 59 aa, Artificial Sequence
  Synthetic sequence.
KKVVDEVDKEIRELIRKDEEIVKEVAERVKKNSEDLRRLLEKARREIEEIIKELEERRR

SEQ ID NO: 9086 - protein, 60 aa, Artificial Sequence
  Synthetic sequence.
DEDEIVRDVIRRLDEVLKKLEKTNTELDEELKRVVEELRKVNRTVDEELKRVLDELAKRI

SEQ ID NO: 9087 - protein, 55 aa, Artificial Sequence
  Synthetic sequence.
DKLVKDLKRVLDKLEESSRRMLKKLSDALRELEKSSDKVVKDLRKVLKELREEVK

SEQ ID NO: 9088 - protein, 60 aa, Artificial Sequence
  Synthetic sequence.
DEDERVEELLRELEEVLDRLAKLNKKLDERNKEVAEESKRLNETVDRELKEVLKRLEEKL

SEQ ID NO: 9089 - protein, 55 aa, Artificial Sequence
  Synthetic sequence.
SELVERIRRELERLKRSSEEVVKKLTEELKKDKKSSEEVVKDLRRALRELERAVD

SEQ ID NO: 9090 - protein, 60 aa, Artificial Sequence
  Synthetic sequence.
SELEKVKEDIRRLLKRLKEDIKRIKDEIDRLLEELKRHLKEVEEEVDRILEELKDLKRRG

SEQ ID NO: 9091 - protein, 55 aa, Artificial Sequence
  Synthetic sequence.
EKLERVKEDVERVLEEYRKRSEDLARRVEKVLREYKKRSDELEKRVEDVIKEVAD

SEQ ID NO: 9092 - protein, 60 aa, Artificial Sequence
  Synthetic sequence.
KELEEVARKIDEELKKLDKNIRDIADEIRRILEELEKDLREIEKRIRDILRRLEDLKRRG

SEQ ID NO: 9093 - protein, 55 aa, Artificial Sequence
  Synthetic sequence.
DELKTVEDKVRKALREYEEKTRKVKKDVDEVIKKYKTDSDRVLDEVEKALREVER

SEQ ID NO: 9094 - protein, 59 aa, Artificial Sequence
  Synthetic sequence.
RVEEKLKRVSDELKRAVDESNKKIEELLERLKRVHDETNKEITEILRELKEVVDKARED

SEQ ID NO: 9095 - protein, 59 aa, Artificial Sequence
  Synthetic sequence.
DELVEDIERKIEELIRRDDDLVRRAEEEVEKSIRELRRLVDEVRKEIKKIVKKIEDDVR

SEQ ID NO: 9096 - protein, 60 aa, Artificial Sequence
  Synthetic sequence.
SREDKARELLRELEKVDDDHRRRVRELLERLKKVLEDHRRAVKDIIKRLDDELKRIKEED

SEQ ID NO: 9097 - protein, 55 aa, Artificial Sequence
  Synthetic sequence.
EEVAKEVKDIVREVEDHLRRVEEEVRRIIREVEEHIRDLERRVRELLEELKRRSK

SEQ ID NO: 9098 - protein, 60 aa, Artificial Sequence
  Synthetic sequence.
SEEEKVRRLKEELRRVIEKHKKDVKEIEDRLREVDDRHRREVKKLIEELKKVLEDAKRRK

SEQ ID NO: 9099 - protein, 55 aa, Artificial Sequence
  Synthetic sequence.
EEVAKRVKEIIEKVERHITEVKKRAEELVEEVERHIRELKKRVEDLVEEIERDTK

SEQ ID NO: 9100 - protein, 61 aa, Artificial Sequence
  Synthetic sequence.
DEKETAEELLRRIEKVIKRLEDTMRKLNKKLKEAIERHHRTAKKLLDDIERVIREVEKDRG

SEQ ID NO: 9101 - protein, 56 aa, Artificial Sequence
  Synthetic sequence.
REELEDDVRRIIEEIDRLLRESEEDHEDLIRRLKRSLEELKRLAEDIIRKLSEDRK

SEQ ID NO: 9102 - protein, 61 aa, Artificial Sequence
  Synthetic sequence.
REKEAAKRILDRIEKVIRDHHREAKRLNDELEKVIREHHETVKELLKRIKEVIDKFKKDKG

SEQ ID NO: 9103 - protein, 56 aa, Artificial Sequence
  Synthetic sequence.
VEELEETARRIIEKLKKSLEDSKRDHERLKKEIEDSLKRLTELVKKIIEEIERDRK

SEQ ID NO: 9104 - protein, 61 aa, Artificial Sequence
  Synthetic sequence.
DEDEEARRLLEEIRKVIEEAEEEAKRLNERLRRVIKEHHRKVKELLDEIERVIEKVLRARG

SEQ ID NO: 9105 - protein, 56 aa, Artificial Sequence
  Synthetic sequence.
VDELRERVREIKEKLRKDLKDSEDDHRRMEEEIKKSLERLERLVREIIKDLEEKLR

SEQ ID NO: 9106 - protein, 61 aa, Artificial Sequence
  Synthetic sequence.
KDEERAKRLLDEIERVIRRHHKTARDLNRELERVLKEHHDTARKLLEDIKKAIDDLKRTRG

SEQ ID NO: 9107 - protein, 56 aa, Artificial Sequence
  Synthetic sequence.
AKELEDKVKEIIDRIEKSLEESDKNHKKLIRELEKSLDDLRREAKEIIDDAREKAK

SEQ ID NO: 9108 - protein, 60 aa, Artificial Sequence
  Synthetic sequence.
SAAERAEEVLRKLRESLERHKKVNKDLLEEIERSLREVAKDVDRVLKDIKRVLDELKRRR

SEQ ID NO: 9109 - protein, 55 aa, Artificial Sequence
  Synthetic sequence.
DEVEELVRRVHRENEKFSKESEDLVREVHERNKELVKRIRKILEDATRELEKAAK

SEQ ID NO: 9110 - protein, 60 aa, Artificial Sequence
  Synthetic sequence.
DMKEEAEEVLKEIEEVLKEHRDINRRLLEEIKKSLEDLSREVERVLDEIRRLLKRAVEER

SEQ ID NO: 9111 - protein, 55 aa, Artificial Sequence
  Synthetic sequence.
EEVRKIVEDLKKRLKELSEKSERIVRKVHRDNERVVREIRDIVRRLKKRLEDATR

SEQ ID NO: 9112 - protein, 60 aa, Artificial Sequence
  Synthetic sequence.
SAKEKVDEVLRRIKELLDRHKKVNEEILEEIRRSLEEHREVNERLLETIDRLLKELKRSR

SEQ ID NO: 9113 - protein, 55 aa, Artificial Sequence
  Synthetic sequence.
EEVEEIMRRAEEELRKLSKESRELVKRLHERNEEMSRRSKKIVDEAKKELEDAER

SEQ ID NO: 9114 - protein, 60 aa, Artificial Sequence
  Synthetic sequence.
SAEEELDRLEKELDKLLKEHHEENKRLLEEIDRVLKEHEETLRRLIKELREVLKEVKEKL

SEQ ID NO: 9115 - protein, 56 aa, Artificial Sequence
  Synthetic sequence.
VEKLREDVERVKRELEDLTRKSEELVKRLKDTLRRVSEELKRRVDEAKKEAREVER

SEQ ID NO: 9116 - protein, 60 aa, Artificial Sequence
  Synthetic sequence.
SAEEELKRLLEENERVTEEHHKRNRDLLRRIDEALRRHEKTLEDLIRELDRVLRELERRL

SEQ ID NO: 9117 - protein, 56 aa, Artificial Sequence
  Synthetic sequence.
VDDLRRIIEESRRRHEELTKESEKLVREVEDILRRLSEELAELVKRVKDKLDEDAK

SEQ ID NO: 9118 - protein, 60 aa, Artificial Sequence
  Synthetic sequence.
SAEETLKRLAERIRKLLEEHRETVKRVIDRLDKVLRDHHRENKRLLEDIDRVLRRLEESL

SEQ ID NO: 9119 - protein, 56 aa, Artificial Sequence
  Synthetic sequence.
VEDLDRRVKEVERRLREMSKTIEKLVKDIERELKEASEESRELVERMKRELTEAEK

SEQ ID NO: 9120 - protein, 60 aa, Artificial Sequence
  Synthetic sequence.
REIEEILKEIEKSLRDLEEEVRRILEEIKKSLEDLRESMERIVEEVDRRLRTLKEVFDRG

SEQ ID NO: 9121 - protein, 59 aa, Artificial Sequence
  Synthetic sequence.
DRVRRIIEKLEEDLRRVNKKIKETLEEAAKRLEDADREIEKILRDLARKIRKVLEEIKK

SEQ ID NO: 9122 - protein, 60 aa, Artificial Sequence
  Synthetic sequence.
SEVEEIERRIEKSLKELRERLEEAEKRHEELLERLEREIDRIEKELRKDLKRLRDMTRRG

SEQ ID NO: 9123 - protein, 59 aa, Artificial Sequence
  Synthetic sequence.
ERVKKEIDRLEKRLEEVNEEIKKRLKELAERSRRVLERIKDRIRRAAEELKRVLDEVRT

SEQ ID NO: 9124 - protein, 60 aa, Artificial Sequence
  Synthetic sequence.
SEIEEILKRLKELLKELKERNEDILRRVEKSLKDLRKKLEEIVRDLRRLLEELREMVKRG

SEQ ID NO: 9125 - protein, 59 aa, Artificial Sequence
  Synthetic sequence.
DRVREIIKTAEKELEKALRTSEDIDRRLEERLEKVNKEIREELRRAEEEIKRVLEEVKR

SEQ ID NO: 9126 - protein, 60 aa, Artificial Sequence
  Synthetic sequence.
DELDRIRKEVKRISDKNRRHVERLDEEVRKLLEELRKHLEDLTREVERLLRELKEVKKEG

SEQ ID NO: 9127 - protein, 59 aa, Artificial Sequence
  Synthetic sequence.
EEMRTKVEELRKRLEESLEEHKRAADELRKRLKKVLEEHEKRVRELEEELRRVLKEAED

SEQ ID NO: 9128 - protein, 60 aa, Artificial Sequence
  Synthetic sequence.
DELEELRKLVEEISRENREHLKKLKKLVEDLSRENEKHLRDVDKRVKELLEDLERLTRRG

SEQ ID NO: 9129 - protein, 59 aa, Artificial Sequence
  Synthetic sequence.
EDVERELRRLKKELDKSLKEHRTTLERLEEELRKSNKEHRDRVKELREELEKVLRDAKR

SEQ ID NO: 9130 - protein, 59 aa, Artificial Sequence
  Synthetic sequence.
SMLDEARKEVKELKDRVERASEKLEDNARRNVEKLERVSEELEREVKRLLDEIEEVKRR

SEQ ID NO: 9131 - protein, 56 aa, Artificial Sequence
  Synthetic sequence.
EETLKELERRIREVLKKHDKTLRDLERRIREVNKRHKDVSDRLAERIKKVIRELER

SEQ ID NO: 9132 - protein, 59 aa, Artificial Sequence
  Synthetic sequence.
DKEKELEREVDELLKRLEEHSKRVDKTVEDVHRRNEEALRDMERKVREVVEKLKEVKER

SEQ ID NO: 9133 - protein, 55 aa, Artificial Sequence
  Synthetic sequence.
EEVDRLRRELREVLKRNRESVERAEEKLKKSVKELDERVKELEEELDRALDELRK

SEQ ID NO: 9134 - protein, 60 aa, Artificial Sequence
  Synthetic sequence.
SEVEKLERDVRELHKDNKRHSDELDREVKKLLEELRRALEELKEKVERLTRRLEEVKRRT

SEQ ID NO: 9135 - protein, 55 aa, Artificial Sequence
  Synthetic sequence.
KEVEELKRRIDRSVEENEDSIRRLKEEIKRIVDEVRRVVEKLIKEIKDAVKKLRD

SEQ ID NO: 9136 - protein, 59 aa, Artificial Sequence
  Synthetic sequence.
DELEELKRRVEELEERNKDHSRKMRETVERVKERLDRHSKEMEKEVRKVVEDIKDVKRK

SEQ ID NO: 9137 - protein, 55 aa, Artificial Sequence
  Synthetic sequence.
REVDELKKEIERADKENKDSIEELERELDRVLKENEKSIRELEKELDDVLDEADK

SEQ ID NO: 9138 - protein, 57 aa, Artificial Sequence
  Synthetic sequence.
SEAEKLLEENRRELEKVKRDAERLNDEIRERLKEIEDKLKTLNDEIRKLVKEMEDRN

SEQ ID NO: 9139 - protein, 56 aa, Artificial Sequence
  Synthetic sequence.
EEILRTIADDNRRVLEEIKKIIKHSRDELERVKRDIDRIVKHSVKLLEDVLRRLRK

SEQ ID NO: 9140 - protein, 60 aa, Artificial Sequence
  Synthetic sequence.
DEEEIVKRIEDDARRIIEEVKEVLRRIRDLNERILREAEEVLKEIREINRKVLEDLRRDG

SEQ ID NO: 9141 - protein, 55 aa, Artificial Sequence
  Synthetic sequence.
ERVLKRLRDELDKLREDLERILRRNKKLLDELRELLERSRRENEKLVEELKRKAK

SEQ ID NO: 9142 - protein, 59 aa, Artificial Sequence
  Synthetic sequence.
SEAERIEEEVKKLLKDVKKKLEELKESSKRVVEELDKVLKELKESSDRLAKEIKKALDD

SEQ ID NO: 9143 - protein, 56 aa, Artificial Sequence
  Synthetic sequence.
KDVLEKLRELVKRLIDDLRRVVEELEETNERLDRKLEDVLKKLRETNEKTLRELRK

SEQ ID NO: 9144 - protein, 59 aa, Artificial Sequence
  Synthetic sequence.
SVREDLKRVVEDIRRIVKEVHERNREASKRSEDLVREVHERNERIARELKKIVDDLRRV

SEQ ID NO: 9145 - protein, 56 aa, Artificial Sequence
  Synthetic sequence.
RRVLEEVRKEVEKVLREIEKSLRDHERENKRLLEDIERSLRELEKTVEKLKRDIRR

SEQ ID NO: 9146 - protein, 59 aa, Artificial Sequence
  Synthetic sequence.
SAREALKEAVKEIERIVREVHDRNRRASERSEKIVRDVHRRNKKLTDESKDLVDKARRI

SEQ ID NO: 9147 - protein, 56 aa, Artificial Sequence
  Synthetic sequence.
KRVLEEVAKRVEEVLKRIKDSLEEHRRVNDKLLKDIEKSLRDHERANEKLLEDLRK

SEQ ID NO: 9148 - protein, 57 aa, Artificial Sequence
  Synthetic sequence.
DELEELLKRIEDVIRRVEELLDELLERHRKVSKESNERLEELLRRHEKVSEEVKREN

SEQ ID NO: 9149 - protein, 59 aa, Artificial Sequence
  Synthetic sequence.
EEVEKRVREVLKEIEDRAREVEKRARDSVRRNREELERLERDVRRSLKKLRDDLERMRR

SEQ ID NO: 9150 - protein, 61 aa, Artificial Sequence
  Synthetic sequence.
SKVEKLLEDIKKLVKEVSDKIEELLKRLHEVVREIAKAVRDLIRENKRVVDDIVKKVRERG

SEQ ID NO: 9151 - protein, 59 aa, Artificial Sequence
  Synthetic sequence.
KEAEDDARRIIEEIERLLREVKKYIEEHIKRLRTVLKKLAEDSKKHLDELRELLRRLEK

SEQ ID NO: 9152 - protein, 61 aa, Artificial Sequence
  Synthetic sequence.
SELETLLTDVERLLDESRRVAERVLKEVKELLDEWEKRHKELADRIRELLRRVEEEMKRAN

SEQ ID NO: 9153 - protein, 60 aa, Artificial Sequence
  Synthetic sequence.
DEEVRREATDLRREIKEHTDEVEKKLEELAREIEELLERSERSAEELRKEIEKLLEEIRR

SEQ ID NO: 9154 - protein, 60 aa, Artificial Sequence
  Synthetic sequence.
SEIEKLLEDFKKRIEDIKRRLERYLEEVRKRVEKVKRELERALEESKRTVDEVKKEIDRA

SEQ ID NO: 9155 - protein, 55 aa, Artificial Sequence
  Synthetic sequence.
DEVRKEIRKLLDDIRRVVEKVKRDNERLNRDLNRRVREVIRESEKLNKRLEEAVR

SEQ ID NO: 9156 - protein, 58 aa, Artificial Sequence
  Synthetic sequence.
SESETLEKELKELKEEADKLIEDIRRRLEEVARRVERNVTESERTLEELLRRAREKKK

SEQ ID NO: 9157 - protein, 55 aa, Artificial Sequence
  Synthetic sequence.
RRVKEEVKRVLEEIERALRTVLKEVRDLLKRLEELHREVLDKNRRVLKAISDEAK

SEQ ID NO: 9158 - protein, 60 aa, Artificial Sequence
  Synthetic sequence.
SEDEKVKKDLDELRDRVRKNIERIRRKLKKLLDEARDNVRRSEETLRRLARRVEKIKKDK

SEQ ID NO: 9159 - protein, 55 aa, Artificial Sequence
  Synthetic sequence.
RSVKEELRRVLEDLKRLHEEVSKRVEDALREMKELHDRVLKRNKDVLRELKERAQ

SEQ ID NO: 9160 - protein, 60 aa, Artificial Sequence
  Synthetic sequence.
SLEEIVKDILRRIKTKADEIKEKVDRSLREIEELVKEIKKEVDDSLRDIERVAEELRREG

SEQ ID NO: 9161 - protein, 55 aa, Artificial Sequence
  Synthetic sequence.
ERLLRDVRRILEELRDLVRRLHEDNKRLDEDLNRKVEKLKRDNEDLNKKMRDRAE

SEQ ID NO: 9162 - protein, 60 aa, Artificial Sequence
  Synthetic sequence.
SEKEEADKKLKKVMDDLREILRRLLETLKRVIERSEEVLKRLDDRNREVLEEIKRAIERL

SEQ ID NO: 9163 - protein, 56 aa, Artificial Sequence
  Synthetic sequence.
EKEAEETVRRMKELVDRIRKKAEEDVKKLREDSKRTADRSKKNVEDLKRRLDELAK

SEQ ID NO: 9164 - protein, 59 aa, Artificial Sequence
  Synthetic sequence.
SEIEELVRRLERKLEEHKKMVDKYREDLKRTLDRVNELSKDYIKKLRDILEKAERLVRR

SEQ ID NO: 9165 - protein, 55 aa, Artificial Sequence
  Synthetic sequence.
EDLRRIAERVLREAHRTAKDLHRDSERVREEIKKSVDRVHEESERVLREIRKLKK

SEQ ID NO: 9166 - protein, 60 aa, Artificial Sequence
  Synthetic sequence.
SIEEEVRKIVDDIRRSSEELEKSVKRVVEEIAESSKEEKDRVKRNIEEIRKEIDKLRRDG

SEQ ID NO: 9167 - protein, 59 aa, Artificial Sequence
  Synthetic sequence.
KDVLEKLKRLLDKVVRDSEDVIRKLEERLKKVVDESKEVLKELEELHERVMREVEETIR

SEQ ID NO: 9168 - protein, 60 aa, Artificial Sequence
  Synthetic sequence.
KIEEDIRRELTKILDKLRKLLEKAKKNVEDIERSSRDLKRRVDETIEKIKDELRKLERDG

SEQ ID NO: 9169 - protein, 59 aa, Artificial Sequence
  Synthetic sequence.
EEVLERAERELRRVMKEVEKVLREIEELHRRVAETSKRVIDELRRLLEKVFKEFEDAVR

SEQ ID NO: 9170 - protein, 61 aa, Artificial Sequence
  Synthetic sequence.
SEVDEDLKRLEDRVREYEDRVREDIRRLEEDLKRLRKRIEDSIEEMRRTLEEVKEDVRREG

SEQ ID NO: 9171 - protein, 59 aa, Artificial Sequence
  Synthetic sequence.
RDRLTKLREVLERLEKRIREIDEEIKRVLERVEKEIRDALRKIEKVNEDVEKALRDILR

SEQ ID NO: 9172 - protein, 59 aa, Artificial Sequence
  Synthetic sequence.
SLEEEIEKVIRKLKEVVERINERNKRALDKLRKVVEEVKDALRRTNEELKKVVKEVERR

SEQ ID NO: 9173 - protein, 59 aa, Artificial Sequence
  Synthetic sequence.
KDDVRRLKREIEELIKRIDDKIRKLIRRHEELVREIREELKKHEERVKDVLRKLEKLAE

SEQ ID NO: 9174 - protein, 57 aa, Artificial Sequence
  Synthetic sequence.
SEVEKLKKEADEESERNKDEVRKLEKESKENADRIRRHLEEHLKRSDENVKRVKDAK

SEQ ID NO: 9175 - protein, 55 aa, Artificial Sequence
  Synthetic sequence.
EEMLRRLEELLRENKKRNKEVLDRDRELLRELDEEVDDVLRRDKELLEELERRLK

SEQ ID NO: 9176 - protein, 61 aa, Artificial Sequence
  Synthetic sequence.
SEVDEVLERIERLADDNRRKAETVLRKIARLLEELKKHSEDVNRKIKELVKELEDEVRRAG

SEQ ID NO: 9177 - protein, 59 aa, Artificial Sequence
  Synthetic sequence.
RELLERVLRRVEKKSEDHKRKLEEAERRVDKNREDHERRNEELLRRVEERVEDVKRRIK

SEQ ID NO: 9178 - protein, 60 aa, Artificial Sequence
  Synthetic sequence.
DEVKEVLKRIKDLLDELRRHSEKVNRDVERLLEELARNSEKVNREIRRLLDDLRRLVEEK

SEQ ID NO: 9179 - protein, 59 aa, Artificial Sequence
  Synthetic sequence.
RDDLERILREVDKKIKDLKRENERMLEEVERNAKEHKDRDREELKRVKEDLDRLRERLR

SEQ ID NO: 9180 - protein, 58 aa, Artificial Sequence
  Synthetic sequence.
KDAEELEKEVERESRKNEESIRRIREEVDKLSKDNDRKLKEIEKEVEDLRRRVDERRK

SEQ ID NO: 9181 - protein, 55 aa, Artificial Sequence
  Synthetic sequence.
EKLLDKIRKVVKENEERMDKLLEDIERVVRENIKKNKEVLERARRVIERLEEKIK

SEQ ID NO: 9182 - protein, 58 aa, Artificial Sequence
  Synthetic sequence.
DEDKKLEKDVRDKSEDNKRRLEEIKKKVEDASRENERKIEEIKRRVEEKAEEVDRARK

SEQ ID NO: 9183 - protein, 55 aa, Artificial Sequence
  Synthetic sequence.
EELLKTATELVTRNRTENERVLREAERVVKENLRRMDELLKDIRRVIEELERRIK

SEQ ID NO: 9184 - protein, 56 aa, Artificial Sequence
  Synthetic sequence.
EEVERSLKKLEDDIRRIERELEEMVRKSKREIDKLVRDLEEMLKDSRRKLEKLRKD

SEQ ID NO: 9185 - protein, 56 aa, Artificial Sequence
  Synthetic sequence.
EEAIRELERLLEELLRKIEEVIKDLRRLNKELDEEIKRVIDEARRLNKELEDDLRR

SEQ ID NO: 9186 - protein, 60 aa, Artificial Sequence
  Synthetic sequence.
SKVEKILKDIKRLLDELRKKLKEVKDRLDEINEELRETLKRSLDRNRKINEELKDKLRRR

SEQ ID NO: 9187 - protein, 55 aa, Artificial Sequence
  Synthetic sequence.
DEVLKRVEEEIRRLEEELDRTLERSKREVEKIKREIERTNRESERAVKEIDDRER

SEQ ID NO: 9188 - protein, 61 aa, Artificial Sequence
  Synthetic sequence.
SKDEEVLKTLRRILEELRDVHRRNLEDNKRITDRLREIHERNLRDNRRITKELEEVARRDG

SEQ ID NO: 9189 - protein, 55 aa, Artificial Sequence
  Synthetic sequence.
DEKREEVKKEVDETRERNERKNRRSREDVKRVEDRNRDANRKSRKEAEDVKRRLT

SEQ ID NO: 9190 - protein, 61 aa, Artificial Sequence
  Synthetic sequence.
SKVEEVLKRLREILKELEEVHKENKDDVKRILRDLEKTHKDNLDDNRRITEKLKRVVERDG

SEQ ID NO: 9191 - protein, 55 aa, Artificial Sequence
  Synthetic sequence.
DEEREKVERRAKEARDRNKRKNERVKEEVKRVKDRNKKKNDESKETVRKIEEDAT

SEQ ID NO: 9192 - protein, 57 aa, Artificial Sequence
  Synthetic sequence.
SDSERILKDIEDKLREIKKRSDDNRRRLEKENREVEKRVREILRRIEEENKDVERED

SEQ ID NO: 9193 - protein, 55 aa, Artificial Sequence
  Synthetic sequence.
EKVKRDLEEALKTLRKVAEDNKKSLRESLETVKKLLEDLERELRKSAESVRRKMK

SEQ ID NO: 9194 - protein, 57 aa, Artificial Sequence
  Synthetic sequence.
SESEELLKRAEDEVRKVEKKSRDNERRLREKLKKAKEDLDRIDEDIKRLNKELEDRN

SEQ ID NO: 9195 - protein, 55 aa, Artificial Sequence
  Synthetic sequence.
ERLRRELERILEELRELVRRNEEELKKIMKRVREEVEKLLRKLEKSLESVDRKVT

SEQ ID NO: 9196 - protein, 60 aa, Artificial Sequence
  Synthetic sequence.
SRDEKAERMVREVEKKIKELIDRNRRVTEKVKEDIKRLIEDLERVTRDVSRAIKELARRL

SEQ ID NO: 9197 - protein, 55 aa, Artificial Sequence
  Synthetic sequence.
EEDDKRIEEDLRKLEEDSRRYDEDLKRELERLRKEVEEYKKRMREELRRLKEEAD

SEQ ID NO: 9198 - protein, 60 aa, Artificial Sequence
  Synthetic sequence.
SELERATKVVKRVADRIAELIRENARVTKRVADESRKLLEETETVTREVMRAIEELLKRL

SEQ ID NO: 9199 - protein, 55 aa, Artificial Sequence
  Synthetic sequence.
EEDLKKLEDDLKRAADESKKYDDDLRRKLDELRRRHEEYKERLKEMLKRLEDETR

SEQ ID NO: 9200 - protein, 60 aa, Artificial Sequence
  Synthetic sequence.
SELEDARRVVKRVADRIKRLIEENERVTKEVKEASEKLLKDTKDATRRLAKEVKELVKRL

SEQ ID NO: 9201 - protein, 55 aa, Artificial Sequence
  Synthetic sequence.
EKDKKRLEEELERLRESSERYDERLKRELERLEEEHRRYIRRLKEELDKLREDTD

SEQ ID NO: 9202 - protein, 60 aa, Artificial Sequence
  Synthetic sequence.
SEVEELIKDIRRHNTRLEKRMREILEDLKRHLKRSEDKMRKLVKELKELLDRLRDIARDG

SEQ ID NO: 9203 - protein, 59 aa, Artificial Sequence
  Synthetic sequence.
EKLLKELEDVIRENEKRSRDIARTLEKALEELRKASKELIDTARDILRKVLEDVDRLRQ

SEQ ID NO: 9204 - protein, 57 aa, Artificial Sequence
  Synthetic sequence.
SEVETSAERLKREVEKHHKEVEEYIRRLEEELKKMTRDVERALEKIKEDVDRLRKEQ

SEQ ID NO: 9205 - protein, 59 aa, Artificial Sequence
  Synthetic sequence.
EELLKRLRDVLEEVSRRIKDNLEELKKVSERLKRRIEELIRRLEKVMRDVRRSAEEIKR

SEQ ID NO: 9206 - protein, 57 aa, Artificial Sequence
  Synthetic sequence.
KEVEEDIERLKRILEKHHKDIERAIRRLEEKLKRLEDKLRKYKRDLEEEVARLKDEQ

SEQ ID NO: 9207 - protein, 59 aa, Artificial Sequence
  Synthetic sequence.
EKVLRRLKEVLREIEERIRRNKEELDKALERVKRTIERLIRELEKLSERLKRIADEIAR

SEQ ID NO: 9208 - protein, 57 aa, Artificial Sequence
  Synthetic sequence.
DEVDEIVRRLRETVDRHHKRIKEAIEKLKEEVKKHHREIEEYIRRLEEEVKRLADEQ

SEQ ID NO: 9209 - protein, 59 aa, Artificial Sequence
  Synthetic sequence.
RKLLEKLDRVLKKLEEDIRRNKEALDRALREAEKSLTDNIKELRDVSREIAERIKEITR

SEQ ID NO: 9210 - protein, 60 aa, Artificial Sequence
  Synthetic sequence.
DEKEKVIEDIKELLKELEKKLEDIIREIEKELKRNDEENEESRRRIEDMLRRLEELKRRS

SEQ ID NO: 9211 - protein, 55 aa, Artificial Sequence
  Synthetic sequence.
EDVDRVLREAERRVREILKELEEVLRRAEERSEENLRSAEKVLREVEKRLKELTD

SEQ ID NO: 9212 - protein, 60 aa, Artificial Sequence
  Synthetic sequence.
SEEERIIKRIKETLEDLKRKLDRIREEIERDIRRNNKKNEDSIRDIERMLRELRRLFEES

SEQ ID NO: 9213 - protein, 55 aa, Artificial Sequence
  Synthetic sequence.
KELKEVLEEAKKTVDKILRDLEELLRRAEEESRRNLREAEEVLKKVREDLERLAT

SEQ ID NO: 9214 - protein, 60 aa, Artificial Sequence
  Synthetic sequence.
SEEEEVIKEIKDALRDLRRRAEELMKELRELIRENNERNKESEREIRRLLDRLRDLKRRS

SEQ ID NO: 9215 - protein, 55 aa, Artificial Sequence
  Synthetic sequence.
EEVKRVLDDAKRAVEEILARIKELLDEVRKASKENLERAEELLRDVERELDRLTK

SEQ ID NO: 9216 - protein, 56 aa, Artificial Sequence
  Synthetic sequence.
SEVERLIEDIRRANEELNRKSERKSRESKKENDRLNRESDKKSRDSERVLEELRRR

SEQ ID NO: 9217 - protein, 59 aa, Artificial Sequence
  Synthetic sequence.
EELVRRLDELLKESETNVRDNKRRVRDNLRRTEENARRNLEKVKKNVRKIDKVIKEIET

SEQ ID NO: 9218 - protein, 56 aa, Artificial Sequence
  Synthetic sequence.
SEVDETARKLDEDLKRLEEEVRRTSKESEDENRKLNETSKRESDESKRRLDELRRK

SEQ ID NO: 9219 - protein, 59 aa, Artificial Sequence
  Synthetic sequence.
ERVLRKLKDLVEKVKRVIEKLVKELEDNVKKTKDNARRNKREIEENARRIREEIKKLED

SEQ ID NO: 9220 - protein, 56 aa, Artificial Sequence
  Synthetic sequence.
SEVEKEADEVRRTNEELNRRSEETSRRSEEDLRRLEEKVRRASKKSEDDLRRLKRE

SEQ ID NO: 9221 - protein, 59 aa, Artificial Sequence
  Synthetic sequence.
EEMVKRLRDVVKRSRENIEENKRRIEDNLRRIDEVIRRLIEELRRNMRRIEEEIERIRR

SEQ ID NO: 9222 - protein, 59 aa, Artificial Sequence
  Synthetic sequence.
SEVEREIERLEEDLDRLRREVDEAHKRSKKKLEELRKEVEDYEERVKEELRRLEKLVRE

SEQ ID NO: 9223 - protein, 59 aa, Artificial Sequence
  Synthetic sequence.
EEVRERLERALRKAEKDVKRLEDELKRSLKEVRETVRELEERLREVNERVEELLDRLRK

SEQ ID NO: 9224 - protein, 62 aa, Artificial Sequence
  Synthetic sequence.
RVEDRVRDLIRKHDETSREIEKRIRDSIKRLADVLDKIRKAIDDLIRKLREAVEDLLRKIGK

SEQ ID NO: 9225 - protein, 59 aa, Artificial Sequence
  Synthetic sequence.
EKEVEDLARKIEKLNEDLRRRLEKLDKENKDVIRRLEDALRRLAEEIKRLIDELRERAR

SEQ ID NO: 9226 - protein, 56 aa, Artificial Sequence
  Synthetic sequence.
KDEDRLRDDIRRAIEEIEEKLKRLKDRNKEHIERLKKRNEDLNRRNRDVVRRLRER

SEQ ID NO: 9227 - protein, 55 aa, Artificial Sequence
  Synthetic sequence.
EELEKLREDLRRVIERVEREIRRSSEENRRVVKKSVDNIRDSLRKNEDVIRKLRK

SEQ ID NO: 9228 - protein, 59 aa, Artificial Sequence
  Synthetic sequence.
DVEKKIKDLARELREVIDDARRKNRKLHEDAREVSERHEKAVRDLTEELKRVIDELRKR

SEQ ID NO: 9229 - protein, 59 aa, Artificial Sequence
  Synthetic sequence.
EDMLREVEKRVKEEIKRIKDDLDEVRKRHEKKVRDIRKHLKELEDRIKKTEKDLREEAR

SEQ ID NO: 9230 - protein, 59 aa, Artificial Sequence
  Synthetic sequence.
RVEEEIERLSRDLKRVIEKAKRDNDRLHKEVRKASEDHKRENKRLHEDVKRVIEELRKR

SEQ ID NO: 9231 - protein, 59 aa, Artificial Sequence
  Synthetic sequence.
ERMLKKLEDEIEETKKDIEREIREIDKRHKDAVKELRDHIRELAREHEEEKKRLEETAR

SEQ ID NO: 9232 - protein, 59 aa, Artificial Sequence
  Synthetic sequence.
RVEEEIRRLLEESERVHKELEDINRRLHEKVDRVSKKHREENKRLHEKLKRAIDRLREK

SEQ ID NO: 9233 - protein, 59 aa, Artificial Sequence
  Synthetic sequence.
EEALKKLEKEVKDNERKLREEARRVEEEHEKTVRDLKKHLDELREEHDRILEELERTRK

SEQ ID NO: 9234 - protein, 60 aa, Artificial Sequence
  Synthetic sequence.
SDMEKRKRDIKRKLDESNKKSEEAVREVERKLDESNKEVKKKEERVEDELRKLEEKRRRG

SEQ ID NO: 9235 - protein, 55 aa, Artificial Sequence
  Synthetic sequence.
EKLKDIERELRENLKRNEDIVREILKKLEDNLRRVEKLAEDIRRKLEKVADDLRK

SEQ ID NO: 9236 - protein, 56 aa, Artificial Sequence
  Synthetic sequence.
SELEEDKKRIEETLRRLEETAKEYHRRSREELRRLEEEAKRYHEESKETLDRLRRE

SEQ ID NO: 9237 - protein, 55 aa, Artificial Sequence
  Synthetic sequence.
KKLKDIKEEVERVMKKLEDLVRRDNEESEKVLEKLKRLVERNNEDIKRALEELRK

SEQ ID NO: 9238 - protein, 56 aa, Artificial Sequence
  Synthetic sequence.
SEDEERLRRIEEELRRLEEEAREYHERSREELKKLREKAKEYHERSRRELEELRRR

SEQ ID NO: 9239 - protein, 55 aa, Artificial Sequence
  Synthetic sequence.
KRLKEITRKVEEVMKKLEKLVRDNNEEIRKVMEELKKLVEDDNEESDRALKELET

SEQ ID NO: 9240 - protein, 56 aa, Artificial Sequence
  Synthetic sequence.
DEMETRLEDVRKKLDDSRRETRKVEEDIRRTLEELRREAKKYHEDSKEELDDLRRR

SEQ ID NO: 9241 - protein, 55 aa, Artificial Sequence
  Synthetic sequence.
EKLKEIKERIEKVLRENRDVVKKIKEDVRRALKELEELVRKNNEDIKRLLDELRR

SEQ ID NO: 9242 - protein, 56 aa, Artificial Sequence
  Synthetic sequence.
SRVEEVERRVRDKSRKSKEKLRKLEEDVRRESETSRDRLRKLAEEVKTKVKELKDK

SEQ ID NO: 9243 - protein, 56 aa, Artificial Sequence
  Synthetic sequence.
SEDLKRLAKEIEDNLEELERKIREIRKELRRSLEEVEKTVEDLKRELKKVLDELRK

SEQ ID NO: 9244 - protein, 60 aa, Artificial Sequence
  Synthetic sequence.
SDIEEAKERLERKLEKLLRKVEEYLKEIADEIRRLEEELEEYNRRSKERIDRVLEVKERG

SEQ ID NO: 9245 - protein, 56 aa, Artificial Sequence
  Synthetic sequence.
ESVLKELEELLKELEDRIRKILTESTELLRRLEKRVRDSLRRNTEELDELLDRLEK

SEQ ID NO: 9246 - protein, 59 aa, Artificial Sequence
  Synthetic sequence.
SEVEKSEKKLRDEIERLVRENEKYLERIKELVEELLRELEKAVRELEKEVTEIEEVKRQ

SEQ ID NO: 9247 - protein, 56 aa, Artificial Sequence
  Synthetic sequence.
ERVLKKLRDLVKEVVDRSKRSLDESTKVLDTLEKEVRKVLEALKDILREALERLDK

SEQ ID NO: 9248 - protein, 60 aa, Artificial Sequence
  Synthetic sequence.
SREEIIKKLKEEVERLLRESAKVLEELKRRLEALLRESEEILRELRELVRTLLEKLERDG

SEQ ID NO: 9249 - protein, 59 aa, Artificial Sequence
  Synthetic sequence.
EKDLKKTEDDLKREADEHRKAVEDELRKVKKRLEEHRERVRKRLEDIEKTLRDIDREVR

SEQ ID NO: 9250 - protein, 60 aa, Artificial Sequence
  Synthetic sequence.
SSVEDLLRKAEEVVRRAEEKSRDSHEKTKDVLRKVKRKSEELNKHNRESIKKVEEVRRRT

SEQ ID NO: 9251 - protein, 55 aa, Artificial Sequence
  Synthetic sequence.
EEVLKTIEDLLRKLERKVRETIETDRRLLRKVEEELKRSIEDSRRLVDELKKRVT

SEQ ID NO: 9252 - protein, 60 aa, Artificial Sequence
  Synthetic sequence.
SSKDRLRDEIRRVVERVREISERVNKHNRDSVKRVEEESRRINKEIRKVVEDVDRMRRRV

SEQ ID NO: 9253 - protein, 55 aa, Artificial Sequence
  Synthetic sequence.
EEVLREIEKLVRDVEREVRESIERSKRLVKELEERVKKSIDEIKKEVDDVERKLK

SEQ ID NO: 9254 - protein, 60 aa, Artificial Sequence
  Synthetic sequence.
KEVEDLKEKVKRVVEEVEKISRELNKHNRDSVRRAEKTSKELNDHNKDSIRKVREVLKRT

SEQ ID NO: 9255 - protein, 55 aa, Artificial Sequence
  Synthetic sequence.
DKVLKDIKKLLKDVEKKVRESIKESKELVKRLKDKLEESIRRSKKDVEDLKREVD

SEQ ID NO: 9256 - protein, 60 aa, Artificial Sequence
  Synthetic sequence.
SSVDKLRKEIREVLRRVERISEESHKHNEESVRKVKERSERLNKHNRDSARDVERVLREV

SEQ ID NO: 9257 - protein, 55 aa, Artificial Sequence
  Synthetic sequence.
EEVLEEIRRRLEEVEERVRRDLEESKKLVDELRKRVEKSIRESRKLVDDLRKRVT

SEQ ID NO: 9258 - protein, 60 aa, Artificial Sequence
  Synthetic sequence.
SSVDKLKDEVRKVVETVKDLSRRLNETAKRVADRVRKISRETHEEVRKVVEDVKDVRRRT

SEQ ID NO: 9259 - protein, 55 aa, Artificial Sequence
  Synthetic sequence.
ETVLEELKRLLDKVREDVRRSIEEIRELLKTVEKEVRDDSRDLERLLKRVEEETK

SEQ ID NO: 9260 - protein, 60 aa, Artificial Sequence
  Synthetic sequence.
SSVDRVREEIERVARRVRKLSEDSHREVEKVLKEVEEISKRTHEEIDKVVKEVEKVIRDT

SEQ ID NO: 9261 - protein, 55 aa, Artificial Sequence
  Synthetic sequence.
EEVLEEIRRLLETVEREVKTDIDRLREELRRVEEAVKKDSEDIRRKLKRVEDDVK

SEQ ID NO: 9262 - protein, 58 aa, Artificial Sequence
  Synthetic sequence.
REAEDIVRRSHELVERAREKLRRLNKDSERLVDEVEKELREVVERVAELIKRAKDEIG

SEQ ID NO: 9263 - protein, 59 aa, Artificial Sequence
  Synthetic sequence.
EEVLEKVLRDSERVLKELEEKLRKSLEDVKRVIDEVKKVLEDVKRKVEEVLKRVRDKRR

SEQ ID NO: 9264 - protein, 58 aa, Artificial Sequence
  Synthetic sequence.
SRAEKVERESHELVRTLKEELDRVVEKVERLVRRVEEELKRVNKESAELVKELKDRIG

SEQ ID NO: 9265 - protein, 59 aa, Artificial Sequence
  Synthetic sequence.
DEVLTKLVKSSRDVIEEIREDLKRVLKEAEEVIRRVKKRLEDSLEKVKEVLRELLRAAK

SEQ ID NO: 9266 - protein, 58 aa, Artificial Sequence
  Synthetic sequence.
SSAEDVVRRSHELVRRLEEELDKVNEDSERLVREVEERLKRANEESKRRVEDAKRRIG

SEQ ID NO: 9267 - protein, 59 aa, Artificial Sequence
  Synthetic sequence.
EEVLEEVLRRSREVLKKLKEDLKRSLDDAERVIRRVREDLKRSLKRVREVLEEVRRRTK

SEQ ID NO: 9268 - protein, 58 aa, Artificial Sequence
  Synthetic sequence.
SSVDRIVEESHTRVRKLMKDLEDVNDESRRRVERLRERLEEVVKEVEKLVEELRRRIG

SEQ ID NO: 9269 - protein, 59 aa, Artificial Sequence
  Synthetic sequence.
EEVLKTILERSREVLDRIRKELERSLKEVEDVLRRIEKDLKKVLDEAREIIKRLLDEAK

SEQ ID NO: 9270 - protein, 60 aa, Artificial Sequence
  Synthetic sequence.
SRLETVLERAKELIDRIRKLLEDVRRKVKELIDRIRRLNEEANRESEELIRRIEEELRKG

SEQ ID NO: 9271 - protein, 57 aa, Artificial Sequence
  Synthetic sequence.
DARRILEEVRKLVKELEEELRRALKEVRDLAKEVDEDSKRALDRNEKLIRDLDRKVE

SEQ ID NO: 9272 - protein, 60 aa, Artificial Sequence
  Synthetic sequence.
RELEEAKKKVEDLLRRILEENERAHEESKKLIEEIRRLLKKMNEESEELRERIRKKLEEN

SEQ ID NO: 9273 - protein, 57 aa, Artificial Sequence
  Synthetic sequence.
DVERALDDVRRLLREVERRSEELLRTDEEAIRTLKKEIDKVLKENKDKADRLKEEVN

SEQ ID NO: 9274 - protein, 60 aa, Artificial Sequence
  Synthetic sequence.
DELETVERRVEKLIEDIKRELRKVHEESKKLIREIKKELEDANRESERVIEEIKRELDRD

SEQ ID NO: 9275 - protein, 57 aa, Artificial Sequence
  Synthetic sequence.
DARKMLEDVKKRAKDVEDEIEEVLRRDRELIKELKRELDEALRENRRLIEDLKRKIK

SEQ ID NO: 9276 - protein, 60 aa, Artificial Sequence
  Synthetic sequence.
SEAEEALKRVKKAIDDARKLLEEANRKDKKSIEEAEKLLREAHERSKKAIKEAEDALDKA

SEQ ID NO: 9277 - protein, 57 aa, Artificial Sequence
  Synthetic sequence.
DAEKALRDAKRLADDLKRTADEVLKENKRTAEDLKRKADEVLERDKKLAKELKEKAT

SEQ ID NO: 9278 - protein, 60 aa, Artificial Sequence
  Synthetic sequence.
SELEDVKRKVKRLIEDIERALTEANKEDEKSIEETERLNRTVHEESKELVERLKDELRKR

SEQ ID NO: 9279 - protein, 57 aa, Artificial Sequence
  Synthetic sequence.
DVDEALKEVRDRAKKLKDKIKKVLDDNRRTVEDNERKSDELLKTDKELVREVKERTE

SEQ ID NO: 9280 - protein, 61 aa, Artificial Sequence
  Synthetic sequence.
RELEKVRKEVERLIKEIKDLNKRAHDETKTRIDRIREKNEKVHEESKRLIREIEELLRRKG

SEQ ID NO: 9281 - protein, 55 aa, Artificial Sequence
  Synthetic sequence.
EEVIKEVEKRLDELRKESKKLLDDDRRLIEKLKEESRRLLEEDRRLIKELKEKVK

SEQ ID NO: 9282 - protein, 61 aa, Artificial Sequence
  Synthetic sequence.
SAAERAAEEVKKLIDEARKLLERAHRETKKLIDEARKLNKRALDEVRRLIEEADRLLRRDG

SEQ ID NO: 9283 - protein, 55 aa, Artificial Sequence
  Synthetic sequence.
EEVAERARRLAEELKKEADDVLRKDRDLARRAREESEEALKEAEKLARDLRRRAK

SEQ ID NO: 9284 - protein, 60 aa, Artificial Sequence
  Synthetic sequence.
KEAEDIKRKVEKVAREITEKSRKSHEELRKVVKEARDKSEKSLRDVERVLREIEELLRRR

SEQ ID NO: 9285 - protein, 55 aa, Artificial Sequence
  Synthetic sequence.
KDLIEEIKRRLDEVRRRSEDNLKKMEEELKKVEEDSRRVVERIRTELKRVEDEAR

SEQ ID NO: 9286 - protein, 60 aa, Artificial Sequence
  Synthetic sequence.
SEAEKIRKDVEKVIREVREDSKRTLERSRKVDEEIRRKSETSHRLVEEVIRRAEELLRRE

SEQ ID NO: 9287 - protein, 55 aa, Artificial Sequence
  Synthetic sequence.
EELIEEIKKALEDVKRESEKVKEESRKSLEDVERDSDRNLKDMERLLREVTERAK

SEQ ID NO: 9288 - protein, 60 aa, Artificial Sequence
  Synthetic sequence.
DEVEEIRKEVERVIREVEEKSKETLRRSEKVDREAKKKSDDSRRKVEKVADEIRRLLETR

SEQ ID NO: 9289 - protein, 55 aa, Artificial Sequence
  Synthetic sequence.
KDVIEEIRRLLDEVRRRSEKVIRDSERSAEEVKERSERVIEELKRLLEKVAREVK

SEQ ID NO: 9290 - protein, 60 aa, Artificial Sequence
  Synthetic sequence.
SSVERVERDVARVAREIRKISRDTKEESKEVDRRIDEISKRTNEDVRRVAEEIKRLKEKR

SEQ ID NO: 9291 - protein, 55 aa, Artificial Sequence
  Synthetic sequence.
KDVIKEIEDRLREVEEESKKAIEESKTSLKRVKEKSEKNVEDMKKLLEKVREDVR

SEQ ID NO: 9292 - protein, 60 aa, Artificial Sequence
  Synthetic sequence.
SEVEKVLDEIRRLLKEVEERSKENNDRNEELARRNTRRSEENIRRIEELLRRVREEARKD

SEQ ID NO: 9293 - protein, 59 aa, Artificial Sequence
  Synthetic sequence.
EKFLREVRREIEEIIRRIKEASEKTHKEAKEVVDRINELSRKSHETIKEIIKRVRDRAK

SEQ ID NO: 9294 - protein, 60 aa, Artificial Sequence
  Synthetic sequence.
REVDEVLDEIRRLLERVREESEKNNRDNEKLMRDNEDRSRKVIETIKRLLEDVKDRATKK

SEQ ID NO: 9295 - protein, 59 aa, Artificial Sequence
  Synthetic sequence.
EKFLREVRREIEEIIRRIRELSERTHREAKEIVDRINELSKRTLDKAKEMLDRAEEKAK

SEQ ID NO: 9296 - protein, 60 aa, Artificial Sequence
  Synthetic sequence.
DEVEKVLRDIEKKLEDVERRSKEVIDEIRKLLKEVEEESRRNVKKIREELKKVVDDVRRK

SEQ ID NO: 9297 - protein, 59 aa, Artificial Sequence
  Synthetic sequence.
EKFLRDVKRMVDEILDTARELSRRTLEEIKRIIARIRERSEKSHEEARKALRDVEEKAR

SEQ ID NO: 9298 - protein, 60 aa, Artificial Sequence
  Synthetic sequence.
DSVREVLKKIEDELERVKRDNKDVNRKNEELMRRNEERSRRVVEDIKRKLKELVDDVRRN

SEQ ID NO: 9299 - protein, 59 aa, Artificial Sequence
  Synthetic sequence.
EEVLKRVDEEAEKVLRENEKLSKKSLDEAREIVREINRLSEDTRREADEILERVKEKVR

SEQ ID NO: 9300 - protein, 60 aa, Artificial Sequence
  Synthetic sequence.
DEVETVLEKIERLLRKLEKDSREVIKKIKRLLDEAKKESRKNIEEIKKLLEEVKREVDRR

SEQ ID NO: 9301 - protein, 59 aa, Artificial Sequence
  Synthetic sequence.
ERFLREVEKELEDMLRRVRKLSEDTERKIREILERIKRLSDDSNRKAKEILREIRKRAE

SEQ ID NO: 9302 - protein, 55 aa, Artificial Sequence
  Synthetic sequence.
DELEKVKEEIRRLLRRIEEDVKRSEERNKELLRRITEEVKRSERRNEELLKEIKD

SEQ ID NO: 9303 - protein, 56 aa, Artificial Sequence
  Synthetic sequence.
LKKVREDLERMLRRVEEELKRSNEESERAIEEVRRELEDIDRESRKAIEDVLREEK

SEQ ID NO: 9304 - protein, 59 aa, Artificial Sequence
  Synthetic sequence.
SEIDEVLTRLRKISKDLNETSDRVNERARKIIDDIKKESKRVNDEAREIVERLKREIDK

SEQ ID NO: 9305 - protein, 59 aa, Artificial Sequence
  Synthetic sequence.
KDKVERVVREVEKLHEEDRKRLEESTRSVRKLLEELKRELEKSTRSVKKLVDELRERVR

SEQ ID NO: 9306 - protein, 59 aa, Artificial Sequence
  Synthetic sequence.
DEVDEMLKRAEDRIREISDTSRKVNEDARKIVEDLKRDSERVLRELRKRIEELRREIER

SEQ ID NO: 9307 - protein, 59 aa, Artificial Sequence
  Synthetic sequence.
EKRVREVAEEVKRLVKELEERLRRSTESVKRLLEDVERAVKESSDEVEKLLRRLREELE

SEQ ID NO: 9308 - protein, 59 aa, Artificial Sequence
  Synthetic sequence.
DEIEEVLRDAKRISDELNRRSEEVNRELREIIKELTKRSRKVLEELKKIVRDLEKKIKD

SEQ ID NO: 9309 - protein, 59 aa, Artificial Sequence
  Synthetic sequence.
REKAERVLRTVEELHKEDRDRMKESTDSVKRLLEELKRRAEKSSRTVEELLRRLEEKIR

SEQ ID NO: 9310 - protein, 59 aa, Artificial Sequence
  Synthetic sequence.
SEIDELLERAKKRSKELNDTSKEVLDRARRIIEEISKTSEEVNKDLERIIRELAEEIKR

SEQ ID NO: 9311 - protein, 59 aa, Artificial Sequence
  Synthetic sequence.
EKRVREVLKEVRRLHEEDRKRMKESSEDVERLLTELRKRMKESTDSVEKLLKELEDRVR

SEQ ID NO: 9312 - protein, 59 aa, Artificial Sequence
  Synthetic sequence.
SSLEKLLEDVRRRSEELNRRSRKVLEDLKDIIRRLKEESKRVLDEAKKKVDDVERKIDK

SEQ ID NO: 9313 - protein, 57 aa, Artificial Sequence
  Synthetic sequence.
KVRKALEDVRRLHEEDKRRVDESSKEVERLLRELREDMKRSSEEVERLVKRVRDRLK

SEQ ID NO: 9314 - protein, 59 aa, Artificial Sequence
  Synthetic sequence.
SEADELLKEVKRISDELNDTSRRVLEELREISRRLNEDSKRVLKELEDILEEIRERIDR

SEQ ID NO: 9315 - protein, 59 aa, Artificial Sequence
  Synthetic sequence.
EERVRELVERVKELHEEDKRRMDDSSRDVERLHKEDADSARDSSRKVRELLEELRRRVE

SEQ ID NO: 9316 - protein, 60 aa, Artificial Sequence
  Synthetic sequence.
KELEDVLRELKRILEELEKLSREADERSKEIVKRLVEETTRSLKEVKEIVERLKELDDAG

SEQ ID NO: 9317 - protein, 59 aa, Artificial Sequence
  Synthetic sequence.
EKRAREVRETVRKLVEDVKKKNEESERRNRELVKEVRKRNKEVRDRSRKLVKELEDKLR

SEQ ID NO: 9318 - protein, 60 aa, Artificial Sequence
  Synthetic sequence.
SSLEKVLKDLRKILEDLRREIKTVLDDLRRILEELKRETERVDKKSKEIIETLSELRKAG

SEQ ID NO: 9319 - protein, 59 aa, Artificial Sequence
  Synthetic sequence.
KKKVDEAIREVEKLIEELRRDLDRVRKTVEKLVRDLERRNEESKRRNEKLVRKLEEELR

SEQ ID NO: 9320 - protein, 59 aa, Artificial Sequence
  Synthetic sequence.
DELETVLRKLEKLVRDLKKRSTDVLRRLEEIVKELTDETKRVDDESRDILRRLKELRDR

SEQ ID NO: 9321 - protein, 59 aa, Artificial Sequence
  Synthetic sequence.
KEEADRVITTVEELVKELRRRNEEVKERVEKLARELRRRNEESIKTNEKEVRELEKRLK

SEQ ID NO: 9322 - protein, 60 aa, Artificial Sequence
  Synthetic sequence.
STLKKVLDENRKSIKELLDMSRRVLEKLREILRRLEEETREVDEKSERIVTTLEELIKAG

SEQ ID NO: 9323 - protein, 59 aa, Artificial Sequence
  Synthetic sequence.
EDKAKKVIDEVRKSVKRLEEENERVLRDVERLVREVEKKNRESEKRNRKLVEELRRKLK

SEQ ID NO: 9324 - protein, 60 aa, Artificial Sequence
  Synthetic sequence.
SVLEEVLKKLEKILRELKREIEEVLKKLRRILEELVRETEKSLEKVDRIIKELEKLIEAG

SEQ ID NO: 9325 - protein, 59 aa, Artificial Sequence
  Synthetic sequence.
EKKAREVTKTVEKLIRELRKTLEDVKREVRKLVEEVKRRNKDVERKSRELVKKLEERLR

SEQ ID NO: 9326 - protein, 60 aa, Artificial Sequence
  Synthetic sequence.
STLEEVLERNKESIERLRKESEDSHRKLKEIMERLKRETERSLEEVEEIVKRLKELTDEG

SEQ ID NO: 9327 - protein, 57 aa, Artificial Sequence
  Synthetic sequence.
KVKRVIEKAKKSVEDLERRLREDEEAAREWVKKLRTENEKVRKRSEELVRELEERLR

SEQ ID NO: 9328 - protein, 59 aa, Artificial Sequence
  Synthetic sequence.
STLEKVLRDLRKILEELLRMSKKVLEELKRLADRLKEEIKKSLDKVKKIIDELRDLTRK

SEQ ID NO: 9329 - protein, 59 aa, Artificial Sequence
  Synthetic sequence.
EDKARKVIEEVTREVRRVEEENKKVERTVEKLVEELEETVREARERSERLVRTLEEELR

SEQ ID NO: 9330 - protein, 60 aa, Artificial Sequence
  Synthetic sequence.
SDAERVEKEIREVLKRVEDLLRRVNEETKKVAKEVRELLKEVDDRSREIMKRVAEKLRRI

SEQ ID NO: 9331 - protein, 55 aa, Artificial Sequence
  Synthetic sequence.
KDVAREVEKLLRELEKKLEEVNRHDKKLLEELEERLKESEERNRRLLEELKRRLD

SEQ ID NO: 9332 - protein, 60 aa, Artificial Sequence
  Synthetic sequence.
REVEEVLKRIEELIRRSEEETREVNERTKKLAEDVRRLLEEVDRRSKKIADEVRELLERI

SEQ ID NO: 9333 - protein, 55 aa, Artificial Sequence
  Synthetic sequence.
KDLVRTVEELLKRNEEDLRRVNEHDKKLLEDLTRSLERSEERNKTILEKLKEDLR

SEQ ID NO: 9334 - protein, 60 aa, Artificial Sequence
  Synthetic sequence.
SDAEKVLDEIRKRIEESEKRTKEVNDRTREVLDRVRKLLEKVNKESRKVAEDVREAAERI

SEQ ID NO: 9335 - protein, 55 aa, Artificial Sequence
  Synthetic sequence.
EEVRKDVERLLRENERSLREVNRHDEALLRELEKRLEEVNRHDDKLVKDLRERER

SEQ ID NO: 9336 - protein, 60 aa, Artificial Sequence
  Synthetic sequence.
DEVREILEDVKRINKEVEDELRKIEEEIREIVKTVRDESRKTLEELERILRKVEDDLRKD

SEQ ID NO: 9337 - protein, 55 aa, Artificial Sequence
  Synthetic sequence.
EEAVKDNERLAKETEDKVREVVKRIRKIIEEVERTARESERRLRKLLKEVEDRAR

SEQ ID NO: 9338 - protein, 60 aa, Artificial Sequence
  Synthetic sequence.
EEIERILEELRRIAKKVEEDSRRTLETVRRLNEEVKRRLREILEEIRRVAEDVRRKLDEK

SEQ ID NO: 9339 - protein, 55 aa, Artificial Sequence
  Synthetic sequence.
EDVKRELERILEEVRKKSREALEKNKRLLEDTRRVVEEVKRELEKILRDVKRKVD

SEQ ID NO: 9340 - protein, 59 aa, Artificial Sequence
  Synthetic sequence.
SVVEELRDELRRAEEENRKIVEDTTRRLEDMIRRDEKINEEVERRLEEVTRRVEELRKQ

SEQ ID NO: 9341 - protein, 59 aa, Artificial Sequence
  Synthetic sequence.
ERKAREMEKEVTEILRRLEEENKRDLDRIKKLLDELRKKNEDTLRRIRRLLEEVRERLR

SEQ ID NO: 9342 - protein, 57 aa, Artificial Sequence
  Synthetic sequence.
SSLDEVLERLRKLLKEIEDKVRRINEEVKKSSEDVERELKRVVDELKRRVERLKEEV

SEQ ID NO: 9343 - protein, 59 aa, Artificial Sequence
  Synthetic sequence.
ERELEKILRDAERVVREIEKRHRDLLEELKKANEDTRRALDEIRKEAERVLERVREEAK

SEQ ID NO: 9344 - protein, 57 aa, Artificial Sequence
  Synthetic sequence.
DEVEEVLKRLRESSEESKRRADDVTRRAEESSRRVHKRSREVVERLKKLVEEVERRV

SEQ ID NO: 9345 - protein, 59 aa, Artificial Sequence
  Synthetic sequence.
RRELEKLEREMRDVDRRTDEALERLLRTLEEVNKRTDEENKKILEDLKRVVEEVEERDR

SEQ ID NO: 9346 - protein, 57 aa, Artificial Sequence
  Synthetic sequence.
SEIEKVIEELRRSSEESHKRSRKVEEDARRSSDEVHRRSREMLRKLREEVKDVERKV

SEQ ID NO: 9347 - protein, 59 aa, Artificial Sequence
  Synthetic sequence.
RRDLRRLREEMRRVDERTTRENEKILRELEEVNKETIKENERLLRDLKRVVDRVREEDR

SEQ ID NO: 9348 - protein, 57 aa, Artificial Sequence
  Synthetic sequence.
RRIEEVIKEARKSSRESHEESKEVMERLKRSSDDSHRKSEEVLRRLRKLVEDVERRV

SEQ ID NO: 9349 - protein, 59 aa, Artificial Sequence
  Synthetic sequence.
DRELKKLRDELKRVDDETRKANEEILREMEEVDKRSKEANDRLLEELAKVVKRVDDEDR

SEQ ID NO: 9350 - protein, 57 aa, Artificial Sequence
  Synthetic sequence.
KDIEEVIRRLRESSKESTKRLRDVVEDLKRSSKEVHDESEDVLRRLEELVRRLKKKV

SEQ ID NO: 9351 - protein, 59 aa, Artificial Sequence
  Synthetic sequence.
KRLLKELEDRMRRVDERTDEELEKIRKRMKEVDDRSRDVNRKLAEDLKRAIKRVDDEEK

SEQ ID NO: 9352 - protein, 61 aa, Artificial Sequence
  Synthetic sequence.
DEVREVLRRDEELHRELKERIDRILEELERLHRDLKRKIDRVLEELKRLHEDVKRELDKRG

SEQ ID NO: 9353 - protein, 59 aa, Artificial Sequence
  Synthetic sequence.
EEALRKLHEESKKSVRDVEKELEELRRENKKVIEDLEDELRRLLEENKRAADELRKRAE

SEQ ID NO: 9354 - protein, 61 aa, Artificial Sequence
  Synthetic sequence.
DEVEKVKDDVRKLVEKVKRDAKRAHEDNERKHRKLKKELDDALRELKKRHEELKRRIDDRG

SEQ ID NO: 9355 - protein, 59 aa, Artificial Sequence
  Synthetic sequence.
DEALRRLKEELDKMIEDVRKELRKLNEDSDDSIRRVKKRLKELRDENEKVIRDIRRETE

SEQ ID NO: 9356 - protein, 60 aa, Artificial Sequence
  Synthetic sequence.
SELEKVRKKVEDISRESEKHLREVKKENDRIIKEIEDELRKLLTDVEREIREVEKRIREE

SEQ ID NO: 9357 - protein, 58 aa, Artificial Sequence
  Synthetic sequence.
EKAKRVFEEIERIVRRNKEELRRILKELRELHEEVKEKIKKVLEDVKRLVDELLERAK

SEQ ID NO: 9358 - protein, 60 aa, Artificial Sequence
  Synthetic sequence.
SELEKVLRDVREAIKRNEDLLRRVHEESRRISEESEKNLRRVHERSRRIAEDVRRVLRER

SEQ ID NO: 9359 - protein, 58 aa, Artificial Sequence
  Synthetic sequence.
EEAEKVAREAKKLVDDLKRKNDEVLDEDRKEVERNERELERVLREDKKLLEDLEREIK

SEQ ID NO: 9360 - protein, 60 aa, Artificial Sequence
  Synthetic sequence.
DFAKKLEDEARRVSEESRRHLEDLLRRSKESIDALKRKLEDMLRRVREVIKRIEDELRRE

SEQ ID NO: 9361 - protein, 55 aa, Artificial Sequence
  Synthetic sequence.
ERVIERIKELLDRNRKELEDVARDAERLNRELNERVDRVLKEVEERLKELEDRVK

SEQ ID NO: 9362 - protein, 60 aa, Artificial Sequence
  Synthetic sequence.
DKAKELEEEIRKIIREIEELLRRMEETSRKSSKESEKHLRDAHEDSRRIAERIKDLLRKE

SEQ ID NO: 9363 - protein, 55 aa, Artificial Sequence
  Synthetic sequence.
EDVIRELERLLRELKKRIEDVVRRIKELNEDNNRKVEKIREDDERLLEKVRRDVK

SEQ ID NO: 9364 - protein, 60 aa, Artificial Sequence
  Synthetic sequence.
SAAEDVLRKVEKIIKEIEELLKRALEESRKSVKELEKILRDAHEKSRKIAREIEDALRKR

SEQ ID NO: 9365 - protein, 55 aa, Artificial Sequence
  Synthetic sequence.
DEVVEEIKRLLEELRKKIEDVADEIRRLNEEVNKKLDDLVKTDTKLLEDVDRKVK

SEQ ID NO: 9366 - protein, 60 aa, Artificial Sequence
  Synthetic sequence.
SAAEEVRKKNEKISRELEKLNRKALEDSRDSIRKLKKILDDAHKDSREIIKEIEDLLRKR

SEQ ID NO: 9367 - protein, 55 aa, Artificial Sequence
  Synthetic sequence.
DEVVEEIKRSNDENNERSKKVLDEIKKLNKEVNDRVEELLERDKRELERVKRDVD

SEQ ID NO: 9368 - protein, 60 aa, Artificial Sequence
  Synthetic sequence.
DEFRDIEERAKELAEENETINRRVLTEHKKLIDELREILERVLREHEKRLKDLKDLVRKI

SEQ ID NO: 9369 - protein, 55 aa, Artificial Sequence
  Synthetic sequence.
EEILERIRKLLEDVEEKVKKSVEDSRRLLKTIREEVERVLDTSRKLLKRLEDDVR

SEQ ID NO: 9370 - protein, 61 aa, Artificial Sequence
  Synthetic sequence.
SDLEEVEKRAEEIIRRNKEELEKVLRESKDIIDKNRKLNKESLDEVKRIIERLEDLLRKDG

SEQ ID NO: 9371 - protein, 58 aa, Artificial Sequence
  Synthetic sequence.
EEVRKVAKKIRDEAKKSHDESKKLNDTSRDLVRKSKEEAERIDEEMKKLLKEIKDKVR

SEQ ID NO: 9372 - protein, 60 aa, Artificial Sequence
  Synthetic sequence.
SEVEEILKRIEDLARTLLKLNEDSLRRNEEIIRTIKELNEKTLKENKEIIDRLRELLRRT

SEQ ID NO: 9373 - protein, 55 aa, Artificial Sequence
  Synthetic sequence.
ERVLKEIEDLLREVADRSRKFNERSERLLREVEERSREVNDRSKKLMDTIAKEVK

SEQ ID NO: 9374 - protein, 58 aa, Artificial Sequence
  Synthetic sequence.
SEVEKALERVKKLAEDLERLDKESLERVEKVIRDAERLDKTSREEVKKIADEADDLRR

SEQ ID NO: 9375 - protein, 55 aa, Artificial Sequence
  Synthetic sequence.
EEVLRRIRRLLEEVRKKVEDSNRELKRRLDELEKRVRDSNKEIRELVKEVERKVN

SEQ ID NO: 9376 - protein, 60 aa, Artificial Sequence
  Synthetic sequence.
SRLEEVLRRIRKLLRDNKETAKRVLEEIERLLREADKRNREALKEIEKRMREVEDKLRKA

SEQ ID NO: 9377 - protein, 59 aa, Artificial Sequence
  Synthetic sequence.
EKDLEELRRRVKEVSDESRKLLEDLLDEARKVLEENRKLVEEILREAKKVIDEIEEKLR

SEQ ID NO: 9378 - protein, 60 aa, Artificial Sequence
  Synthetic sequence.
SELEKVLREIRRLLDEARKRNEEFLRRIEELLRRNEEEVRRVLEKIERKVERVKRDLERR

SEQ ID NO: 9379 - protein, 59 aa, Artificial Sequence
  Synthetic sequence.
EEKLERILRTARKVVEDNERLVREVLKKVKRVSDESRRLLEEIDREVDEVIKRLEERAK

SEQ ID NO: 9380 - protein, 59 aa, Artificial Sequence
  Synthetic sequence.
SEAEEIRRRLEEISRRSVEHLRKVLEEIKRISERSKRHLDRVLEENKRRLEELRELLER

SEQ ID NO: 9381 - protein, 56 aa, Artificial Sequence
  Synthetic sequence.
EEVLRELEELLKESEERIKRIEEEIKKIIDKSREDIKRVLEEIERLNKKAADDLRK

SEQ ID NO: 9382 - protein, 59 aa, Artificial Sequence
  Synthetic sequence.
DEVREVLEELKRISDDSIRHLEEVLRRLREIIERLKATNDDVLRELEEIIRTLLDLDRQ

SEQ ID NO: 9383 - protein, 56 aa, Artificial Sequence
  Synthetic sequence.
KEALDTLERTVEESKKRIKEILDRVKELIDKAREDSKRSVEEVRRRIEKARRDLDR

SEQ ID NO: 9384 - protein, 59 aa, Artificial Sequence
  Synthetic sequence.
SKVDELLKRLEDIIRKLDKENEKVLRELEEISKRSVDHLKRVLEENRRILEELERLLEG

SEQ ID NO: 9385 - protein, 56 aa, Artificial Sequence
  Synthetic sequence.
ERVLRDLKRLVDEARRRSERSLEEVKRIADESRKEIERILREIEEENRRAKDKLRR

SEQ ID NO: 9386 - protein, 59 aa, Artificial Sequence
  Synthetic sequence.
SRAEDLLRRLEKIIRDSLRHLREVLKRLERIIDELRKTNERVKEELERIIDTLRKLKDN

SEQ ID NO: 9387 - protein, 56 aa, Artificial Sequence
  Synthetic sequence.
EEILRRARELVDESRRRLEKVVKEVRDVIRTLKKDSDKSLRDLEEEVRKAEEDLRK

SEQ ID NO: 9388 - protein, 59 aa, Artificial Sequence
  Synthetic sequence.
DEVRELLDTLRRIIERSVKHLEDVLRDLKRIIDKLREDNRRVLEENRRRLEELDKLRKE

SEQ ID NO: 9389 - protein, 56 aa, Artificial Sequence
  Synthetic sequence.
EEFLRDVERLAEESRRRLEAVEREVERLITEAEKESKKSLDEVERLNRELKERLKK

SEQ ID NO: 9390 - protein, 60 aa, Artificial Sequence
  Synthetic sequence.
DVEDILRTIRDLIRRVDEKSRKTLEENRRAIEEVLRRSDETLRRNKKLIEDVEEEVRRTV

SEQ ID NO: 9391 - protein, 59 aa, Artificial Sequence
  Synthetic sequence.
REFMETVLRKIKEDIERLEERNREVHEKSREEIRKLEEENEEVHRKSRKEIDEIRKELK

SEQ ID NO: 9392 - protein, 60 aa, Artificial Sequence
  Synthetic sequence.
DVEEILKEIRKRIEDVKRESEKTLKEIRDLIKKVAEDIERSVKENRELIDKVRRELERDV

SEQ ID NO: 9393 - protein, 59 aa, Artificial Sequence
  Synthetic sequence.
RKVLTDVLKEIERRIDELRRRNEEVVEKIKREIKKLEDESKRVNDESREIIKRIKEEVD

SEQ ID NO: 9394 - protein, 60 aa, Artificial Sequence
  Synthetic sequence.
DVEEIIREIRKLIEKVLRDVRRSAEENKKLIDEVKRRVEEMLKRNRDMIKKVLDDVRREV

SEQ ID NO: 9395 - protein, 59 aa, Artificial Sequence
  Synthetic sequence.
REFLKKVLDEIREIIERLRRESEKVNEDSKREIKDIERELREVHKKSRRIIRRIEEKLR

SEQ ID NO: 9396 - protein, 60 aa, Artificial Sequence
  Synthetic sequence.
DEAREVLERLKKISEEDKRRSDKVNEETRRIIKEAEERSRKVNEETKRIIEKLEEDLRDR

SEQ ID NO: 9397 - protein, 56 aa, Artificial Sequence
  Synthetic sequence.
EEILRELREILRENTERVERSLRDNRRLLDELRKKVERSAEENERLLREAEEKLRK

SEQ ID NO: 9398 - protein, 60 aa, Artificial Sequence
  Synthetic sequence.
SEVDKVLDDSRKSAEDLRREIETVLKRNKELIDENRKRLKEVLDRNAKLADDLRRERKKG

SEQ ID NO: 9399 - protein, 56 aa, Artificial Sequence
  Synthetic sequence.
ERVVRTLEKLIEEWRKAVEDVLRTLEKLTEEAKRESERILEELKRITKELRDEERR

SEQ ID NO: 9400 - protein, 59 aa, Artificial Sequence
  Synthetic sequence.
SEVEDVLRRLEELLRRLEKKSRESLEELRRRLDEVRKDSERSNEDSERLIRELEEIRRK

SEQ ID NO: 9401 - protein, 56 aa, Artificial Sequence
  Synthetic sequence.
KEFLDTMRRIVEELKKRLKEVNDRIKDIVRRAEEELKRSNDENKERIERAEKKVRD

SEQ ID NO: 9402 - protein, 59 aa, Artificial Sequence
  Synthetic sequence.
SELEKVLEELKKLLEELERESDTSVKELRTLLERLEEESKESNERSKRLAEELERRLKD

SEQ ID NO: 9403 - protein, 56 aa, Artificial Sequence
  Synthetic sequence.
REFLETMERIIEELEKRLREVNEDLKRIVRTVAERLKKSNRDNRELIRTLKDRVRT

SEQ ID NO: 9404 - protein, 59 aa, Artificial Sequence
  Synthetic sequence.
SEVEDVLRRLEELLRRLKEKSKKSNEESKKLIKELKEESDKSRRDLERLLEKLDRDLKR

SEQ ID NO: 9405 - protein, 56 aa, Artificial Sequence
  Synthetic sequence.
REVLERMRELVEKLKEDLERSNKENKDLIDKVKRDLEEVNRRLEKIVREVKERVRT

SEQ ID NO: 9406 - protein, 59 aa, Artificial Sequence
  Synthetic sequence.
SEVEDVLRRLRELIEELRERSERSNEESKRLADELEKRSEESLRRLAELLRKLEEDLRR

SEQ ID NO: 9407 - protein, 56 aa, Artificial Sequence
  Synthetic sequence.
REVLTTIAKIVTDLERELRKSNEENKKLIDELRKRLEDSNKRVKEIVKRLEEEVRR

SEQ ID NO: 9408 - protein, 60 aa, Artificial Sequence
  Synthetic sequence.
KDVEEALKELERVLEELKRLSKELLDRLRELADRIRRISKELLEELKRLLKDIKETVDRI

SEQ ID NO: 9409 - protein, 56 aa, Artificial Sequence
  Synthetic sequence.
EDVLRRLRELIEKVKRDLDRTDETLKELIKTLEDELRKSNETIEDLIRRLEEALRK

SEQ ID NO: 9410 - protein, 60 aa, Artificial Sequence
  Synthetic sequence.
SDLERLLDELRKLLDDLRRKSEELLRRLDTLAKKIEREAEKITKDNKELIDRLRDRLRRI

SEQ ID NO: 9411 - protein, 56 aa, Artificial Sequence
  Synthetic sequence.
ERMLRTLERLIEKLKEELKRTDKELERLIRELKKRLDDNNRRNEELIKRVEDELRK

SEQ ID NO: 9412 - protein, 60 aa, Artificial Sequence
  Synthetic sequence.
SEAETVLEEMKEVSKRTEEKNKKVEDDDKRSIDELRKKLEKVLREDRRSIEDLERRLKEN

SEQ ID NO: 9413 - protein, 56 aa, Artificial Sequence
  Synthetic sequence.
EEVLRTIERLSRENKKKDEDTLRKSKEEHERVREELERVLETSRREHEKVKKRLED

SEQ ID NO: 9414 - protein, 60 aa, Artificial Sequence
  Synthetic sequence.
RVEEMLERLRRLHEEVKRRIDEVLRELEEESKRNEERIRRVLERLRDEHRKLKETLDRRN

SEQ ID NO: 9415 - protein, 59 aa, Artificial Sequence
  Synthetic sequence.
EEELERLERKSRESIERLKDTLRELKERLKRISDRSDEKLREAEKRSRESIEEVKKRAK

SEQ ID NO: 9416 - protein, 60 aa, Artificial Sequence
  Synthetic sequence.
EVEDVMREARKLHKELEDKIRDAARRIRETIDRVKKEDDDSLRKLRKLHEDLKRELEKRN

SEQ ID NO: 9417 - protein, 59 aa, Artificial Sequence
  Synthetic sequence.
RDELRKLLEDSKRSIEKVEDDLRKLEEKIKRVIDDNRRKNKELEEKSRKSIRDLEEEVR

SEQ ID NO: 9418 - protein, 60 aa, Artificial Sequence
  Synthetic sequence.
EVEDVLRELRKEHDDLRKEITDVLRRLEKLHRELDEEDERSVKRIRELIEEVMRELRKRN

SEQ ID NO: 9419 - protein, 59 aa, Artificial Sequence
  Synthetic sequence.
RKDLKALKEDSKRSIDDIRRKLEEARRRSERSIDENRKLNKRVIEKIREIIRRLEEKTK

SEQ ID NO: 9420 - protein, 59 aa, Artificial Sequence
  Synthetic sequence.
EVEDVLREAERLHRTLLKEIRDALRRLRKLIEDVKRKDDESLKRLREKLERLKESLERN

SEQ ID NO: 9421 - protein, 59 aa, Artificial Sequence
  Synthetic sequence.
REELKKLLEDSKRSLDELRRRLKEVEDRVREAIKKNEDENRKLERRLDKIIEDLERRVK

SEQ ID NO: 9422 - protein, 60 aa, Artificial Sequence
  Synthetic sequence.
SEAEKILKEIRDISDRTREELKKVKDEHKTLIDRLREILERALREHDRLAKELEDIKRKI

SEQ ID NO: 9423 - protein, 56 aa, Artificial Sequence
  Synthetic sequence.
EEVLREISKIIKDNHDEVTEVLKESEELIRRLRKEVEDVRRTSEKLIRELEERVRE

SEQ ID NO: 9424 - protein, 58 aa, Artificial Sequence
  Synthetic sequence.
SEVDDVLRRLEELIKTLEDINRKSLEDIKKLIDDLRKILEDALRKHEKLIRELREMKK

SEQ ID NO: 9425 - protein, 56 aa, Artificial Sequence
  Synthetic sequence.
KEFLDRMREEIRRLEEESRKSDETIERLIRELRRRVEEVLKTSTDLIRELEEEVKK

SEQ ID NO: 9426 - protein, 61 aa, Artificial Sequence
  Synthetic sequence.
SSVERVLEAVKELAKKLAEDIRRSLEHIRRLLEEVEKKHRDSKEHVRKLLKDLRDIAREKG

SEQ ID NO: 9427 - protein, 59 aa, Artificial Sequence
  Synthetic sequence.
DKELKKILDELRKLIRKVLEALRELNKRAKEILDRVAENVKEVNERLERLVRRIAEEIR

SEQ ID NO: 9428 - protein, 61 aa, Artificial Sequence
  Synthetic sequence.
SSVERVKEEVEKLLEKLEREIRKSLKTIRELLRELKRKHEESKEHVRRLLEKAEREARRRG

SEQ ID NO: 9429 - protein, 59 aa, Artificial Sequence
  Synthetic sequence.
DKKLEEILRRAKELIDRVLEELKKLNEELRRIIEEIVRNVKRVNEKLEKLLRDIKRRID

SEQ ID NO: 9430 - protein, 61 aa, Artificial Sequence
  Synthetic sequence.
SSVEEVLRRVKELLKTLKKKHEDSKRTVKELLDDLRKKHEDSKRHVRKLLEELEKRARERG

SEQ ID NO: 9431 - protein, 59 aa, Artificial Sequence
  Synthetic sequence.
DKELKRILEEVKELVKRVLENVERVNREVRERLKEVSRNVERVNKEAKELVDEVEERAR

SEQ ID NO: 9432 - protein, 61 aa, Artificial Sequence
  Synthetic sequence.
SSVEEVRKRVRDLIKRYREEVEKIKKDVRRLLDELREEVKRSLDHVRKLMEELRRKIKRDG

SEQ ID NO: 9433 - protein, 59 aa, Artificial Sequence
  Synthetic sequence.
DKELKRILDELKERLERAKRENEDSVRKLRKLIEEILREIRRLNKEAEDLIREIEERAR

SEQ ID NO: 9434 - protein, 61 aa, Artificial Sequence
  Synthetic sequence.
KDVEEVLTRVRELLRRVEEEIRRSEEHIRRLLEELRRKHEESKDSIRKLLEDLEEKVRRRG

SEQ ID NO: 9435 - protein, 59 aa, Artificial Sequence
  Synthetic sequence.
RKDLEEILREVEKLVEEVERRLRKLNEELKEILRTIVENVERVNRRLEELIRDIKRRVK

SEQ ID NO: 9436 - protein, 57 aa, Artificial Sequence
  Synthetic sequence.
SEVEKIVEEVKKIVEEVERLHRKLLEDLRRVVEEVEDRSRRINEEAKKIVEDLKRRG

SEQ ID NO: 9437 - protein, 55 aa, Artificial Sequence
  Synthetic sequence.
EEVLKEIEDRLERLRRRAEEVNDTARKIVREVEESLKRSVESLKKLVDELRETLR

SEQ ID NO: 9438 - protein, 57 aa, Artificial Sequence
  Synthetic sequence.
DEVERLLEEAKKIVEEMKRLHEEILREVEEIVRELDEKHDKLLRDAEEIVKELKKEG

SEQ ID NO: 9439 - protein, 55 aa, Artificial Sequence
  Synthetic sequence.
EEMRRRLEKLVRDLREKSREVNERIDKLLEELHEKSERVKKTIDDLVEEVKDTLT

SEQ ID NO: 9440 - protein, 57 aa, Artificial Sequence
  Synthetic sequence.
KEVEDILREVKKIVDELLRRHRELLERARRIIKRLKEEHDRLLKELEEIVRDLTRKG

SEQ ID NO: 9441 - protein, 55 aa, Artificial Sequence
  Synthetic sequence.
EEILRRIEELLKRLRDDAKRVNDELKRLVEELRKRSKEVNDELRRLLKELEDRLR

SEQ ID NO: 9442 - protein, 57 aa, Artificial Sequence
  Synthetic sequence.
SEVEEILKEVERRVDELTRRHEELLRKADEIVKDIRRKLEEINKRLKDIADDVRRKG

SEQ ID NO: 9443 - protein, 55 aa, Artificial Sequence
  Synthetic sequence.
EEILRRIETLLEELERRSKRVNDELEKLVRELKEELERSKRSIDEILKKVSKDLK

SEQ ID NO: 9444 - protein, 57 aa, Artificial Sequence
  Synthetic sequence.
DEVERLLEDLREKVKRLVKKHEDILREVEKEVRRILRTSEEINREAEEIIRELDKRG

SEQ ID NO: 9445 - protein, 55 aa, Artificial Sequence
  Synthetic sequence.
EDVLRDVDRLLRELREKSKEVNKRIKELLDKLKTDLERSKEHLERLVKTLKDKLR

SEQ ID NO: 9446 - protein, 57 aa, Artificial Sequence
  Synthetic sequence.
DEVEDLVRKLKKRVDDLLAEHKRLLDEAEKIVREVLKKSRESNERNKKVSKEVRERG

SEQ ID NO: 9447 - protein, 55 aa, Artificial Sequence
  Synthetic sequence.
EEVLKTLDRLVEELRKASEDVNRELDKLLKDLEKKLRDSIRHLEENHKDVRRALE

SEQ ID NO: 9448 - protein, 60 aa, Artificial Sequence
  Synthetic sequence.
DEVEKVLKEIRKRVEDSLRHLEKVNKEAREIVEKVREELRESNERLREIVKTIRDRLEKL

SEQ ID NO: 9449 - protein, 55 aa, Artificial Sequence
  Synthetic sequence.
EDVRRTVEELVRRSEKAIEDSRRSIEDLVRRLKEDIERSLRSVEKLVEELTEAIR

SEQ ID NO: 9450 - protein, 61 aa, Artificial Sequence
  Synthetic sequence.
SEVEKVLEELRRIVTKSARHLDESNERLKEIIRRLDEKNKEALKRAEDIIRDIDDKLKKLK

SEQ ID NO: 9451 - protein, 55 aa, Artificial Sequence
  Synthetic sequence.
KKVKDEVKKLIDDSREKIKRSRESVKRLVEEHRRRSEEVRKTLEKLAREITERIR

SEQ ID NO: 9452 - protein, 57 aa, Artificial Sequence
  Synthetic sequence.
DELEEVADEVRKIIEDLERRLREVVKTSEKLNKENRRRTEDVEKEVEKILRELEEKL

SEQ ID NO: 9453 - protein, 59 aa, Artificial Sequence
  Synthetic sequence.
DEDIRKVLKELREIIKEVEDMLKEVLDRNRKLIEDNLRRLKEVLDRLRKKVREIEEEAR

SEQ ID NO: 9454 - protein, 58 aa, Artificial Sequence
  Synthetic sequence.
SEIEEAEERVRRLIERNKRETDRVAEEVKRINDENRRATEKVKRDVKRILDDLRRKLE

SEQ ID NO: 9455 - protein, 59 aa, Artificial Sequence
  Synthetic sequence.
DKLLRDVLRDLERLVRKNLEELKRVLDELKRLMEDNLRRLEKVLEELERLVREIVERAR

SEQ ID NO: 9456 - protein, 58 aa, Artificial Sequence
  Synthetic sequence.
EELERVAKKVRDINRRNKEETKRVEDEVRRLIKENEDTSREVVRRNEEILKDLERKLG

SEQ ID NO: 9457 - protein, 59 aa, Artificial Sequence
  Synthetic sequence.
RDVVREVLERLKELVKRNLDKLKRVLDEIRRLIEENLDELRRAHEEHRRIAEDIRRKAK

SEQ ID NO: 9458 - protein, 57 aa, Artificial Sequence
  Synthetic sequence.
ESLERVKEEVKKILEKNRRTSEEVARRVKELIDRNREKSKDVARKNEKILEDLERKL

SEQ ID NO: 9459 - protein, 59 aa, Artificial Sequence
  Synthetic sequence.
EEEVERVLRRLRELVRENEKRLKEVLDEIRRLIRENEEKLEKAHREHKKLAEEVERRKR

SEQ ID NO: 9460 - protein, 59 aa, Artificial Sequence
  Synthetic sequence.
DDVERVLKEVRELVERANEEIRKVLERDRKSNEDANRKIREVLRRVEELVDRIDKIRRE

SEQ ID NO: 9461 - protein, 55 aa, Artificial Sequence
  Synthetic sequence.
DEVVKKIKELLDRHRKTTEEVLERIRRSLEKHRRDSEEVMKELRRLVKELEDRTR

SEQ ID NO: 9462 - protein, 59 aa, Artificial Sequence
  Synthetic sequence.
DEVRELLRTIEELVRDANRKIKEVLDRDRESNDRANKTLEEILKRDKRSNEDVEEKLKK

SEQ ID NO: 9463 - protein, 55 aa, Artificial Sequence
  Synthetic sequence.
KKVEKKIRDLLKKHEEDSRKALEDIKRSLERHRERSEEVLKRIRDSLRELDKKTK

SEQ ID NO: 9464 - protein, 59 aa, Artificial Sequence
  Synthetic sequence.
DSVEEILKRVKELVDKANEKIKEVEERVRRSDEELKKILEEILREIEKLVREVEEIARR

SEQ ID NO: 9465 - protein, 55 aa, Artificial Sequence
  Synthetic sequence.
DEVKKKIKDLLEKHERDSRKVLRKLEESSKETEDRAKEVLERIEKLLEDLRRETK

SEQ ID NO: 9466 - protein, 59 aa, Artificial Sequence
  Synthetic sequence.
KDAEELLKRVRDLLKRSLESLEKILRDSKELADRWRKKLEDLLRESEELVDRAEKILRR

SEQ ID NO: 9467 - protein, 55 aa, Artificial Sequence
  Synthetic sequence.
ERVREELKKLLTRVEEEHRKVLETDKKLLKELHKESKEVNDRDRELLERLEESVR

SEQ ID NO: 9468 - protein, 59 aa, Artificial Sequence
  Synthetic sequence.
KDAERLLRELKKLLEESLKSLKELTDRIRDEVRRVKKRLRDLLRESEELVKRAEDILRR

SEQ ID NO: 9469 - protein, 55 aa, Artificial Sequence
  Synthetic sequence.
EEVEETAKKLLDEVRRAHEEVLKEIRELLRDLERTVREVNEEDKKLLRKLEEDVR

SEQ ID NO: 9470 - protein, 56 aa, Artificial Sequence
  Synthetic sequence.
SEAEKVRKDLKDIADDLHRVSERVLREDERLLKRLHDVSRDVRERDREIVEDLRRG

SEQ ID NO: 9471 - protein, 55 aa, Artificial Sequence
  Synthetic sequence.
EEVLDRARKEVDEIKKKHKKVLDESRKLVAEAERKHEEILKESEDLAREIKERER

SEQ ID NO: 9472 - protein, 56 aa, Artificial Sequence
  Synthetic sequence.
SRAEKVREDLDRIEEDLRRVHREVLKEVERILKELHDTSKRVRDEVEKIVRDLRRA

SEQ ID NO: 9473 - protein, 55 aa, Artificial Sequence
  Synthetic sequence.
EKVLEDARKLVRESKENIRRVLEDLKRIVKKLKEDHKRILDELKKLVDKIKEDAR

SEQ ID NO: 9474 - protein, 56 aa, Artificial Sequence
  Synthetic sequence.
SRAERVREEIDKILEDLHRVSERIKRELTKLMEDLERTHERIKKAIREILADLRRR

SEQ ID NO: 9475 - protein, 55 aa, Artificial Sequence
  Synthetic sequence.
EEVLKEAKKLVDDLKEKHKEVLTRVERLVEESKKNLKRVLDELRDLVRRVKEEAK

SEQ ID NO: 9476 - protein, 56 aa, Artificial Sequence
  Synthetic sequence.
SEAERVREELDKIVEDLHRTSEDVKRRDEELLKDLERRHKEVKEEDEKILKDLRDS

SEQ ID NO: 9477 - protein, 55 aa, Artificial Sequence
  Synthetic sequence.
ERVLEELRKTVTEMKKRHRDILRESEELARESKENVDRVLEESRRRAEEIKRRAK

SEQ ID NO: 9478 - protein, 56 aa, Artificial Sequence
  Synthetic sequence.
DERERVKEELDKLLRDLERVHDKVREDDKRLLDDLRRVHEKARRDDKRILDELKRA

SEQ ID NO: 9479 - protein, 55 aa, Artificial Sequence
  Synthetic sequence.
EEVLERAKELVKRSKENVERVLRDSERLAKESKENVRRVLEESKRRVEEIEERAR

SEQ ID NO: 9480 - protein, 56 aa, Artificial Sequence
  Synthetic sequence.
SEAERVREELKRILEDLERVHREVEEAIERIVEELEDVHRRARERVERILRELERR

SEQ ID NO: 9481 - protein, 55 aa, Artificial Sequence
  Synthetic sequence.
EEVLKEIEKMVKESRDTVRRILEELRELVERSKRNVEKVLRDLERAVEKIERDAK

SEQ ID NO: 9482 - protein, 56 aa, Artificial Sequence
  Synthetic sequence.
KEAEDARRRVDEILEELRKLHDEVRKTDKELLDDLEREHERVKREDDKILDTLRRQ

SEQ ID NO: 9483 - protein, 55 aa, Artificial Sequence
  Synthetic sequence.
EKVLEDLERLVETSRKTVRDILEESKELVKRSKENVRRVLERSKELVKRVSERAK

SEQ ID NO: 9484 - protein, 60 aa, Artificial Sequence
  Synthetic sequence.
SDVDEARKTVKKILDESEETLERVRRELERILRDSERTLKRVEERVRRILRDLERELRKL

SEQ ID NO: 9485 - protein, 59 aa, Artificial Sequence
  Synthetic sequence.
REEIDKVLKEIRERVERSKKHLEDVLDRLRKIIEESKRHVEKVLEKLEKIVKELKDELK

SEQ ID NO: 9486 - protein, 60 aa, Artificial Sequence
  Synthetic sequence.
KDIEEVEKRVREILEDSRRMSKKDEESTRRILEESRRVSEEDKKSTEEILKELKDELRKL

SEQ ID NO: 9487 - protein, 59 aa, Artificial Sequence
  Synthetic sequence.
RDTIKKMLEEIKRRVDESKRHLRESNKRIRDIAEESKKHLEDSNKKVRDRADELKKRLK

SEQ ID NO: 9488 - protein, 60 aa, Artificial Sequence
  Synthetic sequence.
SDLERVKKAVEDILRDSERTLRRARERLKRLLEELRRTSEEDKKSTDEILERLKRELEKL

SEQ ID NO: 9489 - protein, 59 aa, Artificial Sequence
  Synthetic sequence.
RDELRKLLEEIRRRAEESKRHIEEVLKRLEEIVKRLKEELKRSNDEIREIVRRLEEELK

SEQ ID NO: 9490 - protein, 57 aa, Artificial Sequence
  Synthetic sequence.
STLEEMEKEVEKLNRDSRRTLREVAERVEELNRDNERTSKRVEDAVRELNKRLRDEV

SEQ ID NO: 9491 - protein, 59 aa, Artificial Sequence
  Synthetic sequence.
EEELRKVLKENEELARELKKELERALEENRRLHEENKEDLRRVLEENERLHRKLRKDAK

SEQ ID NO: 9492 - protein, 57 aa, Artificial Sequence
  Synthetic sequence.
DTLERVAEAIRRLNEDLKRTLEKVERAVREILKRLAETLKRAEEEVRRLNRDLERKV

SEQ ID NO: 9493 - protein, 59 aa, Artificial Sequence
  Synthetic sequence.
EEEIKKVLDDNKKLAEDLKRELKRVLEEIRKLVKELEDIVREVLKTNKELHERLKRRAD

SEQ ID NO: 9494 - protein, 57 aa, Artificial Sequence
  Synthetic sequence.
DTLERAAEEVKKLNEDNKRTSKRVEDEVRRLNRENEEMSKRVKDTVKKILDDLRRKV

SEQ ID NO: 9495 - protein, 59 aa, Artificial Sequence
  Synthetic sequence.
EKEIERVLRELERIARENKKELEKVLRENRELHERNKKLLEKVLRDIKRLAKTLRDRTR

SEQ ID NO: 9496 - protein, 57 aa, Artificial Sequence
  Synthetic sequence.
RELEEARERVKRLNEENKEFSRRVAEEVKKLNEENERTSKKVEDEVRKLNEDLRKKV

SEQ ID NO: 9497 - protein, 59 aa, Artificial Sequence
  Synthetic sequence.
EETIKRVLEELTRIMDRNRKDLRRVLEENKKLHDENRKELKRVLDENRRLHEEVKKRAK

SEQ ID NO: 9498 - protein, 57 aa, Artificial Sequence
  Synthetic sequence.
SELERVKTEVEKLNRRNREATERVKEEVKKLDEENKKSSKRVEDEVRKILDELRKKV

SEQ ID NO: 9499 - protein, 59 aa, Artificial Sequence
  Synthetic sequence.
REELERMLKRLKEIIERNEERLKEVLDRIRELIERNKELLRRVLKRIRDLVKELKERAD

SEQ ID NO: 9500 - protein, 57 aa, Artificial Sequence
  Synthetic sequence.
RELEEVERRVRELNEDNRRKTEEVKREVKRIDDDNRRASERAAREVKKLNKDLKDKV

SEQ ID NO: 9501 - protein, 59 aa, Artificial Sequence
  Synthetic sequence.
EKTLEDMLRRLKEIIKRNKDELEKVLRDIKKLVDDNKRDLERVLRRNEELHRELLERAR

SEQ ID NO: 9502 - protein, 57 aa, Artificial Sequence
  Synthetic sequence.
DELERAKEEIERLNDELKKSLEEVEKEVEKLDDDNRRTSRRVSEEVKRLNKELEDEV

SEQ ID NO: 9503 - protein, 59 aa, Artificial Sequence
  Synthetic sequence.
RDTIRKVLKENEDLIRKLEEILKKVLDEIRRLIEDNKRELEDMLRKNKELHDRLRERAR

SEQ ID NO: 9504 - protein, 57 aa, Artificial Sequence
  Synthetic sequence.
SELEEVKKEVEKLDERNKRLSKRVEEEVRKLNEENKRATERIKREVEKILEDLRRKV

SEQ ID NO: 9505 - protein, 59 aa, Artificial Sequence
  Synthetic sequence.
REELKRMLDRLRRIIEENERKLKEVLDRLRDIIRKNKEDLKRALERIKKLVEDLKRRAT

SEQ ID NO: 9506 - protein, 59 aa, Artificial Sequence
  Synthetic sequence.
SDLERVLDEIRRLAKEVKDTLRRMLEKNEELSKRDEDKTREMLKEIERLVKELEEIADK

SEQ ID NO: 9507 - protein, 59 aa, Artificial Sequence
  Synthetic sequence.
DDRLRKAEEEIKEIERDLKRTLDEVAKEVKRTIDRNRETSKRAAREVEKLLEKLREKTR

SEQ ID NO: 9508 - protein, 59 aa, Artificial Sequence
  Synthetic sequence.
SDLERMLREIRKLVEDDKRRTREMLRDNERLSREDKKKTDDVLRRLEELVRRLEEILKK

SEQ ID NO: 9509 - protein, 59 aa, Artificial Sequence
  Synthetic sequence.
DKRLDDIRRAIEEIIRDLRRASKKASEDVERTIERNERTSEEAKRRIEELIERLRRTDK

SEQ ID NO: 9510 - protein, 59 aa, Artificial Sequence
  Synthetic sequence.
SDLEEALKRVEKLVRDDKEKTKRMLERNRELVKRNKEKNKRMLDEIRRLVEELEDILRR

SEQ ID NO: 9511 - protein, 59 aa, Artificial Sequence
  Synthetic sequence.
DKRLKEVEDAVREILKDLKRTSERAKEEIERTIRDNERVVRRLEEEARKILEDLERRDK

SEQ ID NO: 9512 - protein, 59 aa, Artificial Sequence
  Synthetic sequence.
SRIEELLKTVEKLVDEVKKALRKLLEENKDLARKSKESLERLLDEVRDLVRRLEEILDR

SEQ ID NO: 9513 - protein, 59 aa, Artificial Sequence
  Synthetic sequence.
KDKLERVMRTLDEILKDLERTVERVKRALDESNRDLRREHERIKKELDKILDRLREKAR

SEQ ID NO: 9514 - protein, 56 aa, Artificial Sequence
  Synthetic sequence.
SEVERLKEELDKLHKENREVLEDSKRSLDKILDDVRKLAEDVKKRLDDILKELRDR

SEQ ID NO: 9515 - protein, 59 aa, Artificial Sequence
  Synthetic sequence.
RDLLRRLLREAERVSEETKKESKKLNDEIRKVLERLRDELRKIEDEIRKVVRRIRERAN

SEQ ID NO: 9516 - protein, 56 aa, Artificial Sequence
  Synthetic sequence.
DEVETLKKRLDKLHEDNKRDLERSKRSLEELLKELEEVVRRSEKTLDELLKKVEDQ

SEQ ID NO: 9517 - protein, 59 aa, Artificial Sequence
  Synthetic sequence.
RKLLKELEDTIRKVSDDTRRKSEELNEELKTVAEEIKKRSRELNEEAKDVLEKVERRTT

SEQ ID NO: 9518 - protein, 57 aa, Artificial Sequence
  Synthetic sequence.
DEVERAKEKLDKILEDLRDVVRRSKENLDRLHEENRETLERSKKNLDRLLEKVKKDG

SEQ ID NO: 9519 - protein, 59 aa, Artificial Sequence
  Synthetic sequence.
RRDIERILRELEKVLKKLTDESERLNREVERVSRDTKKKSKELNEELKRVLDEVKRKAD

SEQ ID NO: 9520 - protein, 60 aa, Artificial Sequence
  Synthetic sequence.
DEVREVLRELKKVVDDSKRDLDRVLREAERVVKESKDDIKRLLEETERVARDVERKIREN

SEQ ID NO: 9521 - protein, 55 aa, Artificial Sequence
  Synthetic sequence.
ETLDKEVKRLLKESKRAADELRERIKRLIEESKRLLDTVRREDKKILEKIERDLK

SEQ ID NO: 9522 - protein, 57 aa, Artificial Sequence
  Synthetic sequence.
DEIEKILEDLRRISEDTKRKHEEILRELEEILRELEERHRRILREVEEVARRLEERL

SEQ ID NO: 9523 - protein, 59 aa, Artificial Sequence
  Synthetic sequence.
EEKVKEVEREIRRLLKENEDASREVERLIEELKRRLDKISEDVERVLKKILERIDRATK

SEQ ID NO: 9524 - protein, 56 aa, Artificial Sequence
  Synthetic sequence.
RSVEEAEKVLEELKRRNERLNEEHRREVEKVREKNERLNKRHREDVERIKRELDKE

SEQ ID NO: 9525 - protein, 59 aa, Artificial Sequence
  Synthetic sequence.
DETIKDVLRKIKKISDETRKTLEDTLRELREISEKTRRRLDESLKELEEILRRLKEETR

SEQ ID NO: 9526 - protein, 60 aa, Artificial Sequence
  Synthetic sequence.
REAEEIRKEVEKLLRDLKRALDEHRETSRRLVEELKDILRKNREEVERLVREIREVIKRV

SEQ ID NO: 9527 - protein, 55 aa, Artificial Sequence
  Synthetic sequence.
RELIEEITRIVEKAKKELREVSKRLREIVKKIKEDNDRSNKRLREIAKEIKDRLT

SEQ ID NO: 9528 - protein, 60 aa, Artificial Sequence
  Synthetic sequence.
SEREEARERVKDLSRKLKEINERSEKHLRDLAKENRDANRRTREEVERLLDKIRKVIKDV

SEQ ID NO: 9529 - protein, 55 aa, Artificial Sequence
  Synthetic sequence.
EELIRELEKIVRDAEKKNRDVNREVRKILEDSKRELEKVLRDLERKVREIEKELK

SEQ ID NO: 9530 - protein, 61 aa, Artificial Sequence
  Synthetic sequence.
RELEEVLKKLKEDAERLKRILEEATRELEKILERLHRLNEKSTEELRRIVKDLKEELKRRG

SEQ ID NO: 9531 - protein, 55 aa, Artificial Sequence
  Synthetic sequence.
EEVEKTVRKLEEDLKRAIEKHEEDSRRLVKRLKESNDEHEKESRRLVRELEKEIE

SEQ ID NO: 9532 - protein, 59 aa, Artificial Sequence
  Synthetic sequence.
DEVREVIKTVRKLLEDLHRTNREVIERVKRTSEETHRKNEDMLRRLRKLVEDLKETLDR

SEQ ID NO: 9533 - protein, 59 aa, Artificial Sequence
  Synthetic sequence.
EKSLRDAEREVKKLLEELKRSLDKLREDVERLLRENKESLDRLREEVKKIERELREKTR

SEQ ID NO: 9534 - protein, 59 aa, Artificial Sequence
  Synthetic sequence.
SDVDRVLEELRKLVEELHRRNRKIIEDLRRASEKTHRKNRDLLEKAKKLADELREIAER

SEQ ID NO: 9535 - protein, 59 aa, Artificial Sequence
  Synthetic sequence.
KDELRRLEEAAKKILDDLEDSLRKLEEAVKDLKRKNKKSLDDLAEAAKDILRRLAETAR

SEQ ID NO: 9536 - protein, 59 aa, Artificial Sequence
  Synthetic sequence.
DEAEEVIKTVKRLLDELHRRNEEAIKEDRRLVEELHRTNEKVLREVEELVKRLAEILRR

SEQ ID NO: 9537 - protein, 59 aa, Artificial Sequence
  Synthetic sequence.
KETLDRLRERAEELKRRLEKSLRDLNRDNERTKRELRESLRKLEETARRLKEEIDRRTK

SEQ ID NO: 9538 - protein, 60 aa, Artificial Sequence
  Synthetic sequence.
DEADDLIRRVRELVKRVKEALEDLLRRNKDVLRKVKEELEKITRRNRDKVRRVEEELKRI

SEQ ID NO: 9539 - protein, 59 aa, Artificial Sequence
  Synthetic sequence.
SRKLEELRKEVEKLKEELDRVLEEARKEVEKSNRELKEVLERHAEDNERIKRRLDEARR

SEQ ID NO: 9540 - protein, 60 aa, Artificial Sequence
  Synthetic sequence.
SELERLLDEVDRIVREIEERLRDILRKNRELSEDSERKLRELLREVRDLVRRIMDELRRT

SEQ ID NO: 9541 - protein, 59 aa, Artificial Sequence
  Synthetic sequence.
REKLEEARRRIDEIRRRLEELLKRAREDSDRSNKRNKDLLREIEEELKKLKRELDEETR

SEQ ID NO: 9542 - protein, 60 aa, Artificial Sequence
  Synthetic sequence.
SLKEKVKKVIEDLKRAIDDLLRKVREESKKSNDHIRKLLEDSERTLRDLARRIKKLKDDG

SEQ ID NO: 9543 - protein, 59 aa, Artificial Sequence
  Synthetic sequence.
ARLIKEVIEEAERLLREIAKRIRKVIEEDRDLNRRIAKKLDELNRRAEELLKRIADRAK

SEQ ID NO: 9544 - protein, 59 aa, Artificial Sequence
  Synthetic sequence.
SSKETVKDVLRKITKRIRDLVRESKKTSDESNKHIKELLERSKKTIDELERRIEDLRRR

SEQ ID NO: 9545 - protein, 59 aa, Artificial Sequence
  Synthetic sequence.
EELLRRLIKELEDLMREIERKLRELNERDKRLNEEIAKKLEKLNRDARKLVEEIERRAR

SEQ ID NO: 9546 - protein, 59 aa, Artificial Sequence
  Synthetic sequence.
KLREDLEEMLRRSEKHIRDLVKRSEETSRDSNRHIEKLLKDSRKTIEDLKRKIEDLARK

SEQ ID NO: 9547 - protein, 59 aa, Artificial Sequence
  Synthetic sequence.
RELLERLIRELKRLNEEIAKKLEDLNREDRRLNEEIAKRLRDLNEELKKLVEDIERRAR

SEQ ID NO: 9548 - protein, 60 aa, Artificial Sequence
  Synthetic sequence.
RSKEEVDKMLERLRERIEKLVEESRKTSKESNEHLEKLFRESEETIKELKKRIEDLRRKG

SEQ ID NO: 9549 - protein, 59 aa, Artificial Sequence
  Synthetic sequence.
EDLLEKLIRELEELIRRIEKKLRDLNREDRELNKRIADEIERLNREARRLIEEIRKRAE

SEQ ID NO: 9550 - protein, 59 aa, Artificial Sequence
  Synthetic sequence.
SLEEEVRREIERSRRHIEKLVRDSERTSKESNKHIKKLLDESKRTLDEIRKRIEDLARK

SEQ ID NO: 9551 - protein, 59 aa, Artificial Sequence
  Synthetic sequence.
REVLKELIRELRRLNEEIRKKLEKLNDEDRRLNEEIRRKLEEINEELRRLVREIEERAR

SEQ ID NO: 9552 - protein, 60 aa, Artificial Sequence
  Synthetic sequence.
SLEETVEEVLRRLRRKIEKLVTESEETIRRSKKHIEEVLEKSKRTLDKIKEDIDRLRKEG

SEQ ID NO: 9553 - protein, 59 aa, Artificial Sequence
  Synthetic sequence.
REVLKELIDRARELIERIARKLTELNKENRKLNEEIARRVEELNKELKRLLKEIEDRAR

SEQ ID NO: 9554 - protein, 60 aa, Artificial Sequence
  Synthetic sequence.
STKETVARELERSRKHLEDSFREAERAIKESEEHIRELLERSRRTLKEIEDRIRDLRRRG

SEQ ID NO: 9555 - protein, 59 aa, Artificial Sequence
  Synthetic sequence.
ERLLRELIEELRRLNRKIHEDNRRLIEDNKRLNEEIKRELDKLNRELERETEEIKKRAD

SEQ ID NO: 9556 - protein, 57 aa, Artificial Sequence
  Synthetic sequence.
SVRETLREVLKESKKHLDDLVRRVKEEIERSKKHIDDLIRRNKESLDDIRRTVEEKI

SEQ ID NO: 9557 - protein, 59 aa, Artificial Sequence
  Synthetic sequence.
SDLVRELIKRLKEINDRVAERIKDIIRKVREANKDLERKLRELNKRSRDVLEEVVRAEE

SEQ ID NO: 9558 - protein, 57 aa, Artificial Sequence
  Synthetic sequence.
SAAEEAEKASKDSEKHIKDLIRRLREVSEESRRHLRRLIEENKRSLEEIEKEVRKKV

SEQ ID NO: 9559 - protein, 59 aa, Artificial Sequence
  Synthetic sequence.
TELIKRIIDRNREINRRVAEAIKKIIKDNRDINEDLERKLRKLNEESKRVLDDVVRREK

SEQ ID NO: 9560 - protein, 57 aa, Artificial Sequence
  Synthetic sequence.
SVEERLKDELRKSEEHLRRLIRELEKALEDSKRHADRLIKENRDSLRRIEDKARKKI

SEQ ID NO: 9561 - protein, 59 aa, Artificial Sequence
  Synthetic sequence.
DETVKRIIEENRRINEDLARKIKEIIRDNKRFNEEVEEKLKRLNDTSEEILRRLVRRDE

SEQ ID NO: 9562 - protein, 57 aa, Artificial Sequence
  Synthetic sequence.
SVDKELEEVIRRSKDHLEKLIKEAEDALKRSEEHLRKLIEEVKRRLEEVEKRVREKV

SEQ ID NO: 9563 - protein, 59 aa, Artificial Sequence
  Synthetic sequence.
SELIKRLIKENKEINEKLAREIEEIIKENKRINDELKKRLEELIERLERILEEVERRER

SEQ ID NO: 9564 - protein, 57 aa, Artificial Sequence
  Synthetic sequence.
SVDRTLEEVIKDSRRHVKELIDRLEKVIKESEENVKRTVDDNERSLKEIADTVRREI

SEQ ID NO: 9565 - protein, 59 aa, Artificial Sequence
  Synthetic sequence.
SEDIKRLIDTNRKINRDVAETIKEIIKEVRKINKEIDDKARELNKESRRVLEEVVRAER

SEQ ID NO: 9566 - protein, 57 aa, Artificial Sequence
  Synthetic sequence.
SVAETLRKVLKESEENVKRTVDRAEEELKKSEEHLRRLVERLKEVLEDVRRRVEEEV

SEQ ID NO: 9567 - protein, 59 aa, Artificial Sequence
  Synthetic sequence.
DERVERIIRELREVNERLDREVERLIRENREINRRLAEEIKDLIRRLREILREVVERAK

SEQ ID NO: 9568 - protein, 57 aa, Artificial Sequence
  Synthetic sequence.
SIAEKVEKVLKESKENLDETIRRAEEDLKRSRDHLRKLIEENKRSLDRIKEEVDRRI

SEQ ID NO: 9569 - protein, 59 aa, Artificial Sequence
  Synthetic sequence.
SDAIEKLITDLRKINEEADRKVKEIIKRNRDINKKVEDDLRELNKESTTVLREVVERER

SEQ ID NO: 9570 - protein, 60 aa, Artificial Sequence
  Synthetic sequence.
SELEKIIEDARRVLEEDERRNREVNRKLRKILEDNERLNREVNKRLREILKRLKEELKRL

SEQ ID NO: 9571 - protein, 55 aa, Artificial Sequence
  Synthetic sequence.
EEAKRALDKIREDVRKILEDTKRELEDVRRRVEEILRETREELKRVEDDVKRAED

SEQ ID NO: 9572 - protein, 60 aa, Artificial Sequence
  Synthetic sequence.
SELEDIIRKLDEILKRNEEENRRVIRRLRELLEEDERRNRKAIEDLERIITKLKDDVRKL

SEQ ID NO: 9573 - protein, 55 aa, Artificial Sequence
  Synthetic sequence.
RDAERRIREVEEEVKRILEETEEVLRDVKRRVDEILKTTEDRIREIEEEIKRTVK

SEQ ID NO: 9574 - protein, 60 aa, Artificial Sequence
  Synthetic sequence.
DELRDIIRELRDILRENKKRNEDAIRKLRKILKENEKKNRDAIRELEDILEKLRKEIEDL

SEQ ID NO: 9575 - protein, 55 aa, Artificial Sequence
  Synthetic sequence.
RKVEEDIKRVEEEVKKILDKTDEELKEVERRVRKILRETEEELKRVEDEVRRAKT

SEQ ID NO: 9576 - protein, 60 aa, Artificial Sequence
  Synthetic sequence.
REEEKARRVMEKLKRDVDRINTRHRDILKKIEDEVRRIDEEHKTEVKKIKDRAEEIIRRI

SEQ ID NO: 9577 - protein, 55 aa, Artificial Sequence
  Synthetic sequence.
KDLIREVEKILKDIEDLVRESERELREILKDIKRMVDESLKRLEDILRELEERTR

SEQ ID NO: 9578 - protein, 60 aa, Artificial Sequence
  Synthetic sequence.
REEEEMRKVVKDLEDAARELDRDHETKLRRIEEEVKKLNEEHKRELERIARRIKEIIDRI

SEQ ID NO: 9579 - protein, 55 aa, Artificial Sequence
  Synthetic sequence.
KDLIRRLEEILRRIARELEDSLRKLEKILEEIKEIVKKSLDELRRIVDELEKRVR

SEQ ID NO: 9580 - protein, 60 aa, Artificial Sequence
  Synthetic sequence.
SEEEEVRRVLKRIAEEVKRLDEDHRRILEEIRKKVEKSSRDHKRELDKIKRDADEIIRRI

SEQ ID NO: 9581 - protein, 55 aa, Artificial Sequence
  Synthetic sequence.
KDLIKKLEEILEEIRRLLEESLRELEDILKKVHDRNARTLERLREILKEIEDRAR

SEQ ID NO: 9582 - protein, 60 aa, Artificial Sequence
  Synthetic sequence.
DEKRKVDKRLKEIEETIRRLLEEHRRELDEIRKRIEEISRRHRKELEDIEREVRKIISRI

SEQ ID NO: 9583 - protein, 55 aa, Artificial Sequence
  Synthetic sequence.
EDLIRDVERVMREVKRDLERSLEELRDVVRRAEEEVRATLRKLREILKKVEDETR

SEQ ID NO: 9584 - protein, 60 aa, Artificial Sequence
  Synthetic sequence.
SEEETMRKVVKEIREKVRRISERHKEELERITDALRRSSKRHEDELREIEKAVREIIRRI

SEQ ID NO: 9585 - protein, 55 aa, Artificial Sequence
  Synthetic sequence.
DKLIRELEEILERLEREVRKSLDRLRKILEDIHRTNKDTLDRLREILKKVEDRTR

SEQ ID NO: 9586 - protein, 59 aa, Artificial Sequence
  Synthetic sequence.
SEVEEVIRRLEELVDRLHKINKRAIEENERLNRELHEKNRDIIRKLKELVERLRDIKEK

SEQ ID NO: 9587 - protein, 59 aa, Artificial Sequence
  Synthetic sequence.
KETADRARDEVRRIEKELDDSLRELEKRVRDSKRHLDRSLEELEKVVDEIRKELEDLAK

SEQ ID NO: 9588 - protein, 59 aa, Artificial Sequence
  Synthetic sequence.
KEVEEVIKRLRELVDRLEKENRDVNEDNKRLNEELHDRNRKMIEELRRLVTELEDIRRK

SEQ ID NO: 9589 - protein, 59 aa, Artificial Sequence
  Synthetic sequence.
KDLLKRVEDEARKIEEKLKRIHEETKKVADDSERHLRKSLRELEKVAREIKKRLEEERK

SEQ ID NO: 9590 - protein, 59 aa, Artificial Sequence
  Synthetic sequence.
DEVREIIKDLRRLLKELEERNREINDRNKKLNDTLRKELEDIKRRLEKLLRELEKIVRE

SEQ ID NO: 9591 - protein, 59 aa, Artificial Sequence
  Synthetic sequence.
EEVLRRVEEEVRDIERRLDKIHEDTRDTAEKSERHLDALLRDLERVAREIEEALDRLKD

SEQ ID NO: 9592 - protein, 59 aa, Artificial Sequence
  Synthetic sequence.
SEVEEVIRRLRELLRTLEEENRKMIRENERLLEELKKRNEDIERELRKLVTELAKIADK

SEQ ID NO: 9593 - protein, 59 aa, Artificial Sequence
  Synthetic sequence.
EKLARELREVAERIKKRLDEIDETTRRMVTESIKRLEEIDKRTTERAREIKKELRDRAT

SEQ ID NO: 9594 - protein, 59 aa, Artificial Sequence
  Synthetic sequence.
SEVEDLIRRLEELLDRIRRDNERIIKELEELLRELEETNKRLIERIRKLLEDLRDTVRK

SEQ ID NO: 9595 - protein, 59 aa, Artificial Sequence
  Synthetic sequence.
EKLMREAKEAVDRIKKRLDEINKRTEDVARRIRKRLDEIDERTKEEAKRIKEELDKEEK

SEQ ID NO: 9596 - protein, 59 aa, Artificial Sequence
  Synthetic sequence.
SEVEELIERLKELLERLEELNRRVNEENRRLNEELERRIRKAIEDLKDLLRRLDDIRRR

SEQ ID NO: 9597 - protein, 59 aa, Artificial Sequence
  Synthetic sequence.
EKKLRELKEVVDRLKKEIKRIDEETRKEAERSKRNLEKILRDLEREAKRLKEEIDKKAR

SEQ ID NO: 9598 - protein, 59 aa, Artificial Sequence
  Synthetic sequence.
DEIRDLLRRLRELNKRIADRIRKLNEENKKLNKEVADKIRKLNREAREIIKTIAEIIKS

SEQ ID NO: 9599 - protein, 59 aa, Artificial Sequence
  Synthetic sequence.
KEVLDRAKEEVDRSRKHLKELLDRSRETSDRSRRHLKDLMRRSRETIRKLDEELKRLEK

SEQ ID NO: 9600 - protein, 59 aa, Artificial Sequence
  Synthetic sequence.
SEIEKLIREAERIIEEIAKEIKDLNEENERLNREVDKRLTDLNRRAKELLEEVKRIIDR

SEQ ID NO: 9601 - protein, 59 aa, Artificial Sequence
  Synthetic sequence.
EEKLRDARREIERLRRELEKLLEDSRRTSEESRRNLERSLDESRKTIEELIKRLDDAER

SEQ ID NO: 9602 - protein, 59 aa, Artificial Sequence
  Synthetic sequence.
SEIEKLIEDAKRILEEVARRLKKINEDNDRLVRKIADELRRLIEEAKKILDEIKKIIED

SEQ ID NO: 9603 - protein, 59 aa, Artificial Sequence
  Synthetic sequence.
EDVLREVRKVIKKLRDELEELARRSRKTSEDSRKRLDDLLKRAREVIEELKKRLEDLRR

SEQ ID NO: 9604 - protein, 59 aa, Artificial Sequence
  Synthetic sequence.
KDIEKLIKDLEKLNRDIAKRIRDLNETNKKLVRDVAEEIKRLNEELKKLLEDIRRIIER

SEQ ID NO: 9605 - protein, 59 aa, Artificial Sequence
  Synthetic sequence.
EEVLKRAREMVKRSKEHLDELLKRSEDTSRESKRRLEKLLKESEDTIRRLEEELKKAEK

SEQ ID NO: 9606 - protein, 59 aa, Artificial Sequence
  Synthetic sequence.
KEIEELLEEIERILREIKKDLERINKENEKLNREVKKKIEDLIREVRKIIEEIRRIIER

SEQ ID NO: 9607 - protein, 59 aa, Artificial Sequence
  Synthetic sequence.
ERKLKEVRDTIEELKKRLEKLAKESRDTSRRSRENLERLAREFREEIKRLKKELEEART

SEQ ID NO: 9608 - protein, 59 aa, Artificial Sequence
  Synthetic sequence.
SEIEKLIRDAEKILEEIAELIKRLNEENKELNERVAKRIKDLNEELRRLLKEIADIIRR

SEQ ID NO: 9609 - protein, 59 aa, Artificial Sequence
  Synthetic sequence.
REELEKVRKVIDKLREELKRLERESERTSEESRRNLERLLRESRKTVEEIKKRLDELRK

SEQ ID NO: 9610 - protein, 59 aa, Artificial Sequence
  Synthetic sequence.
SDIERLIAELEKLNKEIEDKIRELNRENRRLNKEIDEEIERLIEEARKIIEDIREIIRR

SEQ ID NO: 9611 - protein, 59 aa, Artificial Sequence
  Synthetic sequence.
RKKVEEARKKIEDSKRHLEELLRDSRRTVKESNDNLRRSAEKARREIKRLEEALKELRR

SEQ ID NO: 9612 - protein, 60 aa, Artificial Sequence
  Synthetic sequence.
DEVEKVVRELEEVLRRNKELLEKTKKETKEALDRNRELLEDTKRKTREILERLKKVIKEG

SEQ ID NO: 9613 - protein, 59 aa, Artificial Sequence
  Synthetic sequence.
EEVVKRLRDILRRVKEAAEELHRDDERELRRVEKELEELHKDDRRVVEEVKDDVRKAEK

SEQ ID NO: 9614 - protein, 60 aa, Artificial Sequence
  Synthetic sequence.
SDAERVVRELRKILKEIEDTIRKSKKETKEMLDRNRELARKVKEELKEILRRLEKMKRDG

SEQ ID NO: 9615 - protein, 59 aa, Artificial Sequence
  Synthetic sequence.
ERLLRELRRIVEEVKRAVEELNRDDRRTLERVKREAKKIHEDLRRVVEKLERDVEEARR

SEQ ID NO: 9616 - protein, 60 aa, Artificial Sequence
  Synthetic sequence.
DEVEKLKRELDKILEDLERLHRRLEEELRRIHEENRDLSRRTKEELDRILKRIEELLRER

SEQ ID NO: 9617 - protein, 59 aa, Artificial Sequence
  Synthetic sequence.
EKVLEELRRILRRVEEAVRRLNERSEEVLRDVERRDEELNEDNKRRLEEVKKRVEDLLR

SEQ ID NO: 9618 - protein, 60 aa, Artificial Sequence
  Synthetic sequence.
SELDELKKSLEEIHRRDREKNRKLKEDLKRILDEIRKRLEESKKRLEEILREIERLLRER

SEQ ID NO: 9619 - protein, 59 aa, Artificial Sequence
  Synthetic sequence.
EKALKELRKILEDVARANEELNRDTRRTLERVEEEVEKLNRDHKRVLEKVERDVRRLTK

SEQ ID NO: 9620 - protein, 60 aa, Artificial Sequence
  Synthetic sequence.
SEVERLKEELKRILEEIKKLVDDSKKDLERIHREDKKKNEDLKKRAEEILREIRDLLTKR

SEQ ID NO: 9621 - protein, 59 aa, Artificial Sequence
  Synthetic sequence.
EKLLRDLRRVLEEVKRAVDEISKDHKRMLDAVKKANEELNDDSRRVLERVDREVKKAEK

SEQ ID NO: 9622 - protein, 61 aa, Artificial Sequence
  Synthetic sequence.
SELDRVREEAKRIDDENRKRSEDSVRDSERLLREIEELHRETKERSEELLKRVEEIVRDRG

SEQ ID NO: 9623 - protein, 59 aa, Artificial Sequence
  Synthetic sequence.
DRLLEELEKVLRESARRNERIITENRRTMKRVSEEVEKLNRDDKRRMEELEKRAREIIT

SEQ ID NO: 9624 - protein, 61 aa, Artificial Sequence
  Synthetic sequence.
SELERAVEELEKLLKELEDLHRKSKEDSKDMLRRVEELHRRTKEKSKRILEEIERRITEEG

SEQ ID NO: 9625 - protein, 59 aa, Artificial Sequence
  Synthetic sequence.
DELMRKLEEILKRVAEAIKRLIDDDRRVLKRVAEEVKKLNEDDKRVADEVSERIKERLT

SEQ ID NO: 9626 - protein, 61 aa, Artificial Sequence
  Synthetic sequence.
DELEEAEERLREIDKRNEDLHEESRKESKRLLDELRKLVEDVKRELEKILEEAKDIVRKRG

SEQ ID NO: 9627 - protein, 59 aa, Artificial Sequence
  Synthetic sequence.
KEKLEKLRDVLRESERRNRELIEEDKEVMRRVSEEVKKLIDDLRRALEKAARDVEKIRR

SEQ ID NO: 9628 - protein, 61 aa, Artificial Sequence
  Synthetic sequence.
SELEDAERRAEEIDRRNKRTVERVEEELEKILREVEELHRRTEEKSKRILDEIRRKIRDRG

SEQ ID NO: 9629 - protein, 59 aa, Artificial Sequence
  Synthetic sequence.
KELADKLRDVLRRSAEENKKIIDRLRKILEDVARAVEELIKRDKRVMEEVKKEIDKLLT

SEQ ID NO: 9630 - protein, 58 aa, Artificial Sequence
  Synthetic sequence.
SEVEEIKKRARKLLEEVREIVDRVKKLHERLLREIEKTNREAKREHKRVLDTIRDIFR

SEQ ID NO: 9631 - protein, 58 aa, Artificial Sequence
  Synthetic sequence.
ETVADLDREIRRLKDELRRILEDLRRVSEEVKKELEKLTRDTRRVSKEVKDELKKVEK

SEQ ID NO: 9632 - protein, 60 aa, Artificial Sequence
  Synthetic sequence.
REVDEIKKRLTEMLETVRKIVEEIRRELEKLLEDVREINERVKEEHERILKDIRDVARKI

SEQ ID NO: 9633 - protein, 58 aa, Artificial Sequence
  Synthetic sequence.
ETMEDLKRRVREVEKRLEEILRRLDDVVRKIKEELKKLTDDTRRVSKRVKDDLERTRT

SEQ ID NO: 9634 - protein, 58 aa, Artificial Sequence
  Synthetic sequence.
SRVEEIKKELRRLLEEVRKKNEESKERDRRLNDTIRRELEEIIRRLRKLLEEIRRLRE

SEQ ID NO: 9635 - protein, 58 aa, Artificial Sequence
  Synthetic sequence.
RTVEDLRRVVEKVLRDIKRSIDDVRRENKKSNEDARRWLEELKREVKRLKDELREIEK

SEQ ID NO: 9636 - protein, 59 aa, Artificial Sequence
  Synthetic sequence.
SEVERIKRELERLLKEVKDANKRVKDTLRKLLRDVEEMNRRVKRENHELLRRLDELVKA

SEQ ID NO: 9637 - protein, 59 aa, Artificial Sequence
  Synthetic sequence.
EELLKDVRKVAKEVEEELKKLHDDTKRVADKVKEDLDRLHRDSERNARRSEEEMDKRRK

SEQ ID NO: 9638 - protein, 59 aa, Artificial Sequence
  Synthetic sequence.
DRVREVKERLKKLLEEVERTNREVMERNHRLLEDVERKNRRVKEENHRLLEELKRLRED

SEQ ID NO: 9639 - protein, 59 aa, Artificial Sequence
  Synthetic sequence.
ERLLEDVERTAERVERELDRLHEETKRNADRSREELEKLHRDSEKNARDSAKELEKIRR

SEQ ID NO: 9640 - protein, 59 aa, Artificial Sequence
  Synthetic sequence.
DEVERAEEELERLLRELKKLHEDAKERARELLKRIEDVNRKVKEELKRLLDTIRKLREA

SEQ ID NO: 9641 - protein, 59 aa, Artificial Sequence
  Synthetic sequence.
KDLLEKVKRVVEEVHKRSRELNEDTRRVIDKVEKDLDELHRDSRRVVETVKEELEKLRK

SEQ ID NO: 9642 - protein, 59 aa, Artificial Sequence
  Synthetic sequence.
KEVEEVKRRLREVLKRLKEMHERVKRELEKLLKKVEDFNRDVKRKNHDLLRRLEELKKA

SEQ ID NO: 9643 - protein, 59 aa, Artificial Sequence
  Synthetic sequence.
KDLLEDVEREARRLHDESRKLNEDTKRVVDTVTEELKKLHRDSERNAKRSEEEMDKRRK

SEQ ID NO: 9644 - protein, 59 aa, Artificial Sequence
  Synthetic sequence.
DEVERVKETLDKLLDDVRKLNEEVKKRLEELLEKVERDNRKVKEDNHRLLEEVKDLKRR

SEQ ID NO: 9645 - protein, 59 aa, Artificial Sequence
  Synthetic sequence.
KDLLEDVERRAKRVEEELDKLHEDTRREADRVRRDLRRLDEDTKRNVDESRKELEKTRK

SEQ ID NO: 9646 - protein, 60 aa, Artificial Sequence
  Synthetic sequence.
SEVEEVIRRIRALVEEIARKNEDILRKNRKLLEDLRELVERVIKEIKELIDRLADEVRRV

SEQ ID NO: 9647 - protein, 59 aa, Artificial Sequence
  Synthetic sequence.
DRVRKEVEEVLRDVEERIRRLDEEVRRRAEESERELERLREKVEDMIEKVKRALEELRR

SEQ ID NO: 9648 - protein, 60 aa, Artificial Sequence
  Synthetic sequence.
SELEEIIKKLRKLVEDVARRNEELIKKLEETNKRLEDEVRELIEEIKKLIDELAETVKRI

SEQ ID NO: 9649 - protein, 59 aa, Artificial Sequence
  Synthetic sequence.
EEMKKRLRDVAEKLKEDVRDLDRKVKKVAKESHERNRRILKELEEVAARVTERLEELRR

SEQ ID NO: 9650 - protein, 55 aa, Artificial Sequence
  Synthetic sequence.
DEDERVDEVIKKVREDLRKLLEDSERVVKRSKEELDRWRKKVEDVMRDSDRRLEE

SEQ ID NO: 9651 - protein, 55 aa, Artificial Sequence
  Synthetic sequence.
EEVIKELKKLIDKLREDSKKTIEENKKMNKDAADEIEKIIEDNRRLIKRIEEEDR

SEQ ID NO: 9652 - protein, 55 aa, Artificial Sequence
  Synthetic sequence.
SEDERVEEVVKRIEDKLRRLLEESKRVVDDSKRRLDEWRKEVEKVVKKSTDDLEK

SEQ ID NO: 9653 - protein, 55 aa, Artificial Sequence
  Synthetic sequence.
EEVIKELEELIERLARISKKTIEEDRRVNKELAERIKEIIERNRRVIEEARERLR

SEQ ID NO: 9654 - protein, 59 aa, Artificial Sequence
  Synthetic sequence.
KELEELIEELERLNREINERAKELIKKLRKLNEEVARRHERLIEELRRILEELKELLER

SEQ ID NO: 9655 - protein, 59 aa, Artificial Sequence
  Synthetic sequence.
EELRRRAKRVLEESKRNIEKVAEDVTRVLRESEESLERLRERSERVLREVEKTIRDMAR

SEQ ID NO: 9656 - protein, 59 aa, Artificial Sequence
  Synthetic sequence.
SEVERLIEELDELNRRINEKHKKLRRELEELNKRVAERHEELIRRLRKLLEDLERLARR

SEQ ID NO: 9657 - protein, 59 aa, Artificial Sequence
  Synthetic sequence.
EELRKRVEDALRRSKENIKRLEEESREVLRRSEKSIDELRRESERVLKEVKEEIERVRK

SEQ ID NO: 9658 - protein, 59 aa, Artificial Sequence
  Synthetic sequence.
SELEELIKELRDLNRRINKRVDDLADELRRLNERINRRHEELIKELRRLLEDLKRKFDR

SEQ ID NO: 9659 - protein, 59 aa, Artificial Sequence
  Synthetic sequence.
EELKKRADDVLRESKENIERVERKIRRVLEESEENIEDLRRRSKEVLDEVRKRIEDIRR

SEQ ID NO: 9660 - protein, 59 aa, Artificial Sequence
  Synthetic sequence.
SELEELIRRLKELNKDVNEKHKRLIEELEKLNRDINERHKELIEELERLLRRLEKLLRD

SEQ ID NO: 9661 - protein, 59 aa, Artificial Sequence
  Synthetic sequence.
EDLRREAERVLRESEENIKELEDRSRDALRRSEENIRRLKKESEDVLREARREVERLER

SEQ ID NO: 9662 - protein, 59 aa, Artificial Sequence
  Synthetic sequence.
SLEEELDKVLKESRDNVRRVEEELEEVMEKSERAAEKLRRDLDRVLEELEKMIRDLKRR

SEQ ID NO: 9663 - protein, 59 aa, Artificial Sequence
  Synthetic sequence.
REDIKRVIDTLRKLNERLNREVKEVIKRNEELVRRLAERVKKVVEDLRRLVKRLDDEVR

SEQ ID NO: 9664 - protein, 60 aa, Artificial Sequence
  Synthetic sequence.
SLEETLKEVLRKSEENAERLKRELEKVLRKLEEDLRRLDERLDEVLKRSRDEARKLREAD

SEQ ID NO: 9665 - protein, 59 aa, Artificial Sequence
  Synthetic sequence.
REVIKRVIEDLDRLNDELNKEVEEVIRRLEDIVRELEKKIREVIKRNKELVDRLEEKVR

SEQ ID NO: 9666 - protein, 59 aa, Artificial Sequence
  Synthetic sequence.
DLEKRLRDVLKESDENIEELRRELREVLKESEDNVKKLAEENKEVTDRLREEIKRLKEE

SEQ ID NO: 9667 - protein, 59 aa, Artificial Sequence
  Synthetic sequence.
KEEIERVIRELKDLNRRLNEELKRAIKRIKELNKRLNELSKRSIDELRRLVEELERRVK

SEQ ID NO: 9668 - protein, 61 aa, Artificial Sequence
  Synthetic sequence.
SLKEKLEEVLRRSEENVERLRKENEDVAKKNREAIEEIKKRLDDVLRELRERIERLKKEGV

SEQ ID NO: 9669 - protein, 59 aa, Artificial Sequence
  Synthetic sequence.
EEVIDRAVEELKKLNDDLNRTVKKVIRESEELTETLRKDVKRVVDDLRRLVEELARRVK

SEQ ID NO: 9670 - protein, 59 aa, Artificial Sequence
  Synthetic sequence.
DLEEELKEVLKESEENIERLKRENDRVVEKNKKAVDDLRERNKRVTERLREEIERLKRR

SEQ ID NO: 9671 - protein, 59 aa, Artificial Sequence
  Synthetic sequence.
KKDIKRVIDELRKLNEDLNRRVKEAIKTSEKITDDLRRMSEESEKELRELVRRLEERVR

SEQ ID NO: 9672 - protein, 60 aa, Artificial Sequence
  Synthetic sequence.
SEVEEIIRRIDELIKRLAETVKEIVDRLRKLNKKLNDENREIIKEIRDLIRELAKEVKRI

SEQ ID NO: 9673 - protein, 59 aa, Artificial Sequence
  Synthetic sequence.
EEVRERLERVLRRVEEVIKRLKEELKKVLDESRKNVEDVTRENEKVLDEVRKTIDELRR

SEQ ID NO: 9674 - protein, 60 aa, Artificial Sequence
  Synthetic sequence.
SEVEELIKTIERLIKELEKLNEEIIKRLRDLNKRLNERNEEIERTLRKLITDLARMVREV

SEQ ID NO: 9675 - protein, 59 aa, Artificial Sequence
  Synthetic sequence.
EEVLRRLEEVLDRVKKKIKTLTDKNREVLERSRENVKKVTEDNERVLRKLKEDIERLRK

SEQ ID NO: 9676 - protein, 60 aa, Artificial Sequence
  Synthetic sequence.
SELEEALKDIKRLIDKLRKDNEDIIRRLRETNDELRKLNKKIIDEIRDLIRRLEEVAKRI

SEQ ID NO: 9677 - protein, 59 aa, Artificial Sequence
  Synthetic sequence.
KDLKKRLEDVVKRVREEIEKLTRDNERVLEESRRTLEKLTRENEKVLREVKKKIDDLRK

SEQ ID NO: 9678 - protein, 60 aa, Artificial Sequence
  Synthetic sequence.
SELEDVEEKIKRLIDRLRELNKKIEDDLRKLAKELADLNKKIIREIEELIRRLAEVVKRI

SEQ ID NO: 9679 - protein, 59 aa, Artificial Sequence
  Synthetic sequence.
EELKRRLRKVLERVKREVEKSSERNREVVERLRKELERLTRENEEVLKRVKKEIERLEK

SEQ ID NO: 9680 - protein, 60 aa, Artificial Sequence
  Synthetic sequence.
SEVDEVIKRLDELIEELRKRNDDIIREIEKLIKRLEEENKEIVDRIRELIKRLEDMVRRL

SEQ ID NO: 9681 - protein, 59 aa, Artificial Sequence
  Synthetic sequence.
KDVLDRLREVLDRLRKEIERLTRKNEEVLKDVRRRVKRSSEENEKVLKEVRERIERLKK

SEQ ID NO: 9682 - protein, 60 aa, Artificial Sequence
  Synthetic sequence.
SDVDEVIKRLRELIRENHKRNKKIVDEIRELIRELKERNKKIVDEIRELIKRLKDIVRRL

SEQ ID NO: 9683 - protein, 59 aa, Artificial Sequence
  Synthetic sequence.
EEVLRRVEEVLRELREAIKRDDEENKKVLEEARKTVEDSSRENKRVLEEVRRRLDEERR

SEQ ID NO: 9684 - protein, 59 aa, Artificial Sequence
  Synthetic sequence.
SEKERAEEVFRESKKNIDDVKRKLERVLEDSKRTLDELRKEVEKVLKESEDELRKLARS

SEQ ID NO: 9685 - protein, 55 aa, Artificial Sequence
  Synthetic sequence.
EELIREIRELNKRLNDTIEDVIRRMKDLNRRLAEVIKEIIERNKKLIEDAARRIK

SEQ ID NO: 9686 - protein, 59 aa, Artificial Sequence
  Synthetic sequence.
REKERLKEVVEKSRRNLEKLREDSERVLEKSRRTLERLKKEVEEVLKESEERLRELARS

SEQ ID NO: 9687 - protein, 55 aa, Artificial Sequence
  Synthetic sequence.
EELIKTIEDINRRANEESKRTEKELEDINRKLEEDIKRIIDRNRKMIEDAARKIK

SEQ ID NO: 9688 - protein, 59 aa, Artificial Sequence
  Synthetic sequence.
REEERLEEVLRRAEEILKRLEDEVRKVVEDSKKNIEDVRREVEEVLKKSEDRLRKLARD

SEQ ID NO: 9689 - protein, 55 aa, Artificial Sequence
  Synthetic sequence.
EELEKRLKEILDRAAEEIRRIIRELEELNKEANDRIRKIIKENEDLIREAEERTR

SEQ ID NO: 9690 - protein, 59 aa, Artificial Sequence
  Synthetic sequence.
ELEERIKKANEDSKRTLRELMERVRKANEDSKRKLEEIREKVERANRESKKILDELRKA

SEQ ID NO: 9691 - protein, 59 aa, Artificial Sequence
  Synthetic sequence.
EKVIRELIKELKDVNRALEKKAKELIDELEEVDKDLEDKVRELIRKLKEVNEDLKRKAD

SEQ ID NO: 9692 - protein, 59 aa, Artificial Sequence
  Synthetic sequence.
SLKERVKKVLEESERNLEENKKDAKRVNDETRKKLKELEDRADRVNRETERALRELEDN

SEQ ID NO: 9693 - protein, 59 aa, Artificial Sequence
  Synthetic sequence.
EKVVREVIEELKRVNDKLNDASRRLNERLKRVVEDVERRVRDLNKELEDVVEELKERTR

SEQ ID NO: 9694 - protein, 59 aa, Artificial Sequence
  Synthetic sequence.
ELEERIKRVIDELRRRLEELRRELKRVNDKTEEDLRRLEDNARRVNDTSRKMLERLEDG

SEQ ID NO: 9695 - protein, 59 aa, Artificial Sequence
  Synthetic sequence.
ETVVREIIRELEKVIEELEREVRELNRELREVVERVAKKVRDLNRELEEVIRDVKRKVD

SEQ ID NO: 9696 - protein, 59 aa, Artificial Sequence
  Synthetic sequence.
SLEDEARELRRKSEKTNDELRRAIEELEKKVRDMIRRSEEHVRDLVRKVKRVIEKLEED

SEQ ID NO: 9697 - protein, 59 aa, Artificial Sequence
  Synthetic sequence.
RKDLEELIKELKKLNDESREEIERLIRELEELLKEIEDRNRKLAETLKRLLEEVEKRAR

SEQ ID NO: 9698 - protein, 60 aa, Artificial Sequence
  Synthetic sequence.
SIEEEIKELKDRSKKTNEELKKEIDELKEDSERTNRESRKHVKEVLDRLREILERLRREG

SEQ ID NO: 9699 - protein, 59 aa, Artificial Sequence
  Synthetic sequence.
RKEIKRLIDELTELNKRSKELIKRLIEELKKLNDDSRKENKRLVREVERLAEEVDRRVK

SEQ ID NO: 9700 - protein, 59 aa, Artificial Sequence
  Synthetic sequence.
SLEEKAKRLKEESDKTNKKLRELIERLERESRRTNEELRKKIRELLEDARRELDRLRKE

SEQ ID NO: 9701 - protein, 59 aa, Artificial Sequence
  Synthetic sequence.
EKKVEELRRDLERLDRESEKKIRDLIKTLDELNKESDRKIRKLEEELKRLLEEVEKRVR

SEQ ID NO: 9702 - protein, 59 aa, Artificial Sequence
  Synthetic sequence.
DIEKKIEDLRRKAKKVIDDLRKRSDELKKRSKDTNDRLREELKKLEEDVRRVIEDLRRR

SEQ ID NO: 9703 - protein, 59 aa, Artificial Sequence
  Synthetic sequence.
DKDIEKLIRDLEKLLRDVEERHEDLRRKAEELDRDTKEKVDRLIKELKDLLKEVRDRVR

SEQ ID NO: 9704 - protein, 60 aa, Artificial Sequence
  Synthetic sequence.
SLKEKLDDLVRKSDDTNKDLEEKARRLVEDAKRVLKELEDKSRRLVEEARKVLKRLEEEG

SEQ ID NO: 9705 - protein, 59 aa, Artificial Sequence
  Synthetic sequence.
DKKIKELIEELEDLDRRSKKAVEDLIKELKKLIDEVREIHDRLEEELRRLIKTVRDKAR

SEQ ID NO: 9706 - protein, 59 aa, Artificial Sequence
  Synthetic sequence.
SLEDKVRKLEEEIKKVLKEIREEVERLLEEDRRTLEDLKRRHRESDRESKEVLDEIAKK

SEQ ID NO: 9707 - protein, 59 aa, Artificial Sequence
  Synthetic sequence.
DKVIKEVIDTLRKRLEELKRRLEDVIREVRKANEDSERESRDVIRKLKELLERLKEKVK

SEQ ID NO: 9708 - protein, 60 aa, Artificial Sequence
  Synthetic sequence.
SEEEKLKEVKDRIREVLRKLEEHTDKVKKEVEKVLRDIRRTTDELKKEVRAMLERLRRKK

SEQ ID NO: 9709 - protein, 55 aa, Artificial Sequence
  Synthetic sequence.
DELVTEVEKLLRDDEETNRDVVKKVREAVKKDADTNRKVIEEVKKVLEDAARRLD

SEQ ID NO: 9710 - protein, 60 aa, Artificial Sequence
  Synthetic sequence.
SEEEKLERVERRLEKVLDEIRRHTEDVKRKDEENLDRLRKKIEKLKRELEKVLRDLEEKR

SEQ ID NO: 9711 - protein, 55 aa, Artificial Sequence
  Synthetic sequence.
DELVKKLEELLEEDKDTNRKVVKEIEDANRRVNEELDRVIEELKRILEELERRLR

SEQ ID NO: 9712 - protein, 59 aa, Artificial Sequence
  Synthetic sequence.
SEVDEVRKTLEDLLRRLDEENKDIIRRNKELLDDLDRKVREAIERLKRLLDELRKILEK

SEQ ID NO: 9713 - protein, 59 aa, Artificial Sequence
  Synthetic sequence.
EELARRITELEKRVREVIERLKEKNKRLEDDSRRVITELRKKLKDLEDRVREEIEELRK

SEQ ID NO: 9714 - protein, 58 aa, Artificial Sequence
  Synthetic sequence.
SEVERVKEELKRLLEDLDRKNKRMIDEDERLNKELNEENERLIRELEELLKRLKEIRD

SEQ ID NO: 9715 - protein, 59 aa, Artificial Sequence
  Synthetic sequence.
EEVKREIDKLREEIREVIERLDKKNEDVLRKSEKNVRDLNRENEEVLRRATEAVRELER

SEQ ID NO: 9716 - protein, 59 aa, Artificial Sequence
  Synthetic sequence.
DEVDKVTRTLEELLKRLEEENRKMIEDDKRLNEELNKENRRVEETLRKLLKELEDIRKD

SEQ ID NO: 9717 - protein, 59 aa, Artificial Sequence
  Synthetic sequence.
KEVKEKIDRLEKRIRDAIRELNERNKKALDDSERNVRELNKRNERLREEVERKIRELER

SEQ ID NO: 9718 - protein, 59 aa, Artificial Sequence
  Synthetic sequence.
SEVDEVAKRLRDLLRELEEKLKRAEDRDRKLNDDLNKTNKKLIKELEDLLRKLEEIARR

SEQ ID NO: 9719 - protein, 59 aa, Artificial Sequence
  Synthetic sequence.
DEVRRKIDELEREIKEVVDRLRRRLEELLRRSKENVDRLNRENDRVLEEAKRKIRELEK

SEQ ID NO: 9720 - protein, 59 aa, Artificial Sequence
  Synthetic sequence.
SEVDEVADRLEKRLKENRDKNKRVEDEDKRLNKELNDTNRRMEEELKRLLTEIDDIRRK

SEQ ID NO: 9721 - protein, 59 aa, Artificial Sequence
  Synthetic sequence.
EEVRKKIDELERRLKEVIDDSKRRNDELERESRENVRELNRRNKELEDEARKEVERAKK

SEQ ID NO: 9722 - protein, 59 aa, Artificial Sequence
  Synthetic sequence.
SRVDEVIERLERLLRELDKINRDMIEDDKRLNTELNKENKEVEDRLRRLLEELEEIRKK

SEQ ID NO: 9723 - protein, 59 aa, Artificial Sequence
  Synthetic sequence.
KEALDKIRRLEERARRVIEELDEKNRRALERSKENVKRLDERNERLRKELEEKVRRLRK

SEQ ID NO: 9724 - protein, 58 aa, Artificial Sequence
  Synthetic sequence.
DVEEKVKKVIRELREVLKEIEERVRRVLERNKRSLEDLKRKHKESIDRAKEVLDEIRK

SEQ ID NO: 9725 - protein, 59 aa, Artificial Sequence
  Synthetic sequence.
EEALKRLEDKLREKLRDLRRKLDELRKENEKVNRDLEDKTRRVIEKLKRVITKLKEEVK

SEQ ID NO: 9726 - protein, 60 aa, Artificial Sequence
  Synthetic sequence.
SEIEEVEKRLEDVLRKVNKKTEDLMRSVKEIIKRSREHLEKVIRDLEEILKELRELRKRG

SEQ ID NO: 9727 - protein, 59 aa, Artificial Sequence
  Synthetic sequence.
EDVKRRIEEVEERLKRDNERNNKKIEDVNRDNRRVAEELRRRVEDVKRKIEKVLRELKK

SEQ ID NO: 9728 - protein, 59 aa, Artificial Sequence
  Synthetic sequence.
DVEELLDRVTKRVEKALRELRKKVRELKEENRKSVEELEETSKRLKKEVDDVERRLEAG

SEQ ID NO: 9729 - protein, 59 aa, Artificial Sequence
  Synthetic sequence.
REKLKKVLEEIEKILKEIEDKVRRVIEKSRRINEENKETNRRVIEDVRRLLKKAEEDLR

SEQ ID NO: 9730 - protein, 60 aa, Artificial Sequence
  Synthetic sequence.
RVEERLDEVRKKIDEVLKRLRDTTKELEDENEESLRKLKKEVDEVRKKIEEVLKRLEDAN

SEQ ID NO: 9731 - protein, 59 aa, Artificial Sequence
  Synthetic sequence.
EEKLEKVDREIEEILRRNKRTNEKVAEESRKINREAEERLRRVIEELEKILKEIEDRLK

SEQ ID NO: 9732 - protein, 60 aa, Artificial Sequence
  Synthetic sequence.
SVEKKLKDVEDEIRKVLRELEETSKKLDKEVDDMLKKLKDSTEEVKKEIDEMLKRLEERR

SEQ ID NO: 9733 - protein, 59 aa, Artificial Sequence
  Synthetic sequence.
DEKLDKVVKDLRKLLEDDKRTNKEVIDRVRRKLEENKETNEKVIKELRDILREIEERAR

SEQ ID NO: 9734 - protein, 60 aa, Artificial Sequence
  Synthetic sequence.
SEIEDVARRIRKLLEELRRRIRKIAEDSRRLNRRLEERNTEMEKEIKDRLRKLEEELKRK

SEQ ID NO: 9735 - protein, 59 aa, Artificial Sequence
  Synthetic sequence.
EEVKEKIDRLEKEIRDMLKELRERIKRLKDENEKSLEDLRRRNTELEEEVRRVIRELEK

SEQ ID NO: 9736 - protein, 60 aa, Artificial Sequence
  Synthetic sequence.
SELEKVAEDIRRLLKRNEEINREMIKRSRELNEELRERNREVTERIRRLLERLKEERKRT

SEQ ID NO: 9737 - protein, 59 aa, Artificial Sequence
  Synthetic sequence.
DELEKKLRDLEREIRKVLREAKRLNDELRKENKESLERLKRENDKLRKEVETVIREAEK

SEQ ID NO: 9738 - protein, 60 aa, Artificial Sequence
  Synthetic sequence.
DEIEEVIRRIKRLLDENRKKNEEMSDRSRKLNERLRKIIKKIIDEITELLKRLEDRARTV

SEQ ID NO: 9739 - protein, 59 aa, Artificial Sequence
  Synthetic sequence.
RKVDKKIEDLRKEIEDVLKELAERNKENKDRNKKSADELRKEIEDLERKVREVIRELTR

SEQ ID NO: 9740 - protein, 60 aa, Artificial Sequence
  Synthetic sequence.
RVEDEIRRLEEEARRVLRELEDLLRRLKKKNDESNKEIRERIERVRRKAEKVLRELERRG

SEQ ID NO: 9741 - protein, 59 aa, Artificial Sequence
  Synthetic sequence.
ERVIERLIRELRRLLEDVKRKAEDLIRKSEDLNEKWRKELKKLEREIERLLKEVADRVK

SEQ ID NO: 9742 - protein, 60 aa, Artificial Sequence
  Synthetic sequence.
EAEKELKRVEDRDKESNDRTKDILRRIEKEVRESNKRSKEILDEIRKRVRDVIEELRRKR

SEQ ID NO: 9743 - protein, 59 aa, Artificial Sequence
  Synthetic sequence.
EETVRRLKDELEEVNERTERAVRDLLRKARKVDDESRRRVEALLRKVEEVLREIKRRVD

SEQ ID NO: 9744 - protein, 60 aa, Artificial Sequence
  Synthetic sequence.
SFKETLDEIRKRVKEVLDKLEKILRDIARRVEKVNKENEDRLREINRRNEEVLRRLKKKG

SEQ ID NO: 9745 - protein, 59 aa, Artificial Sequence
  Synthetic sequence.
EDKLRELLERLERLLRELERRVEKIEEDLKRILDEVRKRTKELLERNERILEKLERDAD

SEQ ID NO: 9746 - protein, 60 aa, Artificial Sequence
  Synthetic sequence.
SIEDIVREIRERNKDAKRKVEDIVRRNREEIDKVLKRVEKILRDNEKRIREVKEELKERV

SEQ ID NO: 9747 - protein, 59 aa, Artificial Sequence
  Synthetic sequence.
EKDLDKVRKESEDNLREILRTLKEVHERSKETLKRIEDTLRRVHKKSEDELRRLREEVR

SEQ ID NO: 9748 - protein, 60 aa, Artificial Sequence
  Synthetic sequence.
SIEEIAKTIKEEIKEVMDRVREIVERDEREIKKVKEEVDRIAKRNEDEIRKVKDELDKKV

SEQ ID NO: 9749 - protein, 59 aa, Artificial Sequence
  Synthetic sequence.
EEAMKEVADRVRKKLEEIERTLEEVHRKSRKVLTEIIKKLKENHDRSKELLDRIREEVK

SEQ ID NO: 9750 - protein, 59 aa, Artificial Sequence
  Synthetic sequence.
SEVEEVLKEIKDLLRRLEEIVRRVLKENRRLLEEDVRRTEEILEELERLLDELRKDIKR

SEQ ID NO: 9751 - protein, 56 aa, Artificial Sequence
  Synthetic sequence.
EELLKRIEDEVRRVEDKLRKLIKRSKEESDKVAEELERLNREARKRIRDVMEELKR

SEQ ID NO: 9752 - protein, 60 aa, Artificial Sequence
  Synthetic sequence.
DEAEEILRRLKKLLEDAKRISDRTVEKNREMLKKIEEDSKRSLERNRELLKRIKELAKDI

SEQ ID NO: 9753 - protein, 56 aa, Artificial Sequence
  Synthetic sequence.
REIIERLKEEVDRLLKELRDSNRELKRESDEVVEKLRELNKRSKEEADKVEKDLRR

SEQ ID NO: 9754 - protein, 60 aa, Artificial Sequence
  Synthetic sequence.
SEVDEVLKRLRKDLDKVRKDSKKSLEELRRVLEEVERLSDESVKRLEEVLKRLEDLIKDI

SEQ ID NO: 9755 - protein, 56 aa, Artificial Sequence
  Synthetic sequence.
REIIKKLADEVREVLERLKELNRRLEKEARDAKRRLEESNDRLRRKVEEVIKELRR

SEQ ID NO: 9756 - protein, 60 aa, Artificial Sequence
  Synthetic sequence.
SEVEKLLDESRRVVEENRRANKKLAEESRKAVRRNREESKRLNEELREVVERARRKVTER

SEQ ID NO: 9757 - protein, 56 aa, Artificial Sequence
  Synthetic sequence.
EESLRRIKRTHEETEKESEKTLRDLEDEHRKTIEELERSLKELRDRIKKVLDELRK

SEQ ID NO: 9758 - protein, 56 aa, Artificial Sequence
  Synthetic sequence.
DEVEEVLKKARKDIERWREETRKVKEENKRNIDRIRKKLEEVLRDLKRAIDEIRKS

SEQ ID NO: 9759 - protein, 55 aa, Artificial Sequence
  Synthetic sequence.
REVLEEIRKLLRDIKETDRKVHEELERSNEKLRREIEKILRDLEDELRKLRRERE

SEQ ID NO: 9760 - protein, 57 aa, Artificial Sequence
  Synthetic sequence.
SEVEEVLRRAEKAIREWEEETRRAKEENEKNIKKVADDLRRLLEDARRTIEEIEKRR

SEQ ID NO: 9761 - protein, 55 aa, Artificial Sequence
  Synthetic sequence.
EEVLKEIKKLIDTARRKDEKVHKELEDTNRDLDRAIEEVIREIKKLLDDLREKAR

SEQ ID NO: 9762 - protein, 60 aa, Artificial Sequence
  Synthetic sequence.
SEKEDVLRRIKELLERLHEENREVLTRIEKLLKDNKERNDDVLRRITELLKEVTKRAKDR

SEQ ID NO: 9763 - protein, 56 aa, Artificial Sequence
  Synthetic sequence.
TEEVRKRVEDVVRKNKEVARELLDRVRKLSERNKRAIDKLLEEVKRVLEEVERALK

SEQ ID NO: 9764 - protein, 57 aa, Artificial Sequence
  Synthetic sequence.
DEERDVRREIRKLLRDAEEHSKKLNEESKKTNKRNEEENRKALEDNKRLLKEVEDRI

SEQ ID NO: 9765 - protein, 56 aa, Artificial Sequence
  Synthetic sequence.
VTELRERIKRLIEEIERLNREFKKKNEELSKKNKELVERSRTESKKLVDEARERAR

SEQ ID NO: 9766 - protein, 60 aa, Artificial Sequence
  Synthetic sequence.
DSEEEVRKRVKDLSEENKRLVKTAEKRVRELSKENKELVERLKREVDRIKKEIEELKRRG

SEQ ID NO: 9767 - protein, 55 aa, Artificial Sequence
  Synthetic sequence.
EKVLREIREIVKKNKRENEEVLRRIRELVKENNDENKRVLDEIEKLLKEIEDESR

SEQ ID NO: 9768 - protein, 61 aa, Artificial Sequence
  Synthetic sequence.
SEMDEVRKKLRELVERLKKEAERSRKSHREILKKVRDDLKRSEESHKELLDRLEEVLKRTV

SEQ ID NO: 9769 - protein, 59 aa, Artificial Sequence
  Synthetic sequence.
EDKLRRLLEEAAEVIKRLLDEVKRLNEHAKRMAEKILEDVKRLNKHAEDKVRDVEEKVK

SEQ ID NO: 9770 - protein, 61 aa, Artificial Sequence
  Synthetic sequence.
RELEEVARRLERLLDELRKKLRESERSVRRLLEELKKELEKLRKRHEDLLRTVKKKLDDTV

SEQ ID NO: 9771 - protein, 59 aa, Artificial Sequence
  Synthetic sequence.
EEELKRLLEEVEKAIRELLERVERLNRRLEEEIRRVLEDLERIIRHAEEDLRRIEEEVK

SEQ ID NO: 9772 - protein, 61 aa, Artificial Sequence
  Synthetic sequence.
RELEEVKKKLEKLAKDLRDTLERSARSVEELIKRLEDELRRSEESHKELLERLEDTLRKRA

SEQ ID NO: 9773 - protein, 59 aa, Artificial Sequence
  Synthetic sequence.
EEELRKLLKDATEEVRRIAEEVKKLNDELRRAVEEVLKEVRETNKHVREMIETVREEVE

SEQ ID NO: 9774 - protein, 61 aa, Artificial Sequence
  Synthetic sequence.
SELEEVAKRLKELVDDVRRALKESDDSHKELLKRLKEKLDEVRKRLKKLVDDLEETLKRTL

SEQ ID NO: 9775 - protein, 59 aa, Artificial Sequence
  Synthetic sequence.
EEELERLVREVERVIRKLKEDVKRLNDHAREKVKRVEEELRREEKRVRDEVERVKEEVR

SEQ ID NO: 9776 - protein, 61 aa, Artificial Sequence
  Synthetic sequence.
SELERVEDEARKLADDLRRMLEESRRSHEKILREVEEELKKSEESVRRILERVKEVLDRKL

SEQ ID NO: 9777 - protein, 59 aa, Artificial Sequence
  Synthetic sequence.
EDELRELLDRLRKAIKKLLDDVKRLNDHVKELIERIRDEVRRLNRRLEEEARDVERRVE

SEQ ID NO: 9778 - protein, 61 aa, Artificial Sequence
  Synthetic sequence.
DELETVREEIERLARELEKELKKSEDSVEKLLRELKERLKEVRKRHKELLDRLRDRLRKTV

SEQ ID NO: 9779 - protein, 59 aa, Artificial Sequence
  Synthetic sequence.
EEELRRLVEDVKRVVDEVLERVKELNKRLEEAIRRILEELKKIEKNVKDFIEDIDRRVK

SEQ ID NO: 9780 - protein, 61 aa, Artificial Sequence
  Synthetic sequence.
RELEEVKRRLEELLERLRKELERSDKSHKELAKKLRDELERVEREHERLLRELEDTLRKTL

SEQ ID NO: 9781 - protein, 59 aa, Artificial Sequence
  Synthetic sequence.
EKELTDLLREAKRRVEEVLKEVRDLNRNVKETVDRVLKELEDILRNVEEMIKEIKDKVR

SEQ ID NO: 9782 - protein, 56 aa, Artificial Sequence
  Synthetic sequence.
SDAEDILRKVEDLIRRLAEKHRDLLRRSKENAERIKREHDDHHRDIRRVIKEIEDN

SEQ ID NO: 9783 - protein, 55 aa, Artificial Sequence
  Synthetic sequence.
RELLKTVRDLLETLREINDRVREELRKIHEDVERRNKEVLDRNKKLLEELERKRR

SEQ ID NO: 9784 - protein, 58 aa, Artificial Sequence
  Synthetic sequence.
SELEDIERKLKELEDEDRELNRKLNDDTRRLDERNRRLNEELTKKLREVEEEAKELRK

SEQ ID NO: 9785 - protein, 55 aa, Artificial Sequence
  Synthetic sequence.
ERVREKIERIAKKLEDDNKESEDRHRRINEENRRRNDKNREDIERILRRLDEELR

SEQ ID NO: 9786 - protein, 58 aa, Artificial Sequence
  Synthetic sequence.
KELEEVDDEVRKEAEEVKRYIKESKEKLDRLRREDERLNDRVREKVEDVRRRVEERRS

SEQ ID NO: 9787 - protein, 55 aa, Artificial Sequence
  Synthetic sequence.
ERVKRKVDKIERELEDAIRRANEEHTKIEEDLRRRNKESKDEIRRILEELEERTR

SEQ ID NO: 9788 - protein, 60 aa, Artificial Sequence
  Synthetic sequence.
REIETVRREIEKILDDLRRTVKRIEDEVRKIHEDLRRSLEDSKRNIEEILKDLERAARRD

SEQ ID NO: 9789 - protein, 59 aa, Artificial Sequence
  Synthetic sequence.
KKDIDKLLKELRDLVEKIKKDLKELLERYEEIVRRIKELLKDLNREAEEVVRRLKEELR

SEQ ID NO: 9790 - protein, 60 aa, Artificial Sequence
  Synthetic sequence.
DEEERAEREIKKLLDDLRRTLEEVKEAIRRILEDNRRTTKRINDEDRKINDDLRRTLERR

SEQ ID NO: 9791 - protein, 56 aa, Artificial Sequence
  Synthetic sequence.
VDKVLKEVEETIDRVKKDIRRALREVEETSKEDKKRLREVLERSKDLARRLKEKLK

SEQ ID NO: 9792 - protein, 60 aa, Artificial Sequence
  Synthetic sequence.
SREEEAERRIEKLLRELEKTNRDIHEEIRKILERLRRTLKKVNDEDEKLNRDLEDTLRRR

SEQ ID NO: 9793 - protein, 56 aa, Artificial Sequence
  Synthetic sequence.
VEDVLRRVKEIIDRVKEEHKRMLEEVRKIAKDLEEKIRAVLEESKKLAEDIKRRLT

SEQ ID NO: 9794 - protein, 60 aa, Artificial Sequence
  Synthetic sequence.
REEEKAEEDIRRILRDLKETNRRIHEEIKKLLDDNERTLRRINEEDKKLNEDLRRTLEES

SEQ ID NO: 9795 - protein, 56 aa, Artificial Sequence
  Synthetic sequence.
VEEVLKTVEDIVRKVKREHEELLKEIEDLSRENKKDNERMLEESRRLARKLKEELR

SEQ ID NO: 9796 - protein, 60 aa, Artificial Sequence
  Synthetic sequence.
SEEEKMEEDIERLLDRLRRINKRLHDEHKKLNEDNERTVRRIDEEDKRINEDLERTLRES

SEQ ID NO: 9797 - protein, 56 aa, Artificial Sequence
  Synthetic sequence.
VRKVLEDVERIIRRLEEEHRRALEESRKRSEENKRENEEMLERSKELAERIKRRLK

SEQ ID NO: 9798 - protein, 60 aa, Artificial Sequence
  Synthetic sequence.
SEEEKAREDIKRLLEDLRRTNKKIHEDIEDILRELKETLKRVNDDDKRINDDLDRTLKER

SEQ ID NO: 9799 - protein, 56 aa, Artificial Sequence
  Synthetic sequence.
VEEVLRTVEKIIEDVKKEHEDLLKRVKDIVKKIKEEIEKVLRESEKLAREIKEELR

SEQ ID NO: 9800 - protein, 60 aa, Artificial Sequence
  Synthetic sequence.
SEEDELRKRVADILKRLREVNKRLHDEVKRLLKENRDALKEVKDKIRESNRELDEVLKRR

SEQ ID NO: 9801 - protein, 56 aa, Artificial Sequence
  Synthetic sequence.
VEEVLERLKEIVRKAEEEHKDVLRRLKEISDRHKRRLEEAERRNEKLLRDLKEELR

SEQ ID NO: 9802 - protein, 59 aa, Artificial Sequence
  Synthetic sequence.
SRLEEMLKRAEDLSRESEELLRRVLEEVKDLSRKHEEALREILKRVKDLVDTVRDLLRR

SEQ ID NO: 9803 - protein, 58 aa, Artificial Sequence
  Synthetic sequence.
EEVRKLEEELKRLLEENRRLAKELRDELRRLTKRNKDVVREVERRLEEIMKEIDKEVR

SEQ ID NO: 9804 - protein, 60 aa, Artificial Sequence
  Synthetic sequence.
SEDERIKKELRKVEREVDKLLKEHEKILEDLKREVDKLIETHRKILEELKRRVDELKRRG

SEQ ID NO: 9805 - protein, 55 aa, Artificial Sequence
  Synthetic sequence.
ERIRRELEEVLKDIRRKLKELKERNDKVNRDIEELLRELEERNTEVDKEIKKKAD

SEQ ID NO: 9806 - protein, 56 aa, Artificial Sequence
  Synthetic sequence.
DEEKEAEDLIEEHRRRSEEIARRADKLSEDHKRKVDEIAKTVEKLIRTLKEIVDRK

SEQ ID NO: 9807 - protein, 55 aa, Artificial Sequence
  Synthetic sequence.
KELKDRVERVLEESRELLERLRKKLEDNSKEVEDILRKLRKEVEDVVRKIRKRAE

SEQ ID NO: 9808 - protein, 56 aa, Artificial Sequence
  Synthetic sequence.
RDEDEVRKLITRHEKLSRDIAERLKRESKKHRDDVERIAKENEELNRRLREIVKKK

SEQ ID NO: 9809 - protein, 55 aa, Artificial Sequence
  Synthetic sequence.
KELKDDVRRVLKKSRDELKRLREELKRNSEEVERILKKLDEDNRRVLKEIRERLT

SEQ ID NO: 9810 - protein, 63 aa, Artificial Sequence
  Synthetic sequence.
DKEREVRRRVEELKKDSEDVLRRNREEVEKLHDENRKVNEESDRTAKELVEEAERMLREARKK

SEQ ID NO: 9811 - protein, 55 aa, Artificial Sequence
  Synthetic sequence.
EELLKELKKELDRLREENERSNRRLRKMLEELKRKNEEVNRELRKKLREIKERLR

SEQ ID NO: 9812 - protein, 57 aa, Artificial Sequence
  Synthetic sequence.
SEEERLERTVEEVEKALKKLADDLRRDMDRSRKSHEDLLDKLRKELDRVLEEIRKKT

SEQ ID NO: 9813 - protein, 55 aa, Artificial Sequence
  Synthetic sequence.
EEVEKRLRELLDEARREVERILKDLRELNEHVRRRVDEVRRRLEELLERLDRETR

SEQ ID NO: 9814 - protein, 56 aa, Artificial Sequence
  Synthetic sequence.
DEKREVEKELKRVDDEIKRLLRELEEALRRDKEEVDRLDKEVKDALDEVRERIERA

SEQ ID NO: 9815 - protein, 55 aa, Artificial Sequence
  Synthetic sequence.
EKVKEDLKRLLEEVEKAVRKVVEDSKRLHDEAKEAVDRNKEHLRRLLEDAKRRAK

SEQ ID NO: 9816 - protein, 56 aa, Artificial Sequence
  Synthetic sequence.
SEKERAEEEIERSKRNLERLLEEAKREIDRSRENLKRTLTKVEEVLRKIKEDLKRL

SEQ ID NO: 9817 - protein, 55 aa, Artificial Sequence
  Synthetic sequence.
EKLIRELRELNKRLAEEIKRLIDELRKLNKELDDEVEKIIRRAEDLLRDLERETR

SEQ ID NO: 9818 - protein, 57 aa, Artificial Sequence
  Synthetic sequence.
SEVEKVIRDLEEINKRLLEEIKRSIEENKRTNEEAERKVKEVIDRLRKLLEDLKRTN

SEQ ID NO: 9819 - protein, 59 aa, Artificial Sequence
  Synthetic sequence.
EDRLKRVEDVLRESVKNLKRLVDEVRKANRESNEHLKDLARKVEKVIREIEEEVDRTRT

SEQ ID NO: 9820 - protein, 59 aa, Artificial Sequence
  Synthetic sequence.
SELERLVEELRRALEKHKRRLEELKKELKKALDDHRREVKRLIDELKKTLDDVRKASRI

SEQ ID NO: 9821 - protein, 59 aa, Artificial Sequence
  Synthetic sequence.
ERLLEDVKRILDEVRREVEKLDTDADRRLREVKEEVERINREVEKTLRDVEEDLDRLKK

SEQ ID NO: 9822 - protein, 59 aa, Artificial Sequence
  Synthetic sequence.
SEVEKLKEDLKRALDEHRKRLEELKKELEDVLRRHEEKVRRLKEKLKRILDEIRRLSRI

SEQ ID NO: 9823 - protein, 59 aa, Artificial Sequence
  Synthetic sequence.
ERLLEDLDRALDEVRKEVEKLNRDAKRTLDKVREDVKRLDDDLRRTLKRVKEEIDKLTK

SEQ ID NO: 9824 - protein, 59 aa, Artificial Sequence
  Synthetic sequence.
DEIEELKKRLRKILEEHRKRVEDLKKENEDLNRRAEETLERLKRELEEMLREIAERSRI

SEQ ID NO: 9825 - protein, 59 aa, Artificial Sequence
  Synthetic sequence.
ERILEDLKRVIERVEREVRRLNKDLKRALDESRKRIEDWLKELDDVIKRVKREVEKIRT

SEQ ID NO: 9826 - protein, 59 aa, Artificial Sequence
  Synthetic sequence.
SEAEKLKKELEEVLERARRRLTELKEENKDANRRHRRRLEELKKRLEDVLKKVKDDADI

SEQ ID NO: 9827 - protein, 59 aa, Artificial Sequence
  Synthetic sequence.
ERILRRLEEVIRRVDRDIKELIKDAREVLERSKRDVERWNREMKKVLDEVRKRVEEIRT

SEQ ID NO: 9828 - protein, 56 aa, Artificial Sequence
  Synthetic sequence.
SEDEDAKRELRRVKEEVDKTLEDSKRVHDESRKRAREWLEDSKRVHREVKERLKEL

SEQ ID NO: 9829 - protein, 55 aa, Artificial Sequence
  Synthetic sequence.
EELKRELERVLEEHRRSLEKNKRDVERINEELKRRLDRNKEELRKILEDVERRRR

SEQ ID NO: 9830 - protein, 55 aa, Artificial Sequence
  Synthetic sequence.
SEEERLRREVKRVEDENRKLLERLREIAERVHRENKRLLDESRRIADKVRRDLDR

SEQ ID NO: 9831 - protein, 56 aa, Artificial Sequence
  Synthetic sequence.
LEEVLEELERVLKRLEEEHRRVVKELRDLLRRIKEDHDRLVEEAEEILREIDERAK

SEQ ID NO: 9832 - protein, 56 aa, Artificial Sequence
  Synthetic sequence.
SEEEEADKAIRTIAKAIEDLVRDLERALKESKRNIEELAKDLKRANDRIEEELEKA

SEQ ID NO: 9833 - protein, 55 aa, Artificial Sequence
  Synthetic sequence.
KELADRLRDLLRDAKRVVDRIKRALEELNKEAKKLVERAKKKHDDLLEDVKRDTK

SEQ ID NO: 9834 - protein, 56 aa, Artificial Sequence
  Synthetic sequence.
SEEEDAKRVLDEIREELKKLNDDVRRALKESKENIDRIIEDLDRTNKRIEEELDRL

SEQ ID NO: 9835 - protein, 55 aa, Artificial Sequence
  Synthetic sequence.
EELKERLKRLLERVREEVKRNKEHLERLNKKVKEDVDRLKKRHKDTLDEVDERRK

SEQ ID NO: 9836 - protein, 60 aa, Artificial Sequence
  Synthetic sequence.
KLDEDLEKVIKEVKERLKESLDRHKEVAKRLEEEVKRSEEEHRKVLEEAKRKLEEIKTKT

SEQ ID NO: 9837 - protein, 59 aa, Artificial Sequence
  Synthetic sequence.
DRTVRKVERELRDLIRRLEKRNEELIRRVKEIVERMEKTNRDLIRRIRELIKKVEDDVR

SEQ ID NO: 9838 - protein, 63 aa, Artificial Sequence
  Synthetic sequence.
SEEEKLKRVLDEFRRAVKELLEDLERANERAKDEVRRLLEDLDRAHERIRRAVEKLKERVKDK

SEQ ID NO: 9839 - protein, 55 aa, Artificial Sequence
  Synthetic sequence.
KDLEKRIRDTLREIKKRVEDVKRDNKRVLDELRKKIEENKKRNEDVLKEMEDKTE

SEQ ID NO: 9840 - protein, 60 aa, Artificial Sequence
  Synthetic sequence.
SDAERVKKESKDLLDTTKRLADRLKELLERLNKETRDRVREVIKEIERLVDEVEKEARKG

SEQ ID NO: 9841 - protein, 59 aa, Artificial Sequence
  Synthetic sequence.
EDIRTDLEDVLRRNKEALEEIRKDIERVNRKDREELREIARTLEKVLRDARRRLEELRR

SEQ ID NO: 9842 - protein, 59 aa, Artificial Sequence
  Synthetic sequence.
SIEDDLRRVLERSKRSLEELKRKADRVLEESKKNVRDLERELKRVLEKIKETIDKLRKD

SEQ ID NO: 9843 - protein, 59 aa, Artificial Sequence
  Synthetic sequence.
KEEVERLIRELDRVNEELAREVERLIRELEEVNRRVNEDLKRLIRELERALKELDERVR

SEQ ID NO: 9844 - protein, 57 aa, Artificial Sequence
  Synthetic sequence.
DEVDELIKRLEERNEELNRKAKRIIEKLKKENDDLNRKLDEIVRKAREDIEDAERRV

SEQ ID NO: 9845 - protein, 59 aa, Artificial Sequence
  Synthetic sequence.
KDLEDKLEEVLRRSKKNIEDVEKELRDVLRAAKKNLDDLRRKLEDVLRRLRDEIRRKKK

SEQ ID NO: 9846 - protein, 57 aa, Artificial Sequence
  Synthetic sequence.
SDVDRIITELRDINREVNRRVKRLIEELEELNRRLNEKAKRDMDEIRRLIEEAAKKL

SEQ ID NO: 9847 - protein, 59 aa, Artificial Sequence
  Synthetic sequence.
EDLKRKLEKVLKEARDNLEEVKKRLKEVLERSEENLRRLEEELRRVLEEVREMLKRKKD

SEQ ID NO: 9848 - protein, 57 aa, Artificial Sequence
  Synthetic sequence.
KDEEKIKRVLDDVERVLKENEDRNRELLKRVRERLEESRDHLRRVLEDVKRVLEELK

SEQ ID NO: 9849 - protein, 56 aa, Artificial Sequence
  Synthetic sequence.
VDELVKRIKDLLKRLNEISRRIAEEIKELLRTHDELNERVVRKLRDLLRKAREKRR

SEQ ID NO: 9850 - protein, 56 aa, Artificial Sequence
  Synthetic sequence.
SEEEKLKRVLEDVERDLRRNKRENEKSLEESKKVNDDNRRRNKEALDEVKKVLEDL

SEQ ID NO: 9851 - protein, 56 aa, Artificial Sequence
  Synthetic sequence.
DEELVDEIRKLLERLNEISERIHRRNKELDDELNEISKRIRERIEDLKRRAEERAR

SEQ ID NO: 9852 - protein, 60 aa, Artificial Sequence
  Synthetic sequence.
SEEDEIRRLLKENEDSTRRVEEDNKRLNDENEKSTKRVEDDIRRILERVRRELDDLRRRG

SEQ ID NO: 9853 - protein, 56 aa, Artificial Sequence
  Synthetic sequence.
REEIEREVREDNKRLEELLERSEREVREDNKRLDEALKKIEKEARELVKRMREKAK

SEQ ID NO: 9854 - protein, 59 aa, Artificial Sequence
  Synthetic sequence.
REEEEIRRLLKENEESTRKVEEDNKRLNDENRRSTEKVSRDLEDLNRDTRRVMEEAERR

SEQ ID NO: 9855 - protein, 56 aa, Artificial Sequence
  Synthetic sequence.
LEEIKREVEEDNERLKELLKRSEKEVREDNKRLRDVLEKSREEHERLKKRLEEAAK

SEQ ID NO: 9856 - protein, 60 aa, Artificial Sequence
  Synthetic sequence.
SEEDEIRKLLEKNEKSTEDVERENERLNDENRKSTEDVKREIDRLLKELREVLDEARKKG

SEQ ID NO: 9857 - protein, 56 aa, Artificial Sequence
  Synthetic sequence.
LDEIRKTVEEDDKRLKDALERSKREVDDDNRRLKKVLDEIRKTVRTMIEEIKKAEK

SEQ ID NO: 9858 - protein, 61 aa, Artificial Sequence
  Synthetic sequence.
SEKEKADDLRRKSKESNDTLRKRLDELKKRSEKNNEELERRLRALLKRLEDVLREITKRTG

SEQ ID NO: 9859 - protein, 55 aa, Artificial Sequence
  Synthetic sequence.
DELVKEVEDLNRELEEKVKRLIEEMEELNKRLNDKVKELIEEVERLIKELEDRVR

SEQ ID NO: 9860 - protein, 61 aa, Artificial Sequence
  Synthetic sequence.
KDIDELIKRSEDLTRDLERKNKEVVDKIEELLREHEKTNREVVKELRRLLDEVRERVERRG

SEQ ID NO: 9861 - protein, 59 aa, Artificial Sequence
  Synthetic sequence.
EDLERKVRKAEEDNKRAVERSKTHVDEVRKEVERVLRESKRHAEKLAEDVERMIRELER

SEQ ID NO: 9862 - protein, 57 aa, Artificial Sequence
  Synthetic sequence.
STLEKLKKDLDDIDRDLERILDELRRRVERIDEELRKIVERLHRRNKEIIERLRKAK

SEQ ID NO: 9863 - protein, 55 aa, Artificial Sequence
  Synthetic sequence.
REIREAEKKHKKVLDDLRRKLEEVEKRHREVEKELRDRLEESRREHEKVIREETE

SEQ ID NO: 9864 - protein, 56 aa, Artificial Sequence
  Synthetic sequence.
RELEELEKEVRKRLKEAEERVRDLAKKSRDLNRELKDRLRRIVEENRDVNRKVKEK

SEQ ID NO: 9865 - protein, 56 aa, Artificial Sequence
  Synthetic sequence.
DEDLRRVEEEIRRVIERLKRLLERVEEENRKSRKELRETLERLHRENEKSLREKET

SEQ ID NO: 9866 - protein, 60 aa, Artificial Sequence
  Synthetic sequence.
SLKERLDRVEEKIRKVLEELDRSTSRVEKKVEEVLRELKRSNDEVRKEIKKVLDELRKRG

SEQ ID NO: 9867 - protein, 57 aa, Artificial Sequence
  Synthetic sequence.
VVDEVAKRMTEELKKLDKENKEIEKEVDDILKRLKDEDKKTVDTLRKILKELDDDAR

SEQ ID NO: 9868 - protein, 60 aa, Artificial Sequence
  Synthetic sequence.
SEIEEVEKEMDKLAEESNKLNEEALRRVRKLLRDSNELVRELERRVRELIKRAKDLKREG

SEQ ID NO: 9869 - protein, 59 aa, Artificial Sequence
  Synthetic sequence.
EEVRRKIKEIKDRSEENIKRSRDSVREIKKESDENIKRLKRELERIKKRLEEVLRDLKR

SEQ ID NO: 9870 - protein, 59 aa, Artificial Sequence
  Synthetic sequence.
KDEEDLAREVKRVIDELEKLNEELNRAAEELIKRAEEINERVNRKVEKVERDLDKLKKR

SEQ ID NO: 9871 - protein, 55 aa, Artificial Sequence
  Synthetic sequence.
ETLRKLRDDLRKALKKSEDNIEDVRRRLEEVLERARRNLERVRRRLEEVLRKLKE

SEQ ID NO: 9872 - protein, 60 aa, Artificial Sequence
  Synthetic sequence.
SAAERLEKAVRDLIEELKRLNEELNKAVKEIIRRLRELNKKLNEDAERLIRKADELKRRG

SEQ ID NO: 9873 - protein, 56 aa, Artificial Sequence
  Synthetic sequence.
KEILDKLREELKRALEESEENLRRLRRELTEVLRESRENLERLKEEVERVLKRLAD

SEQ ID NO: 9874 - protein, 58 aa, Artificial Sequence
  Synthetic sequence.
SVVEDLEEKVKRLIERIERENRRLNKDADRLVRELDELNERLNRAIRRLIRKAEEARK

SEQ ID NO: 9875 - protein, 56 aa, Artificial Sequence
  Synthetic sequence.
ERELERLKRELEKVLRESEKNLEDLERKLKEVLDRSRENAKRLEDELREVLERLRK

SEQ ID NO: 9876 - protein, 58 aa, Artificial Sequence
  Synthetic sequence.
SVVEDLAKKVEELIRRLEELNKELNKRVRDLIEKLRDINRKLKREVERLIEEAEEVRR

SEQ ID NO: 9877 - protein, 56 aa, Artificial Sequence
  Synthetic sequence.
KDELKKLEERAREVLRKSEENLKRVEDELREVLRESEETLKRLEEELRRVLDELRK

SEQ ID NO: 9878 - protein, 60 aa, Artificial Sequence
  Synthetic sequence.
DEEKKAEDDIRRIHRRNEDLLRRHREITEEIEKRIRELLREHREITKRLERRLRELKKEG

SEQ ID NO: 9879 - protein, 55 aa, Artificial Sequence
  Synthetic sequence.
EELKRIKKRLDESLREVEEDLKRSEKRLRELLKRVKEDLDRSRKRLKEILDELRR

SEQ ID NO: 9880 - protein, 60 aa, Artificial Sequence
  Synthetic sequence.
DEVRKLEEDVERLRREVEEENRRLEEEVERLRKEVKERNRELNERVKTLIETAKRLKEAG

SEQ ID NO: 9881 - protein, 56 aa, Artificial Sequence
  Synthetic sequence.
EEMLRELEKRLKRLADETRRSNKELKERLERLKDESRDNNRELKERADRLLEKLKE

SEQ ID NO: 9882 - protein, 60 aa, Artificial Sequence
  Synthetic sequence.
SEEEELRKLERRLEELMKEYKEALDKLREEHEKTLREYEKRVEDLEREHKKVLKKLVDDR

SEQ ID NO: 9883 - protein, 56 aa, Artificial Sequence
  Synthetic sequence.
LDDLRRKVDKLRKEVEDHVRELEKKSRKLVEELKDHLRKLEEESRRLNRELEERSR

SEQ ID NO: 9884 - protein, 56 aa, Artificial Sequence
  Synthetic sequence.
SKEDLRRELDRVNEESKKHLDKLRKEAEEVLERLDRANKKIIEDAEEILRRIEKKV

SEQ ID NO: 9885 - protein, 56 aa, Artificial Sequence
  Synthetic sequence.
RERIKREIEENRKRNEEIARKIKEDIERARRDLERLRKKHEEELEKLKKRVEDADR

SEQ ID NO: 9886 - protein, 60 aa, Artificial Sequence
  Synthetic sequence.
DEDRIRKELEKAHKETREESEKLNRDVERVLREVRKASKDLNDKFEEELRKLREKVERDL

SEQ ID NO: 9887 - protein, 56 aa, Artificial Sequence
  Synthetic sequence.
RDKVEEDLRRSRKELEDYARDLEDAIRRIEDRLRRYARKLEEDIKRLARKLEERER

SEQ ID NO: 9888 - protein, 61 aa, Artificial Sequence
  Synthetic sequence.
SRTERVKEELKRLVEEYKKRSDDSRRRNEKLTRDYREDSRRVEEELKRIKEDVERELRRRD

SEQ ID NO: 9889 - protein, 59 aa, Artificial Sequence
  Synthetic sequence.
DEEAKKDLKRVRDALDRLTKRNEEKDKENEDRLRKMLRENRERLKEVRERAKRIKEELK

SEQ ID NO: 9890 - protein, 63 aa, Artificial Sequence
  Synthetic sequence.
KEKEEIRKALKELLDDLERTLERLKREYDKLRKDLEDTDERIAREHKKIADDLDRTLKEARKK

SEQ ID NO: 9891 - protein, 55 aa, Artificial Sequence
  Synthetic sequence.
ERVLEEVKREVDRIKEELRRTLEENRRRIEEIKKRLEDILRESRERARELKEKLR

SEQ ID NO: 9892 - protein, 56 aa, Artificial Sequence
  Synthetic sequence.
SEAETILRRVRRRVEEILDRIRRKLEESKREVEKHRRDVKKVLDDVRRTVKRIKER

SEQ ID NO: 9893 - protein, 55 aa, Artificial Sequence
  Synthetic sequence.
EEVDTRLKEISKELEETLRRVTEEHKRLNRELEEVDRRAEKEVRKILKELRDTTK

SEQ ID NO: 9894 - protein, 61 aa, Artificial Sequence
  Synthetic sequence.
SKEEELREVLRRIERELERVNEELREENKRIDKELEEVNRELEERNKRINDTVEDLVRERG

SEQ ID NO: 9895 - protein, 59 aa, Artificial Sequence
  Synthetic sequence.
REELRKIAEKLKKNLEEHKKRVREYLKRLEENLKRHRERVEKYARDLKRDLDRLRERLR

SEQ ID NO: 9896 - protein, 60 aa, Artificial Sequence
  Synthetic sequence.
SEEEKLEKKAREIEEALRRVNEELKRRNKEIDERLEEVNRRLEKDLKKIEEDARKLVKDK

SEQ ID NO: 9897 - protein, 59 aa, Artificial Sequence
  Synthetic sequence.
EDELREIIERLERNLERHKRRVDKYLRDLEKNMRDHKRKVDEVVKTLEETLRRLEEEVR

SEQ ID NO: 9898 - protein, 60 aa, Artificial Sequence
  Synthetic sequence.
SEEERLREKVKRVEDDLRRLNEEYKEKHKRSEERNKKLLKDLKEVHDRVKKAVEDILRDT

SEQ ID NO: 9899 - protein, 56 aa, Artificial Sequence
  Synthetic sequence.
EEEVEERIRRALKESREEIDRLERRNEEEDKKSEETVRRMMERNDRVLKEVEERAR

SEQ ID NO: 9900 - protein, 60 aa, Artificial Sequence
  Synthetic sequence.
REEEELRRLVKTVEDEVEKLLRRYRDESEKVKRTLEELNKDLERKHKEVLDRIRDILRKV

SEQ ID NO: 9901 - protein, 56 aa, Artificial Sequence
  Synthetic sequence.
REDVERELEETLRDVARKIERLLEKNKRDLDRSKKRVEEMVRRNEKALKDVEDEIR

SEQ ID NO: 9902 - protein, 60 aa, Artificial Sequence
  Synthetic sequence.
SEREDLKRTVDEVKKRLEELIDDYRKTSEEVERRLEELLRRLREDHKRVAETIDDILRRV

SEQ ID NO: 9903 - protein, 56 aa, Artificial Sequence
  Synthetic sequence.
TEEVKERIRRDLERVKRKIEELKKKNEEDLRRADKKVKDMLEENRRTLEKAKRKAD

SEQ ID NO: 9904 - protein, 60 aa, Artificial Sequence
  Synthetic sequence.
SKEDEARKEIKRIEDEIERLRKELEDAHRKLREDLKRLRDENKKVLEDIKRRLKELEKDT

SEQ ID NO: 9905 - protein, 55 aa, Artificial Sequence
  Synthetic sequence.
DRVRKKLEDELRRLKRTVDELKKRNEKALRDVKRDSERHKEELRRALRKAEEDAR

SEQ ID NO: 9906 - protein, 61 aa, Artificial Sequence
  Synthetic sequence.
SLKEELDKAIRELKERHKRINEDLERVVRESRKNHEDINRRLKKLLEELEKRVEEIVRREQ

SEQ ID NO: 9907 - protein, 59 aa, Artificial Sequence
  Synthetic sequence.
DRVIREIKKRLEDLLRRTEERAKEVKDENRKRNEDTREEVRRVEEELKELLRRIEERER

SEQ ID NO: 9908 - protein, 59 aa, Artificial Sequence
  Synthetic sequence.
DEVREIIRELKERIDKIAKEIDDENREHRERLKEIAREVKELIKENRKELKRIADERKD

SEQ ID NO: 9909 - protein, 59 aa, Artificial Sequence
  Synthetic sequence.
EEIRKRLDEATKRAEDELRKLKEKNKEVLKELDDRLRKLEDEHRRVREEVDKRLDELRK

SEQ ID NO: 9910 - protein, 60 aa, Artificial Sequence
  Synthetic sequence.
DEREKIEKRIRELLKEDKEHTRRNEEKIRRLLDTNRRLLEEIAKKIEEIARELKERKKEN

SEQ ID NO: 9911 - protein, 55 aa, Artificial Sequence
  Synthetic sequence.
EEIRKLVEDYRREHEKLKRRNDELLERYRRAHEEIKKRIDELVERLEEILRKLAE

SEQ ID NO: 9912 - protein, 60 aa, Artificial Sequence
  Synthetic sequence.
SEKETIEKRIRDKLKDDEDHTKRNEERIRRALKEDEDRLRKIEEEIRRTLEELEREKRSN

SEQ ID NO: 9913 - protein, 55 aa, Artificial Sequence
  Synthetic sequence.
EDIERLEERYRREHERLKRRNEDLSREYEERHERLKREIDKLEEDLKRETERAAR

SEQ ID NO: 9914 - protein, 60 aa, Artificial Sequence
  Synthetic sequence.
SEKEKIKKEIEDARREDEKHTEKNKRDIERDERRDEETLKEIEERIRRTLRELEKDRESN

SEQ ID NO: 9915 - protein, 55 aa, Artificial Sequence
  Synthetic sequence.
EDIERLEREYEKDHKRLKDENDDLTEKYRRRHREIDERIKDLERELDRRIKEIDR

SEQ ID NO: 9916 - protein, 61 aa, Artificial Sequence
  Synthetic sequence.
DVRDRVRELRRRLEEETKKVDDENRKIHEELKRVADESRKNNERLNRELRKEIRRVEKDLG

SEQ ID NO: 9917 - protein, 59 aa, Artificial Sequence
  Synthetic sequence.
EEALRRLEETLKEVKDELKTELDDSRREVEEVKRSNKEKNERSERRLKEVRDRLREERK

SEQ ID NO: 9918 - protein, 59 aa, Artificial Sequence
  Synthetic sequence.
SLEDSAREIEKRLRDLHRRYREDHERIREDLERLKTEYEKAHRDIKRELDRLREELERA

SEQ ID NO: 9919 - protein, 60 aa, Artificial Sequence
  Synthetic sequence.
EKEMLDRLEEHVDRNEKDIKKALDENRKRLDDIRRKIKKALDENREELKRIERRIRELKK

SEQ ID NO: 9920 - protein, 60 aa, Artificial Sequence
  Synthetic sequence.
SAEETTEDLKRRLKELDEKVKEVLKRNEDRVRELEEDVRRNLKKNEDDAREVEERLKTSG

SEQ ID NO: 9921 - protein, 59 aa, Artificial Sequence
  Synthetic sequence.
EELLKEVEDRVREIIKRIEEKLKRLNDRTREFIERIRRELRKVNEETKKMIKELKEEED

SEQ ID NO: 9922 - protein, 60 aa, Artificial Sequence
  Synthetic sequence.
SKAEKVLEKAREVVETIKRLVEEVLRHSEDVVRRITDLVRRLLEENERVVREIKRLADEG

SEQ ID NO: 9923 - protein, 55 aa, Artificial Sequence
  Synthetic sequence.
ERVIKKIEDLLKKVDDEAKKMLEEVERLNKEVNDRLKRVLEEAERLHEEVNRRVK

SEQ ID NO: 9924 - protein, 57 aa, Artificial Sequence
  Synthetic sequence.
KELEDVIEEVKKLLKTVNEESRRVAEEVRKLIREVSEELTEVIRRVERLVEEVATRV

SEQ ID NO: 9925 - protein, 56 aa, Artificial Sequence
  Synthetic sequence.
LDTVLRRAEDIVRKNRKLAEEVLRRVKKIVEENRKIAKEVLDDVRKLVEDVLRRAT

SEQ ID NO: 9926 - protein, 57 aa, Artificial Sequence
  Synthetic sequence.
EELERVIEEVRKLVEEAEKKSREVIKTVKELMDDVNRKSKKVLDDVRRLIEKVRREV

SEQ ID NO: 9927 - protein, 56 aa, Artificial Sequence
  Synthetic sequence.
ADDALRRVKEIVERNEEVVKELLKRAEDIVRTNEKLVKDVLDTVRKLVKKVKDDED

SEQ ID NO: 9928 - protein, 59 aa, Artificial Sequence
  Synthetic sequence.
SEAEDALRKAKRLADEDRKAAKRALEEAKKSAEEVKKAAKRALEEAKRIAEDVKRAADE

SEQ ID NO: 9929 - protein, 55 aa, Artificial Sequence
  Synthetic sequence.
EEAAREAKKLAKDAADVSRKAAKDAKDLSKEAADVARKAAEDARRLAEEAARKAK

SEQ ID NO: 9930 - protein, 60 aa, Artificial Sequence
  Synthetic sequence.
SDAEDVVRKVKRLVDELRRHSKELLKEVEDLVRDLVRHSEEVVKRVEDLVRRLEELVRRG

SEQ ID NO: 9931 - protein, 59 aa, Artificial Sequence
  Synthetic sequence.
EEVRRVLREIREVLKKVAEDSRKVNEDIRRVLEEAKKTSDKVNTDSEEVLRTVARRFED

SEQ ID NO: 9932 - protein, 60 aa, Artificial Sequence
  Synthetic sequence.
SRAERLLEDVRRLLEESLRNSERVLEEVRKLIEENLRHSRKVVDEVRRLLEEVLRVVERG

SEQ ID NO: 9933 - protein, 59 aa, Artificial Sequence
  Synthetic sequence.
EDVRRVLEAIKEDLKRVEDANREINRRSEELLREAEKRSRDIDKESRDLVRKVKKDLEK

SEQ ID NO: 9934 - protein, 60 aa, Artificial Sequence
  Synthetic sequence.
SRAEEVLKDVKRLVDENRRHSERVVEEVRKLVTENKRHSERVVEEVRRLVEELERARRRG

SEQ ID NO: 9935 - protein, 59 aa, Artificial Sequence
  Synthetic sequence.
KDVRKVLKDIREVLERVEEDSERVNRESKKVLDDVKKESDEADDESRRVLEEVDRKARK

SEQ ID NO: 9936 - protein, 60 aa, Artificial Sequence
  Synthetic sequence.
DRVEELLKTVEKLVRDNEKHSRDVVKEVRRLAEENERHSERVVREVRRLVKELEDMKRRG

SEQ ID NO: 9937 - protein, 59 aa, Artificial Sequence
  Synthetic sequence.
REVREVLKRIEEILKDVKRKSEEVNRESERVLREVEKRSEDADRESKKVLDDVKEKARR

SEQ ID NO: 9938 - protein, 60 aa, Artificial Sequence
  Synthetic sequence.
SEEEVLKEIDEVSRDLERKNKTINEEIKKVSDRVAEEVRRVLEDIKRTSKDAVDDVRTRG

SEQ ID NO: 9939 - protein, 56 aa, Artificial Sequence
  Synthetic sequence.
LEKVVREVEESVKESEERSRRLLEEVRRSVKKLEEDVTRLLEENKKSVDDIKERAR

SEQ ID NO: 9940 - protein, 60 aa, Artificial Sequence
  Synthetic sequence.
REEEVLEEIRRVVEEVRRENERINKEIRERSEDLRRKVKRILEKAKKVLDDVDERAKREG

SEQ ID NO: 9941 - protein, 56 aa, Artificial Sequence
  Synthetic sequence.
VDEVLKEVEDLVRESVRLSEDLLREVRESVERLVDEARKLVREIERLVKEAVDTVR

SEQ ID NO: 9942 - protein, 60 aa, Artificial Sequence
  Synthetic sequence.
KEEEVLKEAEEVSRRAEEKNRRINDEVRRVVRRVEETVTRVLEDVERTSKEAKERVERAG

SEQ ID NO: 9943 - protein, 56 aa, Artificial Sequence
  Synthetic sequence.
LDTVVEEIKDSVRKSVERSRELLERVERIVTELEKRVDELVRENEDSVRRIDERVR

SEQ ID NO: 9944 - protein, 60 aa, Artificial Sequence
  Synthetic sequence.
SEAEKIVEEAKRLADKARELAERSVRHSEKLARDSEKAAREAVKEAKDLADKARDLAAKR

SEQ ID NO: 9945 - protein, 56 aa, Artificial Sequence
  Synthetic sequence.
KEALDTARKILRDAEEAAKEAHKEANRLNKEAEEAAKRAADEARKILKKAEEDARR

SEQ ID NO: 9946 - protein, 60 aa, Artificial Sequence
  Synthetic sequence.
DDLEEIVKRVRRIVEEIRRLVEELVRRDKRIVDEIKRLLEEDKRKVDEIVKEIEEVVRRG

SEQ ID NO: 9947 - protein, 59 aa, Artificial Sequence
  Synthetic sequence.
EEVRRVLKEVKDILKTVRDEVEEANEDAKRLNEEVREEAERVLRDTKRILDEVRKEADK

SEQ ID NO: 9948 - protein, 59 aa, Artificial Sequence
  Synthetic sequence.
REKEVLEEVRDIVRRASERSKEALDESREILKTVDDEVRRVLEDSRRLLEEVRKRVEDN

SEQ ID NO: 9949 - protein, 56 aa, Artificial Sequence
  Synthetic sequence.
AREIVERVRRLVDTSRRLVEEDVRRVREVVKELRKLLREDVKRVRDVVEELAKEAT

SEQ ID NO: 9950 - protein, 57 aa, Artificial Sequence
  Synthetic sequence.
SEMEDAKRKIEDLVRRVKDSLRDAERRIREVVERVERSLKEVEDRSRELLEDVKREG

SEQ ID NO: 9951 - protein, 59 aa, Artificial Sequence
  Synthetic sequence.
DESVRDAVREVEDLIRRLTEDNKRLVEEVKRLVDRASEENKKLNDTSKKVVDEIREREK

SEQ ID NO: 9952 - protein, 57 aa, Artificial Sequence
  Synthetic sequence.
EELERVKEEIDKLVKEVRRSLKDVERRSAELLKEVEKSLEEVERESKKVLDEVRKAG

SEQ ID NO: 9953 - protein, 59 aa, Artificial Sequence
  Synthetic sequence.
DKAVKTLLEDVRRLVREATEDNKRVNDESRELVERASRDNRRVNKESRDIVRRLEERTK

SEQ ID NO: 9954 - protein, 57 aa, Artificial Sequence
  Synthetic sequence.
SELEEVERRVEKVVKEVRDSLKKVKEDIEKVLRESHKRLRDVEREVRRVLEKVRRRG

SEQ ID NO: 9955 - protein, 59 aa, Artificial Sequence
  Synthetic sequence.
DKTVRDVLRRVRKLVEDATRANEKALDDVRKLVEKSRKLVEDVLERVRRLVKELEERTT

SEQ ID NO: 9956 - protein, 59 aa, Artificial Sequence
  Synthetic sequence.
DEVEDVVRKVRDLVRRVREAVRRLLEENRDLVRKLIEDSERLVREVEKLIKEVEDTVKD

SEQ ID NO: 9957 - protein, 59 aa, Artificial Sequence
  Synthetic sequence.
REELERVIKEIKDVVREVTKVVEKVIREAEKLNEDVNRRSEEVNKRIKKLVEDVARRVE

SEQ ID NO: 9958 - protein, 56 aa, Artificial Sequence
  Synthetic sequence.
DEAEEVKKLIDKVLREVEEVVRRVNKRDKDLLREVEKVVRDVNREDKRVLEEVERS

SEQ ID NO: 9959 - protein, 55 aa, Artificial Sequence
  Synthetic sequence.
EEIVREIEKVAEDIMRRNEELVKESEDVVRKIVRDNERLAEDSKRVVEEAVRREK

SEQ ID NO: 9960 - protein, 61 aa, Artificial Sequence
  Synthetic sequence.
SAIDRVRKTLEKLVERLERVLEESSKAVEDVKEKVERLLRELRERTKRIVDEVEDMVRKAN

SEQ ID NO: 9961 - protein, 59 aa, Artificial Sequence
  Synthetic sequence.
EEELDRLVKKVEDLVRRLEELARKSLKDIKKLLKDIEDRLRKSVEKSRRLAEEIKERLR

SEQ ID NO: 9962 - protein, 60 aa, Artificial Sequence
  Synthetic sequence.
DKADEAVKRVKDLIDDLKRRIDEVVKRSREVVRDIEKHAEDVVKESRRVVDEIKKLVTRG

SEQ ID NO: 9963 - protein, 55 aa, Artificial Sequence
  Synthetic sequence.
EEVEERVREVLRRVEKRVKEVNEESERTIRELERVSRRVNEESRRSIEEAKRAAD

SEQ ID NO: 9964 - protein, 61 aa, Artificial Sequence
  Synthetic sequence.
DAVERAKEESKRVLEDAERVVRRVEEEVRKMERKAEESLKDVRRKSEEVIRKVEEVVRRKG

SEQ ID NO: 9965 - protein, 59 aa, Artificial Sequence
  Synthetic sequence.
DKEVREVVEDSRRSVRRVEELVEKVVRDVKKLIEDHERRNRESVRESERSIKELEEKVR

SEQ ID NO: 9966 - protein, 59 aa, Artificial Sequence
  Synthetic sequence.
DDLERVLREVKRLVEENEKKVRRIVEESRELVERNKELLRRVVEEVRRLVKEVRDILRN

SEQ ID NO: 9967 - protein, 59 aa, Artificial Sequence
  Synthetic sequence.
EDKLREVRERIKRLLDRSHEAVRRASEKSKRSLEESHRAVREVEKRLKELLEDVREDVR

SEQ ID NO: 9968 - protein, 59 aa, Artificial Sequence
  Synthetic sequence.
DRLEEVVERVERLVRENVKRLEKVAEENRELVERNKRRLEEIVRRVRELIERAKRIVRD

SEQ ID NO: 9969 - protein, 59 aa, Artificial Sequence
  Synthetic sequence.
EDKLRDVERRAKELLEESHRVIRTVEERSKTVLADSHRVIEDVRRRLEELLREVAEEVR

SEQ ID NO: 9970 - protein, 60 aa, Artificial Sequence
  Synthetic sequence.
DEADEVVKEVEDRVRKLVRRLEESAKKSKELVERILKRVEDSVRRSEELVERIKREVERR

SEQ ID NO: 9971 - protein, 55 aa, Artificial Sequence
  Synthetic sequence.
EKVEEMLRRVLEEVRRAVRKSSEDNKRSVEEVKRVLEKAEEDNRRVVEEVDRELK

SEQ ID NO: 9972 - protein, 60 aa, Artificial Sequence
  Synthetic sequence.
SKLEEVEKMVRKVIEDSRRVNEEVNRRSEEVVRELEKVHREVNDASRRVVEKARRVLKEG

SEQ ID NO: 9973 - protein, 58 aa, Artificial Sequence
  Synthetic sequence.
KEADEVVERAERISEENKRRVEDVARKSKELVEDVRRHSEEVVRRVEELVKEVEERVR

SEQ ID NO: 9974 - protein, 60 aa, Artificial Sequence
  Synthetic sequence.
SLLEDVKRTVREVVRESRRVHKEVNDDSRRVLKRSDEAHERVNRDSRRVIERIREVLSRG

SEQ ID NO: 9975 - protein, 58 aa, Artificial Sequence
  Synthetic sequence.
EEVRELAEDARRISEDNRRNSKRVVDRVREISKENEDNSRRVVDRVRKLAEEVEREVR

SEQ ID NO: 9976 - protein, 60 aa, Artificial Sequence
  Synthetic sequence.
DDLERVKETVKKVIKRSRDSTKKVADTLREVVRESERVHREVNETSRRVEEEAKRVASRG

SEQ ID NO: 9977 - protein, 58 aa, Artificial Sequence
  Synthetic sequence.
EEVDKLADRARRLVAKSEEDNKRVMKEVTDISKENEDNSRRVVDEVRKLVEEVRRRLE

SEQ ID NO: 9978 - protein, 60 aa, Artificial Sequence
  Synthetic sequence.
DKVERVVEEIRDLMRRVEELIKKAADDNRKLVKEVEDLIRDAVRDSERLVAEVEKLLTKE

SEQ ID NO: 9979 - protein, 55 aa, Artificial Sequence
  Synthetic sequence.
DEVRKEVKRVIKAVEKVIEDVERTSEEARRRVEKVIKEVEEKNREVIKRVEDRIR

SEQ ID NO: 9980 - protein, 60 aa, Artificial Sequence
  Synthetic sequence.
SEADKLVEEVKDVVREDKRRVKEIVETVRELVRRSRETVRRIVETVEEVVRRLLELLRKG

SEQ ID NO: 9981 - protein, 55 aa, Artificial Sequence
  Synthetic sequence.
EKVEEVLRRVKRESEKVIEDVERELKRVEDDDRRVIEEVKKRLKRVLERVRTESK

SEQ ID NO: 9982 - protein, 59 aa, Artificial Sequence
  Synthetic sequence.
READELVDRVKKVVEEDKRLSKELVDEIERVVDELEKVSRELVERVRDLVRRLLEVAAK

SEQ ID NO: 9983 - protein, 55 aa, Artificial Sequence
  Synthetic sequence.
DKVEKVLKRVEEESREASERNERVIERVERRVDEASKRNEDEIDKVRKEVERVAT

SEQ ID NO: 9984 - protein, 59 aa, Artificial Sequence
  Synthetic sequence.
EEVKELVERVRRVVDDLRKKLEKIVEEVRDVVRKDEERSRKLVEDVKDLVRKILEVLRK

SEQ ID NO: 9985 - protein, 55 aa, Artificial Sequence
  Synthetic sequence.
DDLRRVLKEVDEEVRKVIEDVARVLEEVKRRSDRASRENEEVIKRVTEEVKRVVK

SEQ ID NO: 9986 - protein, 60 aa, Artificial Sequence
  Synthetic sequence.
DRVEKLVEEVKRHVTEVLKTVEDLARRIRDHVRKVEDTSRELVKEIKRLVEEILDRVRKK

SEQ ID NO: 9987 - protein, 59 aa, Artificial Sequence
  Synthetic sequence.
EDVVRELRRVLRESNEKLKEVVDRLRKVLEESTKRVEDASRRVERVLEKVEEDVKREAT

SEQ ID NO: 9988 - protein, 60 aa, Artificial Sequence
  Synthetic sequence.
SEVEELKERIREIVERIEETVRRLAKRVEDHVREVEKDSKRLADEIRDFVRRITDEVRKK

SEQ ID NO: 9989 - protein, 59 aa, Artificial Sequence
  Synthetic sequence.
KRLVDKLRKVLEEVREEVERVVRELEEVLRRSTKRVEDASRELERVLKEVKETLEREVR

SEQ ID NO: 9990 - protein, 60 aa, Artificial Sequence
  Synthetic sequence.
DRVEALVDEVKRHVTELLKTAERLADEVREHVDDVRKKSKELVDEIRRVVEKILDEVRKK

SEQ ID NO: 9991 - protein, 59 aa, Artificial Sequence
  Synthetic sequence.
EEVVRELRRVLRESNEELKKVVTELEERLKDSNEEVKKASAEVRKVLEEVRADVDREVK

SEQ ID NO: 9992 - protein, 57 aa, Artificial Sequence
  Synthetic sequence.
SLVEKLRRVLEEVRRTSEKVIRDVKEVNKRSEDKTREIVRRLEEVNKESKERLDRAG

SEQ ID NO: 9993 - protein, 59 aa, Artificial Sequence
  Synthetic sequence.
KELAEKLAREVKRLVDESKKNMDKSVEDSRRLVRESEENVRKSVEDSRRLVKRAVEETK

SEQ ID NO: 9994 - protein, 60 aa, Artificial Sequence
  Synthetic sequence.
RVDEDLRRVLKEVKERNEEVVRRSKEETDRVEEDIERVIRDSERVSEEVKRRVDKAKKDV

SEQ ID NO: 9995 - protein, 59 aa, Artificial Sequence
  Synthetic sequence.
EELAKEVVKRVRELVDRSRRLMTESVRKVRELVEDIRRRVRESVEKLRRLVEEIERRIR

SEQ ID NO: 9996 - protein, 60 aa, Artificial Sequence
  Synthetic sequence.
KEVEKLVKDVERMVEESLKENERLVKKSDELVKESEKRNKELAERSRRLVKEITDRLAEE

SEQ ID NO: 9997 - protein, 59 aa, Artificial Sequence
  Synthetic sequence.
EDVLRDLRRVVEEVTEKIKEVNRRSEEANKRSKDRIEEVNRRSEKVNEDVEREIERALR

SEQ ID NO: 9998 - protein, 60 aa, Artificial Sequence
  Synthetic sequence.
DELEKAVERVKDIVRKSLELLKRLADRVRDIVREILDEVRRNVEEVRRIVKEIVEEVRRR

SEQ ID NO: 9999 - protein, 59 aa, Artificial Sequence
  Synthetic sequence.
EEALKRLERVVREVAEESDRANKELDRVVEEVKERVERVLRESNKVVKEVEDRVREETR

SEQ ID NO: 10000 - protein, 57 aa, Artificial Sequence
  Synthetic sequence.
SVKETVEEEVRRVSDEDRRINRDVERVSEESNRRLDKVHKELEEVVKEVLKELDDTG

SEQ ID NO: 10001 - protein, 59 aa, Artificial Sequence
  Synthetic sequence.
EETARRVVEEARRIVAESKELVKEVVRRSDELVRDVEKHSRDVAKTVRKIVTDVARRTR

SEQ ID NO: 10002 - protein, 57 aa, Artificial Sequence
  Synthetic sequence.
SAEETLEKVIRDVEEEDKKAHEDSRRVIETVKEEIDRVHKDSKRKIDEVKERIRREV

SEQ ID NO: 10003 - protein, 60 aa, Artificial Sequence
  Synthetic sequence.
LEERVRRIVKEVREIVKRSKERSDEIVKEVKRIVKEALDLSREIVERVERIVREVVERAR

SEQ ID NO: 10004 - protein, 57 aa, Artificial Sequence
  Synthetic sequence.
EADERLRKRLKEVNERDKKAHEDSKRAIDRVREEDKRVLDTVREEIKRVKDEIRRAL

SEQ ID NO: 10005 - protein, 60 aa, Artificial Sequence
  Synthetic sequence.
LERLVREVVRENEELVTRSEELSRRIVEEVKRIVDESRKRAKEIVDEVRKRVKELVDTDK

SEQ ID NO: 10006 - protein, 57 aa, Artificial Sequence
  Synthetic sequence.
DVREKLEKVLREVERRVEKASRESKETLDRVRKRLKDVSDESKRELERVKKRVDDAD

SEQ ID NO: 10007 - protein, 59 aa, Artificial Sequence
  Synthetic sequence.
KKVIEELVEEVRRLVTEHERLSRELVDRVEKLVARHEELSKKLVTDAERIVKEVEERAK

SEQ ID NO: 10008 - protein, 57 aa, Artificial Sequence
  Synthetic sequence.
SALERLREVLERVLRRVKKVTDDARRVNERVNRKVDRVSEDSERELRRVLKRVREAS

SEQ ID NO: 10009 - protein, 59 aa, Artificial Sequence
  Synthetic sequence.
EEVLRELVERAKKLVDDHLELVERLVRESEKLVEDHLRRSKKIVEDVKRIVEDVERRVK

SEQ ID NO: 10010 - protein, 60 aa, Artificial Sequence
  Synthetic sequence.
DEVDKARKEVDRVVKESRKLVEKNVREVEEVVKTVEKLVEDVIRRVEDVVREVKELVTRG

SEQ ID NO: 10011 - protein, 59 aa, Artificial Sequence
  Synthetic sequence.
EELLDRVRKVVEDVSRKSKKALDESHEVVKRVKDRADEVLDKVRRAVEEVERRIETEAR

SEQ ID NO: 10012 - protein, 60 aa, Artificial Sequence
  Synthetic sequence.
DEVEKAVKEVERVVREVKELVDRNIDEVRKVVEDSKRLIDELVEDAKRVVKRVKELRDRG

SEQ ID NO: 10013 - protein, 59 aa, Artificial Sequence
  Synthetic sequence.
EELLDRVRRVVEEVKKEADRLLEESHRVVREVSERSKRALEEVKRVVDEVTERIKKDKD

SEQ ID NO: 10014 - protein, 57 aa, Artificial Sequence
  Synthetic sequence.
STKEKLDDVLRRVEEKAREVVEDNRRADRDVHRKARKVVEELRRVDEEVHETVKRVD

SEQ ID NO: 10015 - protein, 56 aa, Artificial Sequence
  Synthetic sequence.
VDEVVDRLRRLVEEVLRHSKKNSRESDEMVRRVTEEVREVVKESKERVDDVLKRVE

SEQ ID NO: 10016 - protein, 60 aa, Artificial Sequence
  Synthetic sequence.
KKVEEIMERLRRVAKEIKERVDRLVEKNRKSAKDLLDTIEDIVRKNRDLAEKIKDLARRR

SEQ ID NO: 10017 - protein, 56 aa, Artificial Sequence
  Synthetic sequence.
KEKLRRVLREVEEVVRRVKKKLDDSVRELREIIRRAERELREVDEEVRKVVEDVKR

SEQ ID NO: 10018 - protein, 59 aa, Artificial Sequence
  Synthetic sequence.
RVREELKKVEEEVREVVRRAKEKTRRVLEEMRKVVKDVDDESKRVVDEVKKVLEEVRAR

SEQ ID NO: 10019 - protein, 59 aa, Artificial Sequence
  Synthetic sequence.
EEVVKKVVDDIRKLAKDMDDHSKEVVDRIREVARRIEELNRELVRDLKDEVRRVKEKAK

SEQ ID NO: 10020 - protein, 59 aa, Artificial Sequence
  Synthetic sequence.
SVRETLKTVEEEVKRVIDRARKRDERVVREVERVLRDAMRKDEDVNRDVERVLRDVVRR

SEQ ID NO: 10021 - protein, 59 aa, Artificial Sequence
  Synthetic sequence.
KDVFKRVVEELRRLVKRVEELVTRTVEEIDRIAKEVTRHSEETVRRLKKLVKTVTDEAN

SEQ ID NO: 10022 - protein, 59 aa, Artificial Sequence
  Synthetic sequence.
SSVREVVKEARDIAKENLERVKKTVKENRDLARKVAEDVKKSVEELRKLAEDVEEIARK

SEQ ID NO: 10023 - protein, 59 aa, Artificial Sequence
  Synthetic sequence.
EELEKELRTVVREVEEVLRRSEEDDRRVHKEAEDVIKKVEEDDKEVVDRVKKVIRDVRT

SEQ ID NO: 10024 - protein, 59 aa, Artificial Sequence
  Synthetic sequence.
SEVEKIVKEAEDLVREVKRRVEDTVRKNRELADRVRKEVDKSVRELRELVKRVLDIAKD

SEQ ID NO: 10025 - protein, 59 aa, Artificial Sequence
  Synthetic sequence.
EELRRELERVIKKVEEVIRKAEEDDRTVHRELNKIIKDVEDKDRTVVEEVERVIEEAER

SEQ ID NO: 10026 - protein, 59 aa, Artificial Sequence
  Synthetic sequence.
SEVDEVVERARRIAKENLDRVKKIVRENRELVEKVRKDVEDSVRTLKKLVDDVTEIARK

SEQ ID NO: 10027 - protein, 59 aa, Artificial Sequence
  Synthetic sequence.
DDMRRKLETVVKEVEDILRRSREEIRTVNEEVEKVIEEAEREDERVVREVEEVIKRVEK

SEQ ID NO: 10028 - protein, 59 aa, Artificial Sequence
  Synthetic sequence.
SSVEDVVRKMRKIVEDNKREVEKIVRENRKMAKDNEDLVKESVKDLKRLAKELEDLAKD

SEQ ID NO: 10029 - protein, 59 aa, Artificial Sequence
  Synthetic sequence.
EDLERTLRTVVKEVKEVLDRSRDLVRRVNEEVKRVLDRSREEDERVVREVEEVIRRVET

SEQ ID NO: 10030 - protein, 59 aa, Artificial Sequence
  Synthetic sequence.
REVDEIVDRLRRIAKENKDRVRELVERNRKLAEEVRRRVEESVKRLRDLVRTIEELARR

SEQ ID NO: 10031 - protein, 59 aa, Artificial Sequence
  Synthetic sequence.
EDLERKIREVVREAEEVLRESKREMDTVNKEVREVIEDVRKRDEDVIREVEKVIREVEQ

SEQ ID NO: 10032 - protein, 59 aa, Artificial Sequence
  Synthetic sequence.
SEVDEIVKEIREIARKNKEDVRRTVEDLRRLVKEVEKRVEDSVRTMRDLVRRLEETARR

SEQ ID NO: 10033 - protein, 59 aa, Artificial Sequence
  Synthetic sequence.
EELERKLKTVIDEAEKVLRESEEDDRRVVEEVERVIKKVEEEDRKAVREVEKVLEDVRK

SEQ ID NO: 10034 - protein, 60 aa, Artificial Sequence
  Synthetic sequence.
REVDELLKRIKEVADDIKRLSDENVKEIEKLAREVEKLVRDVVRENEEVAKEIEDLARRR

SEQ ID NO: 10035 - protein, 56 aa, Artificial Sequence
  Synthetic sequence.
KKKLRDVLRELEKVVRDVAKEDEDANRRLKEVAERVKREIDEVDKKLKKVLDDVRK

SEQ ID NO: 10036 - protein, 60 aa, Artificial Sequence
  Synthetic sequence.
REEEKLRKVLEDAKKVSKEVNEEDDRVNKEVEDVLREVKKEIDEVLKRATETVERVKREN

SEQ ID NO: 10037 - protein, 56 aa, Artificial Sequence
  Synthetic sequence.
VDEIVKRIKELVDRSRKLSEENVRRLKKIVKRVKERVKELLDRIKEMAKEIEDRVR

SEQ ID NO: 10038 - protein, 60 aa, Artificial Sequence
  Synthetic sequence.
DEEKKLKEVLDRATKVVKDVAEELDRVLEDVERVSRDVNRRDEKVNRDADRVLREVKDEN

SEQ ID NO: 10039 - protein, 56 aa, Artificial Sequence
  Synthetic sequence.
VEEIVRRIEEVAKTLREIVRRVLEELKEVVKESERLSRENVRRIEKLAEEIRRRVK

SEQ ID NO: 10040 - protein, 60 aa, Artificial Sequence
  Synthetic sequence.
DEDEKLRKVLEELRRVVEEVKRRSDKALEDAERVLRRVKKEDRDANKKAEDELRRVIDEN

SEQ ID NO: 10041 - protein, 56 aa, Artificial Sequence
  Synthetic sequence.
VDEILKRIEELMKEIRKLVKEDVDRIRDLVRRIDEESKENVKEIERVADEIRERIR

SEQ ID NO: 10042 - protein, 60 aa, Artificial Sequence
  Synthetic sequence.
KEVEDVLREVEKVVEKIKRDVEKIVKDSKELAKRVEELVKESEDRSKEIVDRVEKLRREG

SEQ ID NO: 10043 - protein, 56 aa, Artificial Sequence
  Synthetic sequence.
EEKVEKVLRKVRDVVRRVKEKVEEVHRRSREMLKRVEDRDREAHERSRKVAEDVKR

SEQ ID NO: 10044 - protein, 60 aa, Artificial Sequence
  Synthetic sequence.
SEVDEVLETIERIVREVKKLVKRSVEESERLVDEVEKLVEKSVREIKEIVDRIRDMKTKG

SEQ ID NO: 10045 - protein, 55 aa, Artificial Sequence
  Synthetic sequence.
EKVERVLEEARRVIEEVEREDDDAHRKSKEVLKRVLEKDRKALEDAKKVVEEVKR

SEQ ID NO: 10046 - protein, 59 aa, Artificial Sequence
  Synthetic sequence.
KEVEDLERRNKELVERVDKLSRENVERNKKLAKELKEISEENVRRNRKLAEELKEVADR

SEQ ID NO: 10047 - protein, 59 aa, Artificial Sequence
  Synthetic sequence.
EDLRRRVKKSHDEVERELRRVDREDETSHEELRRVLEKVKREDRKSHEEVKRRLDEVRR

SEQ ID NO: 10048 - protein, 59 aa, Artificial Sequence
  Synthetic sequence.
SEVDEIVKRNDDLAKEVKRLSTENVKRNKELADRVKRLSTENVKTNEKLAKDLERVVRR

SEQ ID NO: 10049 - protein, 59 aa, Artificial Sequence
  Synthetic sequence.
ERLRRKVEKSHRDLREVLERVRREDERSHEEANKVLEDVKREDEKSHRDVKKRLDDVRR

SEQ ID NO: 10050 - protein, 60 aa, Artificial Sequence
  Synthetic sequence.
SEVDRLLEKLEELVRKVRRDVEENVKKNDELAKEVERLSKRNVERNEELAKEIEDLARRG

SEQ ID NO: 10051 - protein, 59 aa, Artificial Sequence
  Synthetic sequence.
EELKEKVKRVMEKVKRVLDRVREEDEKSHRKADRVLREVEKRDRDSHERLRKVLDDVRR

SEQ ID NO: 10052 - protein, 59 aa, Artificial Sequence
  Synthetic sequence.
DEVREIVERNERLAREDKKIAEENVRRNEDLVRRLRELSRKNVEDNRRLAKELEEVAAR

SEQ ID NO: 10053 - protein, 59 aa, Artificial Sequence
  Synthetic sequence.
EELKKRVKDSHDKLREVSKRSEELDRKSHEDLKEVLKEVRERDDRSHEELRRVLEEVKR

SEQ ID NO: 10054 - protein, 60 aa, Artificial Sequence
  Synthetic sequence.
DEVERILERIDELVKRVKELSRRNVERNKELVERVDRLVKDNVDRNRRLAEEVDRLKKEG

SEQ ID NO: 10055 - protein, 59 aa, Artificial Sequence
  Synthetic sequence.
EELTKKVEKVVKDAKKTLEEVKREDEDSHKKANDVLRRVRELDKRSHDELKRVLDEVER

SEQ ID NO: 10056 - protein, 59 aa, Artificial Sequence
  Synthetic sequence.
SEVEDVLKKLDDIAKEVTERVKRVLDRNEEIVDEVEKLVEEVVRRNKEIVKEVKRLKDE

SEQ ID NO: 10057 - protein, 58 aa, Artificial Sequence
  Synthetic sequence.
DLEREVRRVIREVEKVIDDVRREVERSIRKSEKDIREVEKRVEDVNREVEEAIRRVRT

SEQ ID NO: 10058 - protein, 60 aa, Artificial Sequence
  Synthetic sequence.
REVEELVKKLKELAERSLTAVERIVEENERLLKRLEDESKRNVDDIERLARELLRRVEEE

SEQ ID NO: 10059 - protein, 59 aa, Artificial Sequence
  Synthetic sequence.
ERVERILTKVIEDLERVDKAAHDILREVNERLREVMERVEKTNRTVNRRLEEVLKEIER

SEQ ID NO: 10060 - protein, 59 aa, Artificial Sequence
  Synthetic sequence.
DEVEEIAREMREIVDRVLKLSEKTVRENRESVERLLRLSEETVRRIRDLVRRLEELARD

SEQ ID NO: 10061 - protein, 59 aa, Artificial Sequence
  Synthetic sequence.
EEMKEKVERAVEEVKRVLDRVRETDKRVNEEVRKVNEEAERIDEKVVREAREVLKRVRD

SEQ ID NO: 10062 - protein, 60 aa, Artificial Sequence
  Synthetic sequence.
RVAERLEDVLRELDRTLKDVARKLEEANRDNKRVLEEVAEILKRVLDDLRRVLDEVAKRL

SEQ ID NO: 10063 - protein, 59 aa, Artificial Sequence
  Synthetic sequence.
EKVVDDIVKEVRELAERIKEVVTESVKHSKKNVDEMRKLVDDVVKKVKKLVEDVRREIK

SEQ ID NO: 10064 - protein, 60 aa, Artificial Sequence
  Synthetic sequence.
SVAEKLRKVLEELRDVLRRVKEISRRSLERLKKVLKELADRLKELNDKLRKTLEELRKDV

SEQ ID NO: 10065 - protein, 59 aa, Artificial Sequence
  Synthetic sequence.
EELVEEIVKEIKKLAKEVAETVDKVAKENEKLAKEAKEKVEESERDVERLLEELKREAD

SEQ ID NO: 10066 - protein, 56 aa, Artificial Sequence
  Synthetic sequence.
DEEKILEDVLRELKKVLDEVRKTNEDANKRLKDVDDKSHEILKRVEERLREVVKRV

SEQ ID NO: 10067 - protein, 56 aa, Artificial Sequence
  Synthetic sequence.
VEDVVRRVRKVAEDVRRSSEETVKRIEDVVRRSEETVRELVKRVEDLVREMEEEAK

SEQ ID NO: 10068 - protein, 56 aa, Artificial Sequence
  Synthetic sequence.
SDEEKLRKVERELEEADKESHEINRTVNEDLRRVDRESKEILDRVRKELEEVKDKI

SEQ ID NO: 10069 - protein, 56 aa, Artificial Sequence
  Synthetic sequence.
VEDLVRRVRKVAEDSRRSSEDTVRRVERVVRESKRLVDDLVRRARRVVEEIKRTAK

SEQ ID NO: 10070 - protein, 56 aa, Artificial Sequence
  Synthetic sequence.
KEDEILKTVVDELRDALREVEERNRTVNEELRRADKESEDRLRKVVRELTEVMKRV

SEQ ID NO: 10071 - protein, 56 aa, Artificial Sequence
  Synthetic sequence.
VEELVRRVREVVKRVRDSSRETVERVKRVVERSRRLVERLVRKVEEVVREVEERAR

SEQ ID NO: 10072 - protein, 60 aa, Artificial Sequence
  Synthetic sequence.
SDVDRFLREVERLVERARKLSERDERETRKVVKEVRDSSRKSVEDSKRVVEKLEEEARRG

SEQ ID NO: 10073 - protein, 56 aa, Artificial Sequence
  Synthetic sequence.
KEKLDKVLEDLRRVVEEVKRRNDEVLKRLKEVVDEVTKRNRKALEDAKERLKKVTE

SEQ ID NO: 10074 - protein, 60 aa, Artificial Sequence
  Synthetic sequence.
SEVDEVAKRVREIVERLRDLVRKVVEDNERIAREVKRSSDETLKEIRDIVRKAKEVADRG

SEQ ID NO: 10075 - protein, 56 aa, Artificial Sequence
  Synthetic sequence.
ERKIDKVLKELEEVITDVRRTLDDVDRKLREVVKKVEEINRRANEELERVIREVRR

SEQ ID NO: 10076 - protein, 60 aa, Artificial Sequence
  Synthetic sequence.
DDVERLLKKVEDIVRELRESSRKSVEEIKRIVKEVKRLVDEVVKENERIVEEAEDVMRRG

SEQ ID NO: 10077 - protein, 56 aa, Artificial Sequence
  Synthetic sequence.
REKLDEVLKRARDVLREVEKENDKANKELEEVAERVKKTLDDVDKKLEDVMRKVTK

SEQ ID NO: 10078 - protein, 60 aa, Artificial Sequence
  Synthetic sequence.
KEEEIVERVREKIKRVLDEVREIDKRAHDELRRVLKEVEDIVRKVHEDLKRVLEEVRREV

SEQ ID NO: 10079 - protein, 56 aa, Artificial Sequence
  Synthetic sequence.
VKTVVETVDKIAKEVRDLSRRSVEENRKLAREVREVVRKVVEDNRRLAREVRERVR

SEQ ID NO: 10080 - protein, 60 aa, Artificial Sequence
  Synthetic sequence.
DEDEKVEKVTREVEKALDEVRKIDEEAHRRLKRVLDEVRRIDETVHRDLKRVLDEVRERV

SEQ ID NO: 10081 - protein, 56 aa, Artificial Sequence
  Synthetic sequence.
VETVVERLRRLVEDIRRKSRESVERNRELVKEAKDVSRKSVEENKKLVRDITREAT

SEQ ID NO: 10082 - protein, 59 aa, Artificial Sequence
  Synthetic sequence.
SVDEIVERVERELKRVLDEVREIHDRARDELRRMHERSERIIRKVEEELERALKEVRDR

SEQ ID NO: 10083 - protein, 59 aa, Artificial Sequence
  Synthetic sequence.
DKVVREAVREVERVVTELLEESRRSVEKTERLVRRSEELIRKIVKEVKKVAREIREEVR

SEQ ID NO: 10084 - protein, 59 aa, Artificial Sequence
  Synthetic sequence.
SVDEILRKVKEELDRVLEEVTEIHRKAKEELDRAHDTSERIHREVKRELDRVREEVERQ

SEQ ID NO: 10085 - protein, 59 aa, Artificial Sequence
  Synthetic sequence.
EKVVKEVVDEVRKVVEEIRKKSKDSVDKTKRVVEESIRTSDEVVKKTEKLVREIEKEVR

SEQ ID NO: 10086 - protein, 59 aa, Artificial Sequence
  Synthetic sequence.
SVEEIVRKVTKELRDAHRRTEKILRDVDKELKEVLDRVRKIHRDVKERLEKVLDDVRKR

SEQ ID NO: 10087 - protein, 59 aa, Artificial Sequence
  Synthetic sequence.
EEVVTRAVERVKRAVKKSEDDVRRIVDENRKLVKEIEDRSRESVKKTEELIERIRKRVE

SEQ ID NO: 10088 - protein, 60 aa, Artificial Sequence
  Synthetic sequence.
NVEDILRKAEEEVRRMLAENERIVEEAKERAKRMLDESRKRLEEVLRRAREVLEEVDKRK

SEQ ID NO: 10089 - protein, 59 aa, Artificial Sequence
  Synthetic sequence.
EDVVRAVVEELRRLLEESIRHVRKVVREIEKLLREDIELVKEVVRRIERLLRELDKEVR

SEQ ID NO: 10090 - protein, 60 aa, Artificial Sequence
  Synthetic sequence.
RKVDELRKEVRRVVKESRDKAKRVVEEVKRLVEKSRRDVKRVVDENRRVVEEMRRKVKDR

SEQ ID NO: 10091 - protein, 56 aa, Artificial Sequence
  Synthetic sequence.
DKEVKDAEDELDKAHEDTKKILDEVKKELDDAHDETRRILEEVNKESETVLEEVER

SEQ ID NO: 10092 - protein, 60 aa, Artificial Sequence
  Synthetic sequence.
SLARRVEEEVKRVVDESEEKVRRVVKVNKEMVDDVRRLVKEVVDENEEVVKEVRDTVTKR

SEQ ID NO: 10093 - protein, 56 aa, Artificial Sequence
  Synthetic sequence.
REDVRRVEEELKKAHDDTKKILDDVDERSREALDEVRKELDRVNKRSDKALKDVRK

SEQ ID NO: 10094 - protein, 60 aa, Artificial Sequence
  Synthetic sequence.
SKAEELVKRVKEVVDKVRKLVEEIEEKVKRVVEKSRRDVTEVVKKNREVVKRVKDTVRRR

SEQ ID NO: 10095 - protein, 56 aa, Artificial Sequence
  Synthetic sequence.
EEIVRRAREELERVLDEAKRILEKVTRELDEAHKETEKILRDVNRESDKALEEVER

SEQ ID NO: 10096 - protein, 59 aa, Artificial Sequence
  Synthetic sequence.
SEDEKLDKVRKRLERAHEESKKISDKSEKDTRDAHRKTEEILDRVRKEMEEVLKRVRDR

SEQ ID NO: 10097 - protein, 56 aa, Artificial Sequence
  Synthetic sequence.
AEEIVKDVERVVKESEDLVRRIVEINERIVRESERLVKEVKDRVRDMVRRLAEEAR

SEQ ID NO: 10098 - protein, 59 aa, Artificial Sequence
  Synthetic sequence.
SVEDIIRKVEKEVEEVVEKVERILDTVRRRSEKVLRENKEILEEVKRRADKVLRDVERN

SEQ ID NO: 10099 - protein, 59 aa, Artificial Sequence
  Synthetic sequence.
EEVAKRLEDRVREIVRTLEDLVREIVRRSEESVRRSRESAKRVVDTVKRIVDELEKRVR

SEQ ID NO: 10100 - protein, 60 aa, Artificial Sequence
  Synthetic sequence.
DVEEIIRRVSDKARKVLDRNRKILEDVKRRSEEVLEENKRIVDEVDEIIDEVLKRVKKRS

SEQ ID NO: 10101 - protein, 59 aa, Artificial Sequence
  Synthetic sequence.
REVVDRAVKRVEELVKRSERSADEVRKRSTESVKESKRSAKKVVEDVRRLVEELERRVR

SEQ ID NO: 10102 - protein, 60 aa, Artificial Sequence
  Synthetic sequence.
SEEDIIREAERIAREALKRARKIAEDARRISEKALEDARRIAKEAHDISKKALEDAARKR

SEQ ID NO: 10103 - protein, 56 aa, Artificial Sequence
  Synthetic sequence.
AKRAAEEAKRLAEEAEEAAKRVADRNRKLAKEAADLAREVAKRSEELAREAAKKAQ

SEQ ID NO: 10104 - protein, 60 aa, Artificial Sequence
  Synthetic sequence.
REDEKIEEVKRRAEEVLKESKKIIEDVLKKSEEVIKEVREILEKAHRISAKVLDEVRKTR

SEQ ID NO: 10105 - protein, 56 aa, Artificial Sequence
  Synthetic sequence.
VDEVVERVERIVTKNLRLAERVVEENEKLVEDLRRLVADVVRTSKKLVDDVRERVR

SEQ ID NO: 10106 - protein, 60 aa, Artificial Sequence
  Synthetic sequence.
SEDEKVDEATKEAERVLREVRKIIKRAHDRSRDAEREVKRTLDEVRRETKRVLEDVDRTR

SEQ ID NO: 10107 - protein, 56 aa, Artificial Sequence
  Synthetic sequence.
VDEVVRRVKEIVRRLEELAKEIERRSDEIVEEIRRLVKKVVDENRKIVKKAEEDAR

SEQ ID NO: 10108 - protein, 60 aa, Artificial Sequence
  Synthetic sequence.
DEDEIIDEAKKRADEVLKRSEDILRRAREEVEKVLEEVRKIIEDVHRRSRKVLEDVRRKA

SEQ ID NO: 10109 - protein, 56 aa, Artificial Sequence
  Synthetic sequence.
VETVVRRVDEIVKRNEELARRLVEEAKKIVDDLRRLAEEIVKRSEDLVEKLKEDAR

SEQ ID NO: 10110 - protein, 60 aa, Artificial Sequence
  Synthetic sequence.
SIEDVLRDVARKLRTVVDEARKILDEVDKATEKVLREAERVIREVAKRDKKVVDEVRKGG

SEQ ID NO: 10111 - protein, 56 aa, Artificial Sequence
  Synthetic sequence.
AEDLLKLVEDVVRRIRKLAEDVKRENDKLVERIREVAEDVLRHSEETVEEARKAAE

SEQ ID NO: 10112 - protein, 60 aa, Artificial Sequence
  Synthetic sequence.
SSEEALKEVERRLEDVRREVKRVAEEIKKKDDKVNDDAREKLERVNRETKRVLEELAREG

SEQ ID NO: 10113 - protein, 56 aa, Artificial Sequence
  Synthetic sequence.
VEELKDKVRRLLEELKRLLEELDKHSARTIKEIRDLIETLRRINEKVIEDMKRRRD

SEQ ID NO: 10114 - protein, 60 aa, Artificial Sequence
  Synthetic sequence.
SELDEAKRLVDEVVRRLEELLREDKKLVAEVEREVRELLERNARLLKEVADRIRRLKEEG

SEQ ID NO: 10115 - protein, 59 aa, Artificial Sequence
  Synthetic sequence.
EKVVREIERLLRELEKALEDVERELRRSKDRLRKLAEEVKKVLDDSRRELERLREELRT

SEQ ID NO: 10116 - protein, 60 aa, Artificial Sequence
  Synthetic sequence.
KDIEDAVRDVRRKVKELIENSERVVRTVEKLVRELIDHSRKVVREVEKLAKELIELKRRG

SEQ ID NO: 10117 - protein, 56 aa, Artificial Sequence
  Synthetic sequence.
EEVLKEVDRVLREAEKRSKEINEESKRVLDKAERDSRRIDRKSEEVVKRAEEEVRT

SEQ ID NO: 10118 - protein, 60 aa, Artificial Sequence
  Synthetic sequence.
EEIERVLRRVTERLKELERHSEEVLREVERLVKEDEDLAREVVKRVEELIRTLRELKKRG

SEQ ID NO: 10119 - protein, 56 aa, Artificial Sequence
  Synthetic sequence.
RRVLEEVREVVDRAEKKIKELDDRSREVLKEVEKRSRDIIREIEEKLKDVEERVKD

SEQ ID NO: 10120 - protein, 60 aa, Artificial Sequence
  Synthetic sequence.
SKAEEVAKRVEDLAREDIKLAERAAREVERLARENIKLAREVAKRVEELARRLIEAARRG

SEQ ID NO: 10121 - protein, 56 aa, Artificial Sequence
  Synthetic sequence.
EKALKDAEDAARKAAEDSERAIERAERAAKDALKKSEDAAEEAKRAADKALEDAAR

SEQ ID NO: 10122 - protein, 60 aa, Artificial Sequence
  Synthetic sequence.
DEVRDLVRRVRELSEELIRRVRTLLREVEELSRRLIEESERLLREVRKIVEELIRRVERR

SEQ ID NO: 10123 - protein, 56 aa, Artificial Sequence
  Synthetic sequence.
ERVVKEAEEVVERANRESEKLLEDVKRVVEEANKTSEDILRAVEEIVRRVLEELKK

SEQ ID NO: 10124 - protein, 60 aa, Artificial Sequence
  Synthetic sequence.
SSKEVLERVAEKLKEVNERLKDVLRRVAEKLKRANEENKKVLERVRDILREVLRRLREKV

SEQ ID NO: 10125 - protein, 56 aa, Artificial Sequence
  Synthetic sequence.
VEEAERVVEKSVEEARRLAERVKEEVDRSVKHSEDNVREMRRLVEEIVKRVEEAAK

SEQ ID NO: 10126 - protein, 60 aa, Artificial Sequence
  Synthetic sequence.
REKEVLDRVEEILRDANRRNEKVLREVAEIIRTVIEDNKRVLKEVADELRRVLEELRDKV

SEQ ID NO: 10127 - protein, 56 aa, Artificial Sequence
  Synthetic sequence.
VEEMEDVVRRSLDHSRRNVEEAKKAVTKVVEDNKDNVRRIKEVVARVVEKAREEAR

SEQ ID NO: 10128 - protein, 60 aa, Artificial Sequence
  Synthetic sequence.
SEVEEVLRRSRESAKKSKEHSRELLEKVKRIIDDVKRLVREVLKRSRDSIKRVEDLTRRG

SEQ ID NO: 10129 - protein, 58 aa, Artificial Sequence
  Synthetic sequence.
EKVKEAVKESRDLLRKVEETNRRVNDEVRKLLEDIRRDVERAVEESERLLEDIVRKVK

SEQ ID NO: 10130 - protein, 57 aa, Artificial Sequence
  Synthetic sequence.
SDVERVLTEIRKLVEDIKRDVERVVDESRKLVEEAERDVERVITEVEKLVERIKREV

SEQ ID NO: 10131 - protein, 56 aa, Artificial Sequence
  Synthetic sequence.
ARELLKRVRELIKEHNRLNRESLKTSRKNIEDHHEDNKRSLEEARRIIEEVREAAR

SEQ ID NO: 10132 - protein, 60 aa, Artificial Sequence
  Synthetic sequence.
KELEDVEKEVEEVAKRVEDSIRRNREVVEKVKDEVRRLLDRNDELVDRVAKEITEAIKKG

SEQ ID NO: 10133 - protein, 58 aa, Artificial Sequence
  Synthetic sequence.
EKVKKVLEDVRRRLEELIKRSEDSAREVEKRLEDLRREVEESLERVERTLEDLVRRVK

SEQ ID NO: 10134 - protein, 60 aa, Artificial Sequence
  Synthetic sequence.
SELERLEERVRRIEEEVKRLLEEHREVSDRVAKENRRSNEESKREVRRIEEEVKDLSRKG

SEQ ID NO: 10135 - protein, 58 aa, Artificial Sequence
  Synthetic sequence.
EEVKKVVEDVKRRLDDLIRKAEKVVRDSERELKKLVDHSKEVVDRVRERLKELIEEAR

SEQ ID NO: 10136 - protein, 60 aa, Artificial Sequence
  Synthetic sequence.
SEVEDLERRVKRILEESDELVKRHEEKSRKIVKDLEDLLRRNEDTVEKILRELEKRIRDG

SEQ ID NO: 10137 - protein, 58 aa, Artificial Sequence
  Synthetic sequence.
ERVTRVVEKVRRLLEESKRRSKEVVKRSKDLLKEAEDRADESVRELRRKLKELEEKAE

SEQ ID NO: 10138 - protein, 59 aa, Artificial Sequence
  Synthetic sequence.
SELEDIRRLLEKLDREVKELLKRSRDLAKEMEERVRKLVKESEDELRKLAEKVDRIKKN

SEQ ID NO: 10139 - protein, 58 aa, Artificial Sequence
  Synthetic sequence.
DEAREVLKDVRRKVEELRKELTKVDKEIEEIVRELEKRLREVNERVRTIVDELAKRLK

SEQ ID NO: 10140 - protein, 56 aa, Artificial Sequence
  Synthetic sequence.
SMLEELDKEARELLKEVRRLVEDNDRLLEELLRRARELLERNDRISEKVADEVRKI

SEQ ID NO: 10141 - protein, 58 aa, Artificial Sequence
  Synthetic sequence.
ERMREVAKKVKDILKRAEEEVRESLERVRRELERVIRELEDSLRRNDKTLRDLIEERR

SEQ ID NO: 10142 - protein, 56 aa, Artificial Sequence
  Synthetic sequence.
SDLERLDELLKRVLEKARKLVKENDEHSEEVRKTVEKVVRDNDKLAEDLADKVEKI

SEQ ID NO: 10143 - protein, 58 aa, Artificial Sequence
  Synthetic sequence.
ERVKEVLDRVDEILKRVIKAAEESLKRSHEINRRLIKAAEDSLRRVKKILDELEERVR

SEQ ID NO: 10144 - protein, 56 aa, Artificial Sequence
  Synthetic sequence.
STLDKLRELLRRVEETVREVLERNDEHSKEVKRRVDKLLRENDEHSKELADLVRKI

SEQ ID NO: 10145 - protein, 58 aa, Artificial Sequence
  Synthetic sequence.
REMEKVLTDARRSLRRLEERVRESLERSHRINRKLRKDVRESLERSKRILDKLREEVR

SEQ ID NO: 10146 - protein, 56 aa, Artificial Sequence
  Synthetic sequence.
SVLEELRKLVEKVLREVDKLLKDNNRHSEEVEKTVKRLLDENDRLLEELADRVEKI

SEQ ID NO: 10147 - protein, 58 aa, Artificial Sequence
  Synthetic sequence.
EEAKKVLTEVRRTLEELERRVRKSLKDSHDINRKLEKEVRDSLKRVKDRLDELIKRVR

SEQ ID NO: 10148 - protein, 57 aa, Artificial Sequence
  Synthetic sequence.
RKAEEVLKRAKKIVDEVDKKNRESLERTRKIVEDVNEENREVLDRLRRRAEELKKEV

SEQ ID NO: 10149 - protein, 59 aa, Artificial Sequence
  Synthetic sequence.
DDVVRRIEEVIEKARRENDESVRRDEKLMKEVKDENKKTVDDIRRLLKDIEDKVREAKR

SEQ ID NO: 10150 - protein, 57 aa, Artificial Sequence
  Synthetic sequence.
SKLEEVVKRLEEIVRRVKRADEESLKRTRKIVEEVNRDNRRSLKESRDRVDELKKRV

SEQ ID NO: 10151 - protein, 59 aa, Artificial Sequence
  Synthetic sequence.
DEVVKRIEEVAKRNEELNRETVKRDEDLVREAKRRNEETVERDKRLVEKITKEVDETKK

SEQ ID NO: 10152 - protein, 56 aa, Artificial Sequence
  Synthetic sequence.
SLIETIRDLAKKLKEESDKSVETDKRLVEELRRRSKKTVDDIDELVKRLERMVEDD

SEQ ID NO: 10153 - protein, 58 aa, Artificial Sequence
  Synthetic sequence.
EDAKRVLEELKRIIEDLLRKNKKSLDDTEREVRRLIKENETVVRKLEEIVKRLEEKIR

SEQ ID NO: 10154 - protein, 56 aa, Artificial Sequence
  Synthetic sequence.
SLLEEIAELVERLRRESKESVKRDEELVDELKKRSEETVKEDKRLAEELDRLAKKI

SEQ ID NO: 10155 - protein, 58 aa, Artificial Sequence
  Synthetic sequence.
EEMKKVLDDLRREIKKLEEENERSLERTRDIVRKLDRTNEESARESEKIIREVVKEVK

SEQ ID NO: 10156 - protein, 56 aa, Artificial Sequence
  Synthetic sequence.
SLLERIKEEVEKLRKESEESVETDERLVEELKKEVKDLVEKDRKLAEDLKDEVDKD

SEQ ID NO: 10157 - protein, 58 aa, Artificial Sequence
  Synthetic sequence.
ERAKEVLRDLRRTVKELTDENEKSLERTRREVEKLIRELEESLRESRRRVKRLLEKVK

SEQ ID NO: 10158 - protein, 56 aa, Artificial Sequence
  Synthetic sequence.
SLLEEIERRVEELEDRSRKSVERDKELAKEVDDRNEESVRTDEELAKRLADLVRKR

SEQ ID NO: 10159 - protein, 58 aa, Artificial Sequence
  Synthetic sequence.
ERMEEVLKRLKEIVKELEERNRESLERTRRILEEVDRKNEESLKRSREIVRELDERVR

SEQ ID NO: 10160 - protein, 56 aa, Artificial Sequence
  Synthetic sequence.
SLVEEIERRVEKLAEEVKRLVERDRKEVEKLEKESRDTVREIEELADRLRDAVEKE

SEQ ID NO: 10161 - protein, 58 aa, Artificial Sequence
  Synthetic sequence.
DEMRKVLTRLREEVRRLLDELRRSLEDTKRTVEDLERKNKTVVDELRKTVAELERRAR

SEQ ID NO: 10162 - protein, 59 aa, Artificial Sequence
  Synthetic sequence.
SIDEVLKRIREISDDAKRKIKEVVEEIKKNADRLRREIERVLDEIRKVIRELLERIKRV

SEQ ID NO: 10163 - protein, 59 aa, Artificial Sequence
  Synthetic sequence.
DEDLERLLREVERRTRRHEEELERLLRHNNKVSKEVREELKRLLDRVREMLEDVDRKLK

SEQ ID NO: 10164 - protein, 59 aa, Artificial Sequence
  Synthetic sequence.
SVEEVRKEVKRISDEAREEIERVLERIKENAKRLIEDIRRVLEEIEEIIRRLEDEIRRV

SEQ ID NO: 10165 - protein, 59 aa, Artificial Sequence
  Synthetic sequence.
DEDLEELLRRLERISRESRKRLEELLKHNNKESEEVRKRLKELLDDVRRVVEEVRRKLK

SEQ ID NO: 10166 - protein, 59 aa, Artificial Sequence
  Synthetic sequence.
SIDEVLEELKRISTEAVERIRRVAERNRKSVEEVRKRIEEVAKRIREIATRLLERIRRV

SEQ ID NO: 10167 - protein, 59 aa, Artificial Sequence
  Synthetic sequence.
DEELKKLLDELEKISRDSDERLKESTKKVRDVNRESDKKLKELLKRVEDVLEKVDRELK

SEQ ID NO: 10168 - protein, 59 aa, Artificial Sequence
  Synthetic sequence.
SVDEVLERIRESAETILEEIRRVLERNKRSAETILEEIRDVARKIEKRIRDVLKKIEDV

SEQ ID NO: 10169 - protein, 59 aa, Artificial Sequence
  Synthetic sequence.
DEELRKLLEEVKKINDDSRRKLEKSTRDVKKVNDDSRRELERLLRKVEEVIRRVDEELR

SEQ ID NO: 10170 - protein, 60 aa, Artificial Sequence
  Synthetic sequence.
KLEELVEEVEKVVREVKKELEDVVRTVREVVKRSKDDLREVVKEVERINRELEERLRRLA

SEQ ID NO: 10171 - protein, 55 aa, Artificial Sequence
  Synthetic sequence.
TELLERVKTLIKEIRDRLRRLLEEVKRLVEESKKDLKRLLDENKRLVDEATKTAK

SEQ ID NO: 10172 - protein, 60 aa, Artificial Sequence
  Synthetic sequence.
SLEELLKEVEKVIRDVKRELEKVVRDIEENVRRSAKRLREAEEEVERINRRLEEELKKKT

SEQ ID NO: 10173 - protein, 55 aa, Artificial Sequence
  Synthetic sequence.
TELLKRVRDLIRRIRETLEKLLKENHDLSKRSKEDVERLLKENADLVKELTDRAE

SEQ ID NO: 10174 - protein, 60 aa, Artificial Sequence
  Synthetic sequence.
SLEDLLREVKRVIEEVKRELEEVVRRVKEIVERSVRDLRRVVDEVRRINTELEERLRRLT

SEQ ID NO: 10175 - protein, 55 aa, Artificial Sequence
  Synthetic sequence.
TELLRRVEELIKEIRKELKRLLDEVKDLVDKSKENAKKLLEDNKRLVEKIARDAT

SEQ ID NO: 10176 - protein, 60 aa, Artificial Sequence
  Synthetic sequence.
KLEELVREVEKVVDDIRKELEEVVRRVEEVVRRSKRTLEDVVRRVKKINDDLEKELRERS

SEQ ID NO: 10177 - protein, 55 aa, Artificial Sequence
  Synthetic sequence.
TELLEDVKRVLDEIRETLERLLRKVEELVERSKRNAEELLKRNEDLAKKVRDDAK

SEQ ID NO: 10178 - protein, 56 aa, Artificial Sequence
  Synthetic sequence.
DVEDVLRKIEEIIRRVLEEIKTVLDEIRKNNEKLKEDVDRVLAEIEKDSEDLKRKI

SEQ ID NO: 10179 - protein, 58 aa, Artificial Sequence
  Synthetic sequence.
ELAETILRRVEELVEEIRRRLKEILDRDHELSKRLKEELKKILDDNHKLSRDAAERAR

SEQ ID NO: 10180 - protein, 56 aa, Artificial Sequence
  Synthetic sequence.
SVEDVLREIKETSDDAARKADEVLKEIEKNNRRLKKEIDRVHEHTKEDSRRLKEEI

SEQ ID NO: 10181 - protein, 58 aa, Artificial Sequence
  Synthetic sequence.
DLMREMLERNRKLIEDLKRELEDILRRDHRLSKELLARLKESNEENHRLSKEIRERRK

SEQ ID NO: 10182 - protein, 56 aa, Artificial Sequence
  Synthetic sequence.
RVEDVLRKVEEIIRRLKEEIDRVLEKIRETSERAVKDIRDVLRRIREDSKRLKEDI

SEQ ID NO: 10183 - protein, 58 aa, Artificial Sequence
  Synthetic sequence.
EDAERIVEEVRKLVEEIRKELEDILRKNEKLIEDLKRELKKILEENHRLSREIRERRR

SEQ ID NO: 10184 - protein, 56 aa, Artificial Sequence
  Synthetic sequence.
SAEDVLREITKTSERAREDIKRVLDEIKRTSDEAVKTVTDIHEHTRKTSEDLKRKI

SEQ ID NO: 10185 - protein, 58 aa, Artificial Sequence
  Synthetic sequence.
EVLRKILEENRELIERLKKELKELLDRNRKLIEDLLREAEKSNEDNKELIKKAEEDAR

SEQ ID NO: 10186 - protein, 56 aa, Artificial Sequence
  Synthetic sequence.
SVEKVLEDITRELRRADEESKRALDHSAEVLKDLERRVKEVLDESREIIKELERRL

SEQ ID NO: 10187 - protein, 59 aa, Artificial Sequence
  Synthetic sequence.
DEEAKRVLDEVEKLVRELKKRNDELNEKTERLVRDLRRRLKDSLDKSRDLVRRLEEKAK

SEQ ID NO: 10188 - protein, 56 aa, Artificial Sequence
  Synthetic sequence.
SVEEVLDEVRRIIEELLRLSEEMLRHSEEVIRDLERVSREVLERSKRIIDELLREL

SEQ ID NO: 10189 - protein, 59 aa, Artificial Sequence
  Synthetic sequence.
DEVAKRAVEDVRRVVEDLERRNRTLNEKTKRLVEKLTRDNERSLKESKKVVDELREEAR

SEQ ID NO: 10190 - protein, 56 aa, Artificial Sequence
  Synthetic sequence.
SVEEVLDEIRKRIEDLKREVDEVLDRSRRIIETLKERVDRVLKHSRELIKRLKDKL

SEQ ID NO: 10191 - protein, 59 aa, Artificial Sequence
  Synthetic sequence.
DEEMKRALEEVKKLLDRLREELKRSLDESRKLVEELERRLRESNEESERLIRKLEREAD

SEQ ID NO: 10192 - protein, 56 aa, Artificial Sequence
  Synthetic sequence.
SVEDVLREVEKIIRELDRKSEKVLEDSKRVIEDLKRKVEEVLRHSETLIRDLERRL

SEQ ID NO: 10193 - protein, 59 aa, Artificial Sequence
  Synthetic sequence.
DELAKEMVDRVRELVKKLEEENRRSLEESKKLVEELARRLERSNTESKRLIDKLREEAR

SEQ ID NO: 10194 - protein, 56 aa, Artificial Sequence
  Synthetic sequence.
SVEEVLKDIEKKIRDLDRKVKEALRHSEEVIRRLEEEVKRVLDDSERILRDLKEKL

SEQ ID NO: 10195 - protein, 59 aa, Artificial Sequence
  Synthetic sequence.
EELMRRIVEKVEELVKELDKRLRESNEDSKRLVEDLSRRAKKSLEESRELVRELKKRAK

SEQ ID NO: 10196 - protein, 56 aa, Artificial Sequence
  Synthetic sequence.
SVEEVLDRIRKIIKELLDRSEEALRHSEEVIKDLERKVEEVLERSREVIRELLERL

SEQ ID NO: 10197 - protein, 59 aa, Artificial Sequence
  Synthetic sequence.
DEELKTMLEEVKKVVEELLRRNRKSNEDSKELVKELTRRLRKSLEDSKELVRKLEEEAR

SEQ ID NO: 10198 - protein, 56 aa, Artificial Sequence
  Synthetic sequence.
SVEDVLREIEEILRRLEKESDDALEHSRRVIKRLEEESDRVLEESRRVIEELERKL

SEQ ID NO: 10199 - protein, 59 aa, Artificial Sequence
  Synthetic sequence.
DEEMKKLLEDVKRLVDDLRRKNEESNRRSKELVDKLDKENKDSLKESRELVEKLEREAR

SEQ ID NO: 10200 - protein, 59 aa, Artificial Sequence
  Synthetic sequence.
SVEEVVREVEEKLRKLIDDVRRVVEENRRNTERLRKRVTEVVKRNEDILRRLEEDIRRV

SEQ ID NO: 10201 - protein, 59 aa, Artificial Sequence
  Synthetic sequence.
EEVAKTALRKVEDLLKKLKERAEDSSRDNHRISKELTEELEESSKRVKTLVDELRKTVK

SEQ ID NO: 10202 - protein, 57 aa, Artificial Sequence
  Synthetic sequence.
SVEEVLKESREISTRLAEEVKRVLDEIRRILERVKRINEKVNKDIEEILRRVKKTVG

SEQ ID NO: 10203 - protein, 59 aa, Artificial Sequence
  Synthetic sequence.
ERVAEKILKEDRDTVERLRKRVEDLLRDVRRLVEDSERKSRDLLRRVEELVRELKKRVD

SEQ ID NO: 10204 - protein, 57 aa, Artificial Sequence
  Synthetic sequence.
SVEEVLKESKRVSEELNELNKKVNDDIRKILEKVNRENKKVNEDIERELRKLEEEVG

SEQ ID NO: 10205 - protein, 59 aa, Artificial Sequence
  Synthetic sequence.
EEVAREILRDDKRTVEESKRESKRLLERVKKLVDRSAEESKKLLEDVKRLLEELRERAR

SEQ ID NO: 10206 - protein, 57 aa, Artificial Sequence
  Synthetic sequence.
RVDEVLDESKKVSDRLHESIRRVLEKIEEILRRVNEENRRVNEEMKRILDELARTVG

SEQ ID NO: 10207 - protein, 59 aa, Artificial Sequence
  Synthetic sequence.
ERVAREILKADRETVRRLEKRAKDLLDEVRDLVRESEKRSRELLKEVEDLVRKLTEEAR

SEQ ID NO: 10208 - protein, 57 aa, Artificial Sequence
  Synthetic sequence.
RVEEVLKRMRDILRRVNEINRRVNRELERSSREILERIREILDRIRRILERLEERVG

SEQ ID NO: 10209 - protein, 59 aa, Artificial Sequence
  Synthetic sequence.
EKVARDLLREVEELVKESEELSEELLRRSRRSNEESLRKAEKLLETVRRLVEELEKKTT

SEQ ID NO: 10210 - protein, 60 aa, Artificial Sequence
  Synthetic sequence.
SEAEAVEEEVRRLVEESEKRSKELLEDVERLVEESERRSKKLLDDVRKLVDDLKKELRRV

SEQ ID NO: 10211 - protein, 56 aa, Artificial Sequence
  Synthetic sequence.
DRVIERLKRILKEAHDKNKEVSDRIRKILEELHRKNRKVLEDIKRILDDVRREVER

SEQ ID NO: 10212 - protein, 60 aa, Artificial Sequence
  Synthetic sequence.
KEAEDLLREVEKLVRESKKLSEDLLREVRKSNERSKRESERLLREVERLVRELKDLRDKV

SEQ ID NO: 10213 - protein, 56 aa, Artificial Sequence
  Synthetic sequence.
DRIIERIKRILEKVHKINREASKRIKESLDRAHETNKRVLDRIRKIVDDVRREVER

SEQ ID NO: 10214 - protein, 56 aa, Artificial Sequence
  Synthetic sequence.
RLEEVKEELKRIATKLKEEIKENIRRLEESVEKIAKELAENIKRLEDILRDVKRKL

SEQ ID NO: 10215 - protein, 56 aa, Artificial Sequence
  Synthetic sequence.
GEELVERLRRVVEEVRERLKDSSRELRKINEDSRKKVEDSSREVKKVVEELERRDT

SEQ ID NO: 10216 - protein, 57 aa, Artificial Sequence
  Synthetic sequence.
KELEDVARKVEDLLRRIEKTNRDAIRESERLVRELKREVEKVEEESRRLLEEVERRI

SEQ ID NO: 10217 - protein, 56 aa, Artificial Sequence
  Synthetic sequence.
AKKLLDEVRKVIEDNRKRSEELLEENRKVVEDVSRTLERILRENERVADEVDKEER

SEQ ID NO: 10218 - protein, 57 aa, Artificial Sequence
  Synthetic sequence.
DELERVTEEIDKLSKDLERRVREVLEESRRLVEDVERVVREVLEEARRTAKDIADKV

SEQ ID NO: 10219 - protein, 56 aa, Artificial Sequence
  Synthetic sequence.
VDKLLEEVRKISEDSKERLKEILKRNEEVARRVKRELKRLLETNREIIRRVEERER

SEQ ID NO: 10220 - protein, 56 aa, Artificial Sequence
  Synthetic sequence.
RELEELLDKVRKIVEESKKRNEDLLREVREIVERSKEKIKKVLDEVRKIIETVRKS

SEQ ID NO: 10221 - protein, 58 aa, Artificial Sequence
  Synthetic sequence.
KEVEKVLRDVEELIRDSERASDRVLKDVEELIKDSERMSKKAEEDVDRLLRELDKDVR

SEQ ID NO: 10222 - protein, 61 aa, Artificial Sequence
  Synthetic sequence.
DSVERVAEEVRKLLEDIKRVSDEVTKRLRDLLEDLKRVSDKVRKDIERLLEDLEREVRRKG

SEQ ID NO: 10223 - protein, 59 aa, Artificial Sequence
  Synthetic sequence.
DRVLEEALRRVEELARRIKEHSKRVLETVRRLVEEIKKHSRKVLEEVRERIKRIKDELR

SEQ ID NO: 10224 - protein, 61 aa, Artificial Sequence
  Synthetic sequence.
SEVEKAEKDVRDLLKDLRRVSEKVKRAVEDLLRDLKRTSDKASEDAKRLLDDLRRKVEERG

SEQ ID NO: 10225 - protein, 59 aa, Artificial Sequence
  Synthetic sequence.
DRVVKEILDEVEKLIREIKKHSEDLLRKVRKDIKRVKDHTKRVLDRIRKLIEDIKRRLE

SEQ ID NO: 10226 - protein, 60 aa, Artificial Sequence
  Synthetic sequence.
DEVKELLDRVREEIRRDKERVKKLLEDSKRLNERDKREVKRLLEEVRELIKRLEDIIRKS

SEQ ID NO: 10227 - protein, 55 aa, Artificial Sequence
  Synthetic sequence.
EEVVKDLERLLRDLERVNDEVEKRLRDLTEDSKRFNDEVAREIEKLLEDVARTVK

SEQ ID NO: 10228 - protein, 60 aa, Artificial Sequence
  Synthetic sequence.
REAEELLKRVEDLIRRLKDMIRKLLEDSKRLNERDVETVKRLLEDVERTIREIKDEVRRD

SEQ ID NO: 10229 - protein, 55 aa, Artificial Sequence
  Synthetic sequence.
ERIVREVEKLLEKIKRDVDRVRRELERLTEESKRINDKAVRDIEELLEDLKRAVK

SEQ ID NO: 10230 - protein, 59 aa, Artificial Sequence
  Synthetic sequence.
DELERLLEDVERVSRETKKLLKKLLDDAKRVIDKNREDSRRSLEEVERVIREAKELLKD

SEQ ID NO: 10231 - protein, 62 aa, Artificial Sequence
  Synthetic sequence.
KDTERRVRDVVKKIRELSEDVEREAKKVIDRLKELLEDIERENRRVEEEIKKLLEDVERTAR

SEQ ID NO: 10232 - protein, 59 aa, Artificial Sequence
  Synthetic sequence.
KLVERLVKEAEDLTEEHKERLDRLLKENEKISRESKKRLKEILEENERVVEEVKKLLRD

SEQ ID NO: 10233 - protein, 59 aa, Artificial Sequence
  Synthetic sequence.
RKKVDEVRRRLEELHKELEKVVRDVKRTSEKLVRDSEDMARKVVKTSEDLLRELEEEAR

SEQ ID NO: 10234 - protein, 59 aa, Artificial Sequence
  Synthetic sequence.
SRAEDLVRRVEEMTRKHKKDLDDLLRENEEVSRRSKERIRKLLKDIKDVVDDVERVLRA

SEQ ID NO: 10235 - protein, 59 aa, Artificial Sequence
  Synthetic sequence.
RDKVEEVRERLKKLHTELEKRVREVKRDSERLVEDSERTVEELLRRVRKLLKEVRDSVK

SEQ ID NO: 10236 - protein, 60 aa, Artificial Sequence
  Synthetic sequence.
SEAERLVEEAERVTREHKKRLDDLLKEVRRVSEDSKRKLEKILKENEDVVEEVKELLKAG

SEQ ID NO: 10237 - protein, 59 aa, Artificial Sequence
  Synthetic sequence.
KEKVDRVRRELDRLHKELAEVVERVKRAVDKLLRDSEEEVKRVEERSERLLKEVADALR

SEQ ID NO: 10238 - protein, 59 aa, Artificial Sequence
  Synthetic sequence.
SDVDKLVDDVRRETEKHKKTARDLLDELRKVSEESRRRLKRLLEEITEVVERIKRVLEA

SEQ ID NO: 10239 - protein, 59 aa, Artificial Sequence
  Synthetic sequence.
EEEVRRAKEELDRLHKEVEDVVRDVTRELDRLLKRSREVVERVREEADRLLEEVERTLK

SEQ ID NO: 10240 - protein, 59 aa, Artificial Sequence
  Synthetic sequence.
SEVDELVERAERISRESKKTIKKILEDNERVSKRHKDELKKLLDELKRVVDEVRKVLER

SEQ ID NO: 10241 - protein, 59 aa, Artificial Sequence
  Synthetic sequence.
KEKVERALRELDRLLEESKRVVDEAEKTSDKLNKEVEEMARRVEEEVDRLLKEVRDDAK

SEQ ID NO: 10242 - protein, 59 aa, Artificial Sequence
  Synthetic sequence.
SEADELVKEIEDVSRRSKEELTRLLEEAEKVSREHKKTLEELLRRIEKVVRDIKEVLRG

SEQ ID NO: 10243 - protein, 59 aa, Artificial Sequence
  Synthetic sequence.
EKKVREVEKLLDKLLEESRKRAKEVLRALRELNREVAEVVRRVEERLRRLLKEVEEAVR

SEQ ID NO: 10244 - protein, 59 aa, Artificial Sequence
  Synthetic sequence.
SDVDKIVEEIERISRDSERRIREIVERNKKVSEDHKRELERLLKEMEKVVEDVKKVLKD

SEQ ID NO: 10245 - protein, 59 aa, Artificial Sequence
  Synthetic sequence.
KKKVDEARKKLRDLLERSKEVVKEAERRLEKSNRDVRREAERVRKALDDLLKEVDEAVR

SEQ ID NO: 10246 - protein, 59 aa, Artificial Sequence
  Synthetic sequence.
SRADELVERAKRMTDEHKKTAEDILRENKRVSDEHKKTLEKILRENEKIVDEVAKLLEE

SEQ ID NO: 10247 - protein, 59 aa, Artificial Sequence
  Synthetic sequence.
KDKVREVEEELKRLHKEVEDVVDTVRRTSEKLNDEVRKVVETVTRRSEELLEELRRRAK

SEQ ID NO: 10248 - protein, 59 aa, Artificial Sequence
  Synthetic sequence.
KEVEKLVTEIREMTERHKRTLEELLKEAEEVSRRHKEDLKRLLDENRKIVEEVARVLEK

SEQ ID NO: 10249 - protein, 59 aa, Artificial Sequence
  Synthetic sequence.
KDKVERVLREADRLHEEVRKVVEKVREELRRLNEEVRKVVEEVRRDSERLVREVEERAR

SEQ ID NO: 10250 - protein, 59 aa, Artificial Sequence
  Synthetic sequence.
SRVDELVDRARKMTEKHKEELKRIVEENRRVSKEHKERLEDILRRNAEIVERVKEVLKR

SEQ ID NO: 10251 - protein, 59 aa, Artificial Sequence
  Synthetic sequence.
EDKVRRALEELKKLHDELAKEAKRVEELLDKSNEEVEKVVRDVREASERLLEELERTAK

SEQ ID NO: 10252 - protein, 59 aa, Artificial Sequence
  Synthetic sequence.
DEVKKLVDDARRLTEKHKTDLERLLDEARKVSEEHKKRLEELLREIAEVAKEILKVLRK

SEQ ID NO: 10253 - protein, 59 aa, Artificial Sequence
  Synthetic sequence.
REKVKRVEETLERLHKEVEEVVRRVKKALRDLNDEVRRVVDEVRRRLEELLKRVEEEAR

SEQ ID NO: 10254 - protein, 63 aa, Artificial Sequence
  Synthetic sequence.
REVDEVEERVTRLLKKVRDVAEESRRRSEELLKKSRDVVEEVKKEVDKLLEEVRDMVRRVKDK

SEQ ID NO: 10255 - protein, 59 aa, Artificial Sequence
  Synthetic sequence.
GRVLKKLVEEVKKLADEIERELERTSKEIEELSRRSEEDLRRLVRKLREVVRKIEEDLR

SEQ ID NO: 10256 - protein, 63 aa, Artificial Sequence
  Synthetic sequence.
REVERVERELERLLEEVREVAERSERESKKLLEDTRRVVRKVKEDVRRLLEEVRDVVRKVKDK

SEQ ID NO: 10257 - protein, 59 aa, Artificial Sequence
  Synthetic sequence.
GDVIRRMVEEVEKLARRIKETLERTVRRLEELVRRSEKNLRTLVEEVRKAVERIKETLR

SEQ ID NO: 10258 - protein, 63 aa, Artificial Sequence
  Synthetic sequence.
SEAERVEEDVRRLLKRVEEVIKRSEERSRELLKKTEDVVREVRKRVKKLLDEVKDTLDKVRDK

SEQ ID NO: 10259 - protein, 58 aa, Artificial Sequence
  Synthetic sequence.
EVLDRLVEELRKLVEEIERDLERTVREIEKLVKDSDRNLEDMVRELRRVAERIKEELR

SEQ ID NO: 10260 - protein, 60 aa, Artificial Sequence
  Synthetic sequence.
REVDEVRRRAEELLKEVRDVVTESEKESRRLLEDTRRVVEDVKRRVDRLLEEVRDLLREV

SEQ ID NO: 10261 - protein, 58 aa, Artificial Sequence
  Synthetic sequence.
DVLRELVKRLEDVAREIKKRLEDTLRKLEEVSRRSKENLRELVERLRRIADEIRERLR

SEQ ID NO: 10262 - protein, 61 aa, Artificial Sequence
  Synthetic sequence.
DEVDRVREEIERLLREVEEVLERSERESRRLLREVEEMLERSDEEVRRLLKEVEEVLRDEL

SEQ ID NO: 10263 - protein, 58 aa, Artificial Sequence
  Synthetic sequence.
EVLEEILRRAKEEVEKLKRELERTVERLAELVEELKRELERSTREVRKTVEELKRRIK

SEQ ID NO: 10264 - protein, 61 aa, Artificial Sequence
  Synthetic sequence.
DEAEDLERRARELLEEVERVLEESIRRSEETVKEVEDMLRRSTEEVERLLKRVEDVLREEL

SEQ ID NO: 10265 - protein, 58 aa, Artificial Sequence
  Synthetic sequence.
ELLKRLIDEVRRLAEKIKEELKESSKRDEEKVEKLKKELKDSTDAVRELVERLEREIK

SEQ ID NO: 10266 - protein, 60 aa, Artificial Sequence
  Synthetic sequence.
DEVEELVKEVEERIKKVHKENEDVLRESEELMKRLHEENERLLREVEELVRRIRELRKRG

SEQ ID NO: 10267 - protein, 55 aa, Artificial Sequence
  Synthetic sequence.
REARERIRRLLTESRKSVEEVEKRLRELSKRSEESVERVERTARRLLKELEDMTR

SEQ ID NO: 10268 - protein, 60 aa, Artificial Sequence
  Synthetic sequence.
EEVKRLVEKVRKLIEDSKRRNRDVLRRVEELVRRVHRRNEEVLRRVEKLVEDIKELLRRG

SEQ ID NO: 10269 - protein, 55 aa, Artificial Sequence
  Synthetic sequence.
EEAEREIERLLEESKRSVEEVEERIRRLIRESEESVREVKERIDELLKDADRATK

SEQ ID NO: 10270 - protein, 60 aa, Artificial Sequence
  Synthetic sequence.
REVEELVKDVERLMREVHRRNEKVVEEVEALIRKSKEDNERVAREVERLVREVEKMLRRG

SEQ ID NO: 10271 - protein, 55 aa, Artificial Sequence
  Synthetic sequence.
REAKERIKDLVRKSRDSVREVRERIRRLLEDSKRSVDDLARRIRELLRKAAEKAR

SEQ ID NO: 10272 - protein, 60 aa, Artificial Sequence
  Synthetic sequence.
DEAEELVDRVRKLAEDVHKKNEDVLRESDALVKDSDRRNREALRRVEKLVEDVEELLRRG

SEQ ID NO: 10273 - protein, 55 aa, Artificial Sequence
  Synthetic sequence.
EEVKRRIKELLKRVEESVRTVEEELRRLSKESEESVKRVEDRIRELLKRLRDAAR

SEQ ID NO: 10274 - protein, 60 aa, Artificial Sequence
  Synthetic sequence.
DEAEDLVRKVRKLIEESKKENEDLLREVRELVARVHEENERVLREVEKLVEDIRRLLRRG

SEQ ID NO: 10275 - protein, 55 aa, Artificial Sequence
  Synthetic sequence.
REVKKAIEDLLKESEDSVREVEEEIRKLLKDLEKSVRDVERAIEKLLDELRKDTK

SEQ ID NO: 10276 - protein, 60 aa, Artificial Sequence
  Synthetic sequence.
REVEELVREAEELVRRVHKRNEDALRRSKKLVEDVHRKNEEVLKRVERLVERIEELLRRG

SEQ ID NO: 10277 - protein, 55 aa, Artificial Sequence
  Synthetic sequence.
KEAAERIKRLIDEVRKSVEEVERRAEELSRELRRSVKEVRDALKRLLDDLRRATT

SEQ ID NO: 10278 - protein, 60 aa, Artificial Sequence
  Synthetic sequence.
REVEELVKEVRRRVREVHERNRRVLEDSERLVREVHKRNEEALRRSEELIKRVEDMRRRG

SEQ ID NO: 10279 - protein, 55 aa, Artificial Sequence
  Synthetic sequence.
ERAEREIRRLLEEVKKSVEDLTRKARKLSRDLERSVREVEERARDLSRRLREKTR

SEQ ID NO: 10280 - protein, 60 aa, Artificial Sequence
  Synthetic sequence.
SEVEKLVKDVEDLAREVHKRNKELVDEVRDRVRRVEERNKRVVDEVREEVKKLIDLLRRG

SEQ ID NO: 10281 - protein, 55 aa, Artificial Sequence
  Synthetic sequence.
EEAKDRIRELLKRVEESVEKVKRDIERLIERSKESVRRLEERIKELLRELEEAAR

SEQ ID NO: 10282 - protein, 60 aa, Artificial Sequence
  Synthetic sequence.
SEVEDLVRKVKKLMEDSDRENKRLVDEVRERVEEVKKRNKEVVDEVRERVKRLEEMLRRG

SEQ ID NO: 10283 - protein, 55 aa, Artificial Sequence
  Synthetic sequence.
KDAAEAIKDLIRKSEKSVDEVRREIERLIKESEDSVKRVTDEIRKLLKRLRDTTT

SEQ ID NO: 10284 - protein, 60 aa, Artificial Sequence
  Synthetic sequence.
SELEEILKTVKKLVDDHKRLSEEILRRVRKLVEEHKRKSEEILKRVTDLAEDVKDKIRKD

SEQ ID NO: 10285 - protein, 54 aa, Artificial Sequence
  Synthetic sequence.
EVEKELDRLLKELERVSRESEKELRRLLKELEEASRESEERLRRLLRDVEEALK

SEQ ID NO: 10286 - protein, 57 aa, Artificial Sequence
  Synthetic sequence.
DEIETVKEELKKLLERLEESSRKVERDLEDLLRRSEESTREVEKRLKELLEDVRRKL

SEQ ID NO: 10287 - protein, 56 aa, Artificial Sequence
  Synthetic sequence.
VKEVLDRVRELARTHHELNRELLREAEESSREHHRLNEELVDRVRKLVKEVEDRAR

SEQ ID NO: 10288 - protein, 57 aa, Artificial Sequence
  Synthetic sequence.
SEIERVKKALRKLLEDSRKSSEDLARELKRLLEESRKSTEKVERDLTDLLREIEEKL

SEQ ID NO: 10289 - protein, 56 aa, Artificial Sequence
  Synthetic sequence.
LDTILERVERSSREHHKLNERLLETLRRSSEEHHKRNEELVRRVERLLEEVERRRK

SEQ ID NO: 10290 - protein, 57 aa, Artificial Sequence
  Synthetic sequence.
SKIERVKEEIRRLLDTLKKSSETVIREIEKILKESRESSKKVEDDLRRLVREVEKKV

SEQ ID NO: 10291 - protein, 56 aa, Artificial Sequence
  Synthetic sequence.
VDKVLRDLEDLVRRHHERNKELLDRVRKSSEEHNRTNEELLKEVERLARKVIKDTT

SEQ ID NO: 10292 - protein, 57 aa, Artificial Sequence
  Synthetic sequence.
DEIEEVKRRARELLREATESSKEVAKALDELLERDRDSSRRVKEDLKRLLEEVRRKL

SEQ ID NO: 10293 - protein, 56 aa, Artificial Sequence
  Synthetic sequence.
LEKVLRDVEKLMREHHELNRELLKRVEDSSRTSHELNKRLVDTVRKLVTDAAEKAK

SEQ ID NO: 10294 - protein, 57 aa, Artificial Sequence
  Synthetic sequence.
SEIEEVDERIKALLKRSTESSKRVEDEARRLMKEDKDSSKEVEDRLRDLLRKVREKL

SEQ ID NO: 10295 - protein, 56 aa, Artificial Sequence
  Synthetic sequence.
LKKVLDDLKRSSEEHHRLNEELLKRAEDSSRTSHRLNRKLVEEVRRLVEKVLEEVR

SEQ ID NO: 10296 - protein, 57 aa, Artificial Sequence
  Synthetic sequence.
DEIEEVKKTLKKLVEELEESTRRVEEELKKLLKESEDSTRRVEDELRRLLEEVERKL

SEQ ID NO: 10297 - protein, 56 aa, Artificial Sequence
  Synthetic sequence.
LDEVLKDVERLVKEHEDLNKELLKKVEKSSRDHHELNKELVRRVEELVREAIKKTT

SEQ ID NO: 10298 - protein, 57 aa, Artificial Sequence
  Synthetic sequence.
DEVEKVKEEIRRLLKRLEDSTRDVERRLEELLRESTESSKEVEERLKRLLDEVRKKL

SEQ ID NO: 10299 - protein, 56 aa, Artificial Sequence
  Synthetic sequence.
VKKVLEELRELVRKHEELNRKLLEEVRESSERHKKLNKELVDEVKRLAEKITEEAR

SEQ ID NO: 10300 - protein, 57 aa, Artificial Sequence
  Synthetic sequence.
KEIEDVKRALEKLLEDDKRSTEELKDRLARLLEDSKRSSDKVIEDLDRLLKEVRDKL

SEQ ID NO: 10301 - protein, 56 aa, Artificial Sequence
  Synthetic sequence.
LDEILKRVEDSSRESHKKNEELLRRVRRSSEEHKRLNEELLREVEELVKEIVKEAK

SEQ ID NO: 10302 - protein, 57 aa, Artificial Sequence
  Synthetic sequence.
SKIEEVKKALRRLLEDLKRSTDRVKEEAKKLLDESRKSSEEVKRELERLLEEVTRKL

SEQ ID NO: 10303 - protein, 56 aa, Artificial Sequence
  Synthetic sequence.
ADKMLRDIERLVEEHKRLNEKLLREVRESSKRHNEKNEELVKTVKKLVEDAEERAK

SEQ ID NO: 10304 - protein, 57 aa, Artificial Sequence
  Synthetic sequence.
SEIETVKKELERLLDESRRSTETVEREVEDILRKSTESSEEVKDRLDKLLKEVRDKL

SEQ ID NO: 10305 - protein, 56 aa, Artificial Sequence
  Synthetic sequence.
LREVLERVRKSSEDHKELNKELLERLRRSSKEHNDKNKRLVDEVRRLVEEVIRRAT

SEQ ID NO: 10306 - protein, 57 aa, Artificial Sequence
  Synthetic sequence.
REIEEVKERLKKLLKDVTDSTDKVRKDLEKLLEDDRRSSRKVEEDLRRLLKDVRDKL

SEQ ID NO: 10307 - protein, 56 aa, Artificial Sequence
  Synthetic sequence.
LEKVLREAEKLAREHERTNEKLLKDVEKSSRDSHKRNKEIVDRVKKLAEDIIRKTK

SEQ ID NO: 10308 - protein, 57 aa, Artificial Sequence
  Synthetic sequence.
SEIERVKKRLEELLREVEESTRRLEERLKRLLEEAKRSSEEVEKELRRLLEEVRRRL

SEQ ID NO: 10309 - protein, 56 aa, Artificial Sequence
  Synthetic sequence.
LDDVLRRVEELAKRAHDENERLIREVEELVRRHNKRNKELVDEVKRLVEKVIEEER

SEQ ID NO: 10310 - protein, 57 aa, Artificial Sequence
  Synthetic sequence.
DEIERVKEELERLAKEDKDSTDTVKRELERLLEESKRSSDKLREDVERLLREVRERL

SEQ ID NO: 10311 - protein, 56 aa, Artificial Sequence
  Synthetic sequence.
LKRILEEVKRSSEESHKLNEELLDEVRKSSEEHNKLNEKLLRDVERLVRKVLTETK

SEQ ID NO: 10312 - protein, 60 aa, Artificial Sequence
  Synthetic sequence.
DELDKLLRDAEEVVRRVKEENKRLVKRDEEVVRRIHELNRKLLEDIRKVVEDVKEEIKEG

SEQ ID NO: 10313 - protein, 62 aa, Artificial Sequence
  Synthetic sequence.
EDAKRKVKRVKDELKRLVEEVEEVSRRSEERSRKTLEDVRDSSRRLEEELRKLVKEVEEAVR

SEQ ID NO: 10314 - protein, 60 aa, Artificial Sequence
  Synthetic sequence.
DELEKLLEDIRDVVRRIKETLEKLVKEDRDVVEKVKEDNKRLLKEMEDVVRKVKEEIRSG

SEQ ID NO: 10315 - protein, 62 aa, Artificial Sequence
  Synthetic sequence.
ERLERRAEEMEERLRRLVEEVREVVERVKEESDRTVEEVRRSSDRVEKEVERLVREVEDKVR

SEQ ID NO: 10316 - protein, 60 aa, Artificial Sequence
  Synthetic sequence.
EELERLMRRSEESLKRSEDTVRELIREAREILKRIKEELKRLLEEAERILEEVKKTVRDL

SEQ ID NO: 10317 - protein, 55 aa, Artificial Sequence
  Synthetic sequence.
KDLIKTARDTLRESERVSKELEERLKKIVEEVERLVEEVKKELERIVKDAERDVK

SEQ ID NO: 10318 - protein, 60 aa, Artificial Sequence
  Synthetic sequence.
DELRKLARDAEEILKRSEEEVRKLKKRSDDSLRRSREEVKKLEDEIREIVDRIKKRVEER

SEQ ID NO: 10319 - protein, 55 aa, Artificial Sequence
  Synthetic sequence.
EELKRTLEEIVERSKRVSDRLRERLKRTLDDSRRISDDLRRRLKKLVDDIRREVK

SEQ ID NO: 10320 - protein, 61 aa, Artificial Sequence
  Synthetic sequence.
KEIEDVKEELKKVLEEDRDSLRKVEKEHRRLAEEVKRKVRELEESLKRIVEEVERIAREAK

SEQ ID NO: 10321 - protein, 56 aa, Artificial Sequence
  Synthetic sequence.
LETVIREVRRILEESKRLNDKSREEVRKLVEELKDIVRRIEETVRRLLEEAKERLR

SEQ ID NO: 10322 - protein, 60 aa, Artificial Sequence
  Synthetic sequence.
DSVDRLRRRVDEVLKTVEDALRRNKKDAEDLLRRIEEVLERLERRSEKLLKEIDEVLKRV

SEQ ID NO: 10323 - protein, 59 aa, Artificial Sequence
  Synthetic sequence.
DEILTRAVEEIDELLRKLKRELDESTKESRKRVEELEKRLRDNTKRVKKDVDDLKRRVS

SEQ ID NO: 10324 - protein, 57 aa, Artificial Sequence
  Synthetic sequence.
SSIERLEEESRKNIKELEDSVKELKEEVDRLVEELERSVRELAKIVEDVVRELKKRA

SEQ ID NO: 10325 - protein, 59 aa, Artificial Sequence
  Synthetic sequence.
DEEVKRVLEESHRLVREVHERNKRVAERVRDLVRRVHEENERVAEEIRDLVRRVEEEVR

SEQ ID NO: 10326 - protein, 60 aa, Artificial Sequence
  Synthetic sequence.
SEIEDVVKKLRDLSERNVRDIDRLVKEIDELLKRDKEEIKRVVDDIKRRVREIKKIIEED

SEQ ID NO: 10327 - protein, 59 aa, Artificial Sequence
  Synthetic sequence.
KEMLDRLRKVVDELVKENKKAVEDLKKRVEDVIRESKRVVEEARRVVDELKKELRDELK

SEQ ID NO: 10328 - protein, 60 aa, Artificial Sequence
  Synthetic sequence.
SEIEKLVEEAKRLVKEAEDRLRKLSKESEESVRRVVKTLKDLVRELERLVEEVRKIIERN

SEQ ID NO: 10329 - protein, 62 aa, Artificial Sequence
  Synthetic sequence.
DEMRKRVKELEEAVKELTKEIKEVVDRHRETVERSSRKVKTVLDDLRRVVEEILRRVEDAAR

SEQ ID NO: 10330 - protein, 60 aa, Artificial Sequence
  Synthetic sequence.
KKIEDLVEEIKRLSDENRRRVERLSEDSKRSLEENKKKLKELVERIKKLLEEVSDKIRKD

SEQ ID NO: 10331 - protein, 62 aa, Artificial Sequence
  Synthetic sequence.
EEAEERLRRAEDTVRRLVERNREVLEEHERTLRRSSEESKRALKEVERVVREVLKRVDEELQ

SEQ ID NO: 10332 - protein, 60 aa, Artificial Sequence
  Synthetic sequence.
DELEKLVRDLEKRVKEVKDELKRSSEESERSLDEVRKTLKKLVEEMRELLKEVKRIIERN

SEQ ID NO: 10333 - protein, 62 aa, Artificial Sequence
  Synthetic sequence.
EEARERLERLRKRVEELLREVEKALEDDEKTVRESSKRIKKVLKELEDTARELVKEVRETAR

SEQ ID NO: 10334 - protein, 60 aa, Artificial Sequence
  Synthetic sequence.
SELEKLVRDLERLSEDNKRRLKESSKESKESLDRVRETIKRLVEEAEELLKRVVDTIRRT

SEQ ID NO: 10335 - protein, 62 aa, Artificial Sequence
  Synthetic sequence.
EEARERLERLREKVEELARDNERALREDERTVRESSERLRKVLEEAKDRIDKLVKAVEDAAR

SEQ ID NO: 10336 - protein, 60 aa, Artificial Sequence
  Synthetic sequence.
SELEKLVEEAKRLSDKNEEDLRRSSRESRESLKENKERIERAVKRLADLVRDVKEKIKRT

SEQ ID NO: 10337 - protein, 62 aa, Artificial Sequence
  Synthetic sequence.
EEMKERLERLRDTLKKLKERNKEVLREDRETVTDSSRRSEEVVREAEERVERLLREVEEAAR

SEQ ID NO: 10338 - protein, 60 aa, Artificial Sequence
  Synthetic sequence.
DELEKLVRELEELVKRVKEELERSSKESEDSLRDVKKKIEDLERKLDKLLKEVTDEIRRN

SEQ ID NO: 10339 - protein, 62 aa, Artificial Sequence
  Synthetic sequence.
DEMRKRLEDLERKVRDLARRVEKALEEDERTVRESSKRIRELLKRLEDKVRKIEKDVDDARR

SEQ ID NO: 10340 - protein, 60 aa, Artificial Sequence
  Synthetic sequence.
SELERLVREVRELSDDNRRKLERSSRESERSAKEVERTLEKLVKELRELVERVKRDIERV

SEQ ID NO: 10341 - protein, 62 aa, Artificial Sequence
  Synthetic sequence.
EEMKERLKELEKEADDLRRENEELLDRDRRTVEESSKRVEKALRDLEREVRRILREVEETMR

SEQ ID NO: 10342 - protein, 60 aa, Artificial Sequence
  Synthetic sequence.
SKLERLVEELKRLSDENVKDLERSSRESEESLKRNKEEIERVVERLRELLEKVVRDIKDD

SEQ ID NO: 10343 - protein, 62 aa, Artificial Sequence
  Synthetic sequence.
EEAKERLDRLREAVEKLREDNKRALDRDRETVERSSKKSEDAVRRAEEDVRRLTETVRRAKK

SEQ ID NO: 10344 - protein, 60 aa, Artificial Sequence
  Synthetic sequence.
SEIEDLVRKLRELLRDVKKKLKESSKRSEDSLRRVKEEIDKLVEELKKLLDEVKKEIERT

SEQ ID NO: 10345 - protein, 62 aa, Artificial Sequence
  Synthetic sequence.
EEAEKKMRELEEEVKKLLEEVDRALKDDERTLRKSSKDIKKVLDDLRRTVKKLKEDVEETMR

SEQ ID NO: 10346 - protein, 60 aa, Artificial Sequence
  Synthetic sequence.
DEIERLVEELRKLSERNKRELDRSSEESRESLKRVKEELKKIVEELRRLLEEVKDRIRKD

SEQ ID NO: 10347 - protein, 62 aa, Artificial Sequence
  Synthetic sequence.
EEARERAKRLEKEVRDLAKENEKALEEDERTVRRSSEEIADLLRKVEKVVRELLEEVRRAAK

SEQ ID NO: 10348 - protein, 60 aa, Artificial Sequence
  Synthetic sequence.
SSLEDLVRRARELSDRNREKLKRSSDESRESLKRNEEEIRRLVEELRELLERVRDLIRKL

SEQ ID NO: 10349 - protein, 62 aa, Artificial Sequence
  Synthetic sequence.
EDAKRDLDRLRREVERLIRDNERLAEEDARTVEKSSRDSKKLVEDLEREVEKLRREVERDRK

SEQ ID NO: 10350 - protein, 60 aa, Artificial Sequence
  Synthetic sequence.
SSIEDLVRRLRELSKRNTEELKRSSEESEDSVREVEDRVRELVKRLRELLKRVEDLIRKI

SEQ ID NO: 10351 - protein, 62 aa, Artificial Sequence
  Synthetic sequence.
EEMEKRAKELEEEVRDLTRRNEDALRRDRDTVKRSTERVDKVLKDLEREVRDIKRRVDEATK

SEQ ID NO: 10352 - protein, 60 aa, Artificial Sequence
  Synthetic sequence.
RELDELVKELRKLVEEVKDELRKSSKTSKELVEEIKERLERLVRELKRLVDEVRKTIRRL

SEQ ID NO: 10353 - protein, 62 aa, Artificial Sequence
  Synthetic sequence.
EDARRKLEELKETVRELLREVEKALDEDRETVKRSSEEVEEMLKDLRRRVTELDERVEREAT

SEQ ID NO: 10354 - protein, 60 aa, Artificial Sequence
  Synthetic sequence.
DEIEKLVEDAERLSRENEKRVRKSSEESKKLVKEALDELKKLVEELEKTVRDVDREIERN

SEQ ID NO: 10355 - protein, 62 aa, Artificial Sequence
  Synthetic sequence.
EEAKKRMEDMERRVRELEKRNKKVLDEDRETVRKSSKDLEDAVRELEERVRRLAKKVKESAD

SEQ ID NO: 10356 - protein, 60 aa, Artificial Sequence
  Synthetic sequence.
RELEELVKRLRELSRENEERLRRSSDESRKLLERNKERVKKVVDDLRRLVEEVKKEIERD

SEQ ID NO: 10357 - protein, 62 aa, Artificial Sequence
  Synthetic sequence.
DDARRRLKELEEEVKRLAKRNEDLLREDERTVRESSRRSEDVVRRAEEMVRRLLEEVERARK

SEQ ID NO: 10358 - protein, 60 aa, Artificial Sequence
  Synthetic sequence.
SELEKLVDELRKLSDENRRRLEKSSRDIEKLLKEIRDRIEELKKEIEDLLKEVKERIERL

SEQ ID NO: 10359 - protein, 62 aa, Artificial Sequence
  Synthetic sequence.
EEAEELLRRLEKRVEELARENEEMLKRDEDTVEEVRKRVTDVLRELKRVVEEVRRKVEEEAK

SEQ ID NO: 10360 - protein, 60 aa, Artificial Sequence
  Synthetic sequence.
SKLEKLVKDAEELSRRNEEELRRSSDESRKLLEKNKRRVERLVEELRKLVKKVRDDIRRE

SEQ ID NO: 10361 - protein, 62 aa, Artificial Sequence
  Synthetic sequence.
REAEELLRRLEEMLRRLTKKNRELLRRDEETVRRSSKRSEEVVRRAEEEVERLVKDVEDTRT

SEQ ID NO: 10362 - protein, 57 aa, Artificial Sequence
  Synthetic sequence.
KDEERAKKVVEEIKKRVTEIVRRHHKTNEDLVRRVRESSEKHHRRNEELKERVTRKI

SEQ ID NO: 10363 - protein, 56 aa, Artificial Sequence
  Synthetic sequence.
IETLVRELEELLKRLEDEVRRLTKRSKEVIDRIHKLNEDLTRESERVLKEVEDRDR

SEQ ID NO: 10364 - protein, 57 aa, Artificial Sequence
  Synthetic sequence.
RETEEVKKELDKLVEEAERAVREHHKENDRLVKRLEEVIRRHEKSVRELVEKVRREV

SEQ ID NO: 10365 - protein, 56 aa, Artificial Sequence
  Synthetic sequence.
LEKIVRRARELVERLKERLKELTRRSEELVKDLERKIERLSRELARIVKEVLDRDK

SEQ ID NO: 10366 - protein, 57 aa, Artificial Sequence
  Synthetic sequence.
SREEEAKKRLEELLREVEKVVRDHHRENEKIREEVERVVEKHKKRNRELVEAVRKRI

SEQ ID NO: 10367 - protein, 56 aa, Artificial Sequence
  Synthetic sequence.
VREAVERLKEIVERVRRKVEKLTEDSRRVLEELKRRIEKLTRDSERVLKEIEDRTR

SEQ ID NO: 10368 - protein, 57 aa, Artificial Sequence
  Synthetic sequence.
SDKEEVKKEIKKLKEDIKRAVDEHRKVNKRILEEAEKSSREHEKENRDIVRRVREEV

SEQ ID NO: 10369 - protein, 56 aa, Artificial Sequence
  Synthetic sequence.
IKEVVKELKKILEKLKRELEDLSRKSEDVLRRLHELNKRLTDDSRRVLDEVREDTK

SEQ ID NO: 10370 - protein, 59 aa, Artificial Sequence
  Synthetic sequence.
SEVDRLLKELEDVLKKVEDDIRRHIKRNEDILRESKKLADKLITEIEDMLRKVEEMIRN

SEQ ID NO: 10371 - protein, 59 aa, Artificial Sequence
  Synthetic sequence.
EEAVKRLEDTARRVEEEVRRLIRELEDTSRRVLEESRKISKELDERLRRVIEEVEKAAK

SEQ ID NO: 10372 - protein, 59 aa, Artificial Sequence
  Synthetic sequence.
SELEKLIKEIRDILKESEDAIKENLDRNEEALKRVAEEIKRLIDELRKMLEDVKRMIRD

SEQ ID NO: 10373 - protein, 59 aa, Artificial Sequence
  Synthetic sequence.
RRAVERVREELEKVIRDSRKLSRDLEEASRRVEEDVRRLIEELERRLKEVIKAVEDAAR

SEQ ID NO: 10374 - protein, 59 aa, Artificial Sequence
  Synthetic sequence.
DEVEKLAEELREILKRSEEMIRENLKRNRDLLRRSKEEVDKLKDELEEMLRRVRRVIED

SEQ ID NO: 10375 - protein, 59 aa, Artificial Sequence
  Synthetic sequence.
RELVKDLERKAREVIRTSEELSRRLAKTSEEVLEESERVVEELERRAERVEEEITKAAK

SEQ ID NO: 10376 - protein, 59 aa, Artificial Sequence
  Synthetic sequence.
SEVEDLLRKLEEILRRSKENVERNVRENREMLKKVEKTIRDLIRRAEKLLREVEEAIRN

SEQ ID NO: 10377 - protein, 59 aa, Artificial Sequence
  Synthetic sequence.
EDAVRRLEKELERVIKTSRDISERLERESRRVEEEVRKLIEELSRRLEEVRERVKEATR

SEQ ID NO: 10378 - protein, 59 aa, Artificial Sequence
  Synthetic sequence.
REVEEALKDLERILKESEDNVRRNIKKNEDLLRRVEERIRELLDEARRLLERVKEVKKD

SEQ ID NO: 10379 - protein, 59 aa, Artificial Sequence
  Synthetic sequence.
KDLVERLKEELERVTRDSRRVVDELRKRSEKVREDVRRLIEDLRRRLEKVIRDVEEDAR

SEQ ID NO: 10380 - protein, 59 aa, Artificial Sequence
  Synthetic sequence.
DETERIIRDLERVLEEIARLAKKNIDDSRRVLKELAEKLKRDSERAKKLLEDVEEIIRR

SEQ ID NO: 10381 - protein, 55 aa, Artificial Sequence
  Synthetic sequence.
EDVDRVVRKVLEDLRRLLEEVKKVNDDSEKEVRRLLEENERKNRRVEEEVKKLLK

SEQ ID NO: 10382 - protein, 60 aa, Artificial Sequence
  Synthetic sequence.
SELEDIIRRIEEVLKRNEELNRKNIKESRDLLEEIRRKAKEDSDRVKEVLRRLEDEVRRN

SEQ ID NO: 10383 - protein, 55 aa, Artificial Sequence
  Synthetic sequence.
EEVKRKVDKVVEDIKRVSEESTRANDESRRALEKVVKENEDTNREVVKRVRDAEK

SEQ ID NO: 10384 - protein, 59 aa, Artificial Sequence
  Synthetic sequence.
SELEEIIDRIRTVLERNRELNERNIRESKRLLDEIKKRVEDDNERSKDIVRRVETEVRE

SEQ ID NO: 10385 - protein, 55 aa, Artificial Sequence
  Synthetic sequence.
ERVDEVVEKVLDEMRKVSRTSEESNRKSEEEVRKVLKENNDMNRESVERLRRTEE

SEQ ID NO: 10386 - protein, 60 aa, Artificial Sequence
  Synthetic sequence.
DEVRRVIEELERLLEENRRHSKEDNERSKKINKENHDHSKESTDRAEKLLREVEKLIRET

SEQ ID NO: 10387 - protein, 58 aa, Artificial Sequence
  Synthetic sequence.
DRVRDVDRTVKRVVKESRRSTRENEKTNTDVVRSTDESLKEDKKEVDRVIEELDRAVR

SEQ ID NO: 10388 - protein, 60 aa, Artificial Sequence
  Synthetic sequence.
SEAEKVIEDAKRLLKENEDHSKEDNDRVRELLEEVKRHSEESTRRAEKILEEIRELVEKV

SEQ ID NO: 10389 - protein, 58 aa, Artificial Sequence
  Synthetic sequence.
EEVKRVEDEVRKLVKASRESTERNERTNREVAERLKKSLEEDRERVRKVVEDLRRAEK

SEQ ID NO: 10390 - protein, 57 aa, Artificial Sequence
  Synthetic sequence.
DELRKVLKESEDSLERLRRTLEESIKRSRDSLRENTELVKDSLRRSEESLERVEKSN

SEQ ID NO: 10391 - protein, 59 aa, Artificial Sequence
  Synthetic sequence.
KEMLKRLEDEIRRSIEELRKALRRVEEEHRKVIEASKDLVRRLEEAHKEVIDRLKEKLR

SEQ ID NO: 10392 - protein, 55 aa, Artificial Sequence
  Synthetic sequence.
DEIERVIEESRKSLDDLRRKAEESIRRSEESLREVEERLKRSIREAEESLKKVEN

SEQ ID NO: 10393 - protein, 59 aa, Artificial Sequence
  Synthetic sequence.
DEVVRELKKMIDKSERDLEELLDRVRRKHERVIEELKKLLKRVKDAHERVIRELEKTRK

SEQ ID NO: 10394 - protein, 59 aa, Artificial Sequence
  Synthetic sequence.
SEVEDLIRRVRKSNKESEDVLRESIERSEESNERSERTARRIIEEAERILEEMEESLKK

SEQ ID NO: 10395 - protein, 59 aa, Artificial Sequence
  Synthetic sequence.
EEVVRRLEEEVKRVAEHTRKLLKDVRKKHEESIRHSEEVLDRLEKKLREIMKRVTERTK

SEQ ID NO: 10396 - protein, 59 aa, Artificial Sequence
  Synthetic sequence.
KEVEDIIEDVKRSLEESKRMADKSITDSRRSNEESKRIVEEIKRKIDEILERIERKARK

SEQ ID NO: 10397 - protein, 59 aa, Artificial Sequence
  Synthetic sequence.
EKVVRELEKRVKEVVKTTEDVLREVERTHRESIKHSEDLVRRLEERLRRVAKEVERTRK

SEQ ID NO: 10398 - protein, 59 aa, Artificial Sequence
  Synthetic sequence.
SEVEKAIKEARDSLRESKRLLEESIKRSEDSLEESRRVVEEIKKRLEELLREVKESVDQ

SEQ ID NO: 10399 - protein, 59 aa, Artificial Sequence
  Synthetic sequence.
EKKVRDLERMVKRVMEETEKALEDVERRHEKSIRDTRRVLKELEDTVRKVLKEVDRERQ

SEQ ID NO: 10400 - protein, 59 aa, Artificial Sequence
  Synthetic sequence.
SKLEKVITEVRDSLRRSRKMAEDSIRRSEELLKELEDLLKKVRDTLRKILKDIEDLARK

SEQ ID NO: 10401 - protein, 59 aa, Artificial Sequence
  Synthetic sequence.
KELVDDVRREVEKVVEDTRRVLEEVERTHKESIDRLRKLVERVRREIEEIARRVKETRD

SEQ ID NO: 10402 - protein, 60 aa, Artificial Sequence
  Synthetic sequence.
SVVEKLKDEADKLVKRNEDLARRLEEVSKDTIDRLEDVLRKLREVLKRLRRRLEEVLKRV

SEQ ID NO: 10403 - protein, 59 aa, Artificial Sequence
  Synthetic sequence.
REKFEEVIKRLRDSSKRSEDKIRKVLKDSRDLLEDVRRKIEDVIRRMEKLIKEVEDRVR

SEQ ID NO: 10404 - protein, 60 aa, Artificial Sequence
  Synthetic sequence.
SVVEELERVMRELKKRNEELSRENHESVKEAEKRNKRLSEELEKVSRDVIKDLERVVEEV

SEQ ID NO: 10405 - protein, 59 aa, Artificial Sequence
  Synthetic sequence.
EREIRRIIEELKRLSDENEERIRRISEEIKDLSRRNEETVRRVIEENRKLLEDATRRTK

SEQ ID NO: 10406 - protein, 60 aa, Artificial Sequence
  Synthetic sequence.
SLREKLKEVIRRLEEENRRVSEENHRSVREVEEENRKVSDELRKVAEELKRRLEEVVRRV

SEQ ID NO: 10407 - protein, 59 aa, Artificial Sequence
  Synthetic sequence.
SREIEDIIRRVKKLSKENKETIERISREIRELSKRNEEEVRRVIRRLEELLEELERTAK

SEQ ID NO: 10408 - protein, 60 aa, Artificial Sequence
  Synthetic sequence.
RVIEKAEEVVDRLKKRNKEVLKENHDSVREVEKENRELLEKAEKVVRELEERLKEVVEEV

SEQ ID NO: 10409 - protein, 59 aa, Artificial Sequence
  Synthetic sequence.
EREIERIIKEAEELSKRNEEVIDEISKRIKELSERNRERVEKVIEEAKELVKRVTDKVK

SEQ ID NO: 10410 - protein, 60 aa, Artificial Sequence
  Synthetic sequence.
KDEEKAEDVVRRLTEEVRRVHEKTRDVVRRVTERSNDVSRRSKEEVRELLERADDLARKG

SEQ ID NO: 10411 - protein, 56 aa, Artificial Sequence
  Synthetic sequence.
VEDLIRELKRLVDELRERSEDLIRKAERVLERLEEESRRLLKELRDLLEDVTRKAE

SEQ ID NO: 10412 - protein, 60 aa, Artificial Sequence
  Synthetic sequence.
SETEKAREVVRELEKRNDEVHKETRDVVRRLEETSDEVSKDSERKVDRLREEVKKVRDDG

SEQ ID NO: 10413 - protein, 56 aa, Artificial Sequence
  Synthetic sequence.
VEELIRRMEKLTEDNERRSRKLIEELKRLLEDLREKSERLIRELERLVKELRDRAE

SEQ ID NO: 10414 - protein, 60 aa, Artificial Sequence
  Synthetic sequence.
SEKEKAREVVKKLKKRVDEAHKKTKDVVEELRKRNRDVHRTTREVVRDLLKKVKDVERRG

SEQ ID NO: 10415 - protein, 56 aa, Artificial Sequence
  Synthetic sequence.
VETLIERLRELIDELRRRSEKLIKELREVTKRNKERSDRLIKELEDLVKKLKDDAT

SEQ ID NO: 10416 - protein, 59 aa, Artificial Sequence
  Synthetic sequence.
DEVEKLIEDLKRIVERDEREIRELIKELDDHVRKDEKIARDLERRLKEILDEVRKMVTD

SEQ ID NO: 10417 - protein, 59 aa, Artificial Sequence
  Synthetic sequence.
KELLEKVKRVLEEVRRRSRETLERLREVLERSIRDSERTLEKVREMLERVRKEIEKLRK

SEQ ID NO: 10418 - protein, 59 aa, Artificial Sequence
  Synthetic sequence.
SEVEELDKRLRDHVRRDEEIVERLIRELKRHVERDREEARRLIEELRRLLEEVKRMMED

SEQ ID NO: 10419 - protein, 59 aa, Artificial Sequence
  Synthetic sequence.
RKLVRDVEKSLEESIRRSEETLKTVKDVLDKSKEDSKRTVEDVERVLREAEKEAKRATD

SEQ ID NO: 10420 - protein, 59 aa, Artificial Sequence
  Synthetic sequence.
SEAEKLIKELEDHVKRVEDRARELIDELRKHVEEDERRARKLIEELRRLLKEVKRMVDD

SEQ ID NO: 10421 - protein, 59 aa, Artificial Sequence
  Synthetic sequence.
EDLVRRVRKVLRRSEEDVRRLIEEVERVLKRSEEESRRTIREVEEVLKEVERAVEELAR

SEQ ID NO: 10422 - protein, 60 aa, Artificial Sequence
  Synthetic sequence.
SLEDRVREVVERSERDLRRSTDEIRRVVEEAEKALRRLVREVEEVVREVKERLERVVREG

SEQ ID NO: 10423 - protein, 59 aa, Artificial Sequence
  Synthetic sequence.
EDTVRKVIEDSDRSLEENKRLVKKVIDEIKERLKEMKKRAEEIIERLKKLLEEVEERAR

SEQ ID NO: 10424 - protein, 60 aa, Artificial Sequence
  Synthetic sequence.
DLTKRVEEVVRRSRERLERSTRDIKRKAEEVKERLKKSSKEVEKVIREVETELERLRREG

SEQ ID NO: 10425 - protein, 59 aa, Artificial Sequence
  Synthetic sequence.
EKKVEEVLRRSEKSVRDNKKRVEEVAETLKKILTDNRRLVKRVKEELDKLIRDVEERAR

SEQ ID NO: 10426 - protein, 57 aa, Artificial Sequence
  Synthetic sequence.
SEKEDVERVVERVKREADELLKENHKSVKDVDERVKETVERNHRSVRKAEEDVKRVE

SEQ ID NO: 10427 - protein, 56 aa, Artificial Sequence
  Synthetic sequence.
VREVAKELEDIVRRIKELVERSNRELKKIVEDNERVVEESDRRIKEILERITEASR

SEQ ID NO: 10428 - protein, 57 aa, Artificial Sequence
  Synthetic sequence.
SEKETVEEVVDKVRRDLDKSLEDNHKSVEEVRRRVEKTLRENHESVERARKRARDLE

SEQ ID NO: 10429 - protein, 56 aa, Artificial Sequence
  Synthetic sequence.
VREVVERAKRILEDNKKKIDESNERLERIVRENKEMVERSDRRIEEIVERIERETR

SEQ ID NO: 10430 - protein, 57 aa, Artificial Sequence
  Synthetic sequence.
DEKEEVEKRAEEVRKKVDKLLKENHESVEDARRRVDKTLRENHESVEEVKRRVDEVR

SEQ ID NO: 10431 - protein, 56 aa, Artificial Sequence
  Synthetic sequence.
AEDVMEELDRLVEDLRRKVEDSNRKIKRIVDENKREVEKSNRKLRELLKELEDRAR

SEQ ID NO: 10432 - protein, 57 aa, Artificial Sequence
  Synthetic sequence.
SKKEDAERVVREVTREVRRLLKENHDSVREVLKRVDETVERNSRSVKEVLRKVREVE

SEQ ID NO: 10433 - protein, 56 aa, Artificial Sequence
  Synthetic sequence.
LKEVVDRARDLIRDLTRKVKESNERLEEIVERNEREVRKSDEDLKRLADDLERKAT

SEQ ID NO: 10434 - protein, 57 aa, Artificial Sequence
  Synthetic sequence.
REKEEVERVVEDVRRRLDESLERNHKSVRDALREVDRTVEENSRSVEKVRKRLKEVE

SEQ ID NO: 10435 - protein, 56 aa, Artificial Sequence
  Synthetic sequence.
VREVKKELEKIVRDNERVVEDSNDKIRRIVTKNTEDVKRSDETLERIVEEIERRAR

SEQ ID NO: 10436 - protein, 57 aa, Artificial Sequence
  Synthetic sequence.
KEKEDVERKVEDVKRDVDRVLEENHRSLKEAEERSNKLSDTSRRVAKRVVDDVRRLK

SEQ ID NO: 10437 - protein, 56 aa, Artificial Sequence
  Synthetic sequence.
VKEVVDRLEKIVRDIRKEIERSNRDVERLVRTLEEVSKRIIDTLERIIDKIREDTK

SEQ ID NO: 10438 - protein, 59 aa, Artificial Sequence
  Synthetic sequence.
SEAEELIEELERIAEEDRKLVEDSIRKLRKILDEDRKIMKRLAEELDRILEDVKRKVDK

SEQ ID NO: 10439 - protein, 55 aa, Artificial Sequence
  Synthetic sequence.
KELEEVVRKVKRESDRTLEKSKKVVDEVRRRSEETLEKLRRVVERVRKRVDEASK

SEQ ID NO: 10440 - protein, 60 aa, Artificial Sequence
  Synthetic sequence.
DRADELRERLKEIMERDRRIMKELEDELRELVERDERIIRELERRLEEIVKDVERKAKSG

SEQ ID NO: 10441 - protein, 55 aa, Artificial Sequence
  Synthetic sequence.
DELRRVVEEVEKDSERTLKELRRVVKEVEERVEKTLRDLEEVLERVKERVKRLKD

SEQ ID NO: 10442 - protein, 59 aa, Artificial Sequence
  Synthetic sequence.
KEAEDLMREVEELVRRDEEIIKRLADELEEIVDDNRRKVEDLVRRLEEILRRVEESMRK

SEQ ID NO: 10443 - protein, 55 aa, Artificial Sequence
  Synthetic sequence.
KELREVIERARKRVEETLRELERKLEEVRKTSEDLLRRLEEVVKRVKEEVEKLEK

SEQ ID NO: 10444 - protein, 59 aa, Artificial Sequence
  Synthetic sequence.
SEMDELRKELEDLARDDKRRVEESIRRLEKIAEDNERLARESIKRLRRLVTELEKLARK

SEQ ID NO: 10445 - protein, 55 aa, Artificial Sequence
  Synthetic sequence.
KELKEVVDRVREIVKKTLEESREVVKKVREDSKRLLEESKRVVEEVKKRVEELKK

SEQ ID NO: 10446 - protein, 59 aa, Artificial Sequence
  Synthetic sequence.
DEVEEVKEELKRTSRDDERKVEEIRKRLEESTRRLRELAEELKDELRKSSRDLERLRRE

SEQ ID NO: 10447 - protein, 55 aa, Artificial Sequence
  Synthetic sequence.
REVERALERSLKRSDETVKEVEELLRRSLEDSKKLLEEVREALERSKKRSDELRR

SEQ ID NO: 10448 - protein, 59 aa, Artificial Sequence
  Synthetic sequence.
KEVEDVKEELRRSSKKLRELAERLKKLLEDILDEDRKLAEEIKKRLEDSSRKIEELKRR

SEQ ID NO: 10449 - protein, 55 aa, Artificial Sequence
  Synthetic sequence.
DEVERMLKESDKESKRLLEEVDRMLKEVIKASKKSLDDVDRVLRRSERESEKRRK

SEQ ID NO: 10450 - protein, 59 aa, Artificial Sequence
  Synthetic sequence.
SEVEKVKEELRESSRALRKLVEKIRRILRETSERDRDTVREIADRLRKSSRRVEELKRN

SEQ ID NO: 10451 - protein, 55 aa, Artificial Sequence
  Synthetic sequence.
DEVRRVLEESERRSKKLLDEVEELLRRSERTSRESLKEVKERLRKSLEESERRAR

SEQ ID NO: 10452 - protein, 60 aa, Artificial Sequence
  Synthetic sequence.
SLVERLKKVVEDAERELRRLTKETEDVLREAEETIKRLSERLKKANEDTERKIRRLAKEN

SEQ ID NO: 10453 - protein, 59 aa, Artificial Sequence
  Synthetic sequence.
EKKIDDAIKRIRDLIERVEEINKEVVDRIKELIERVEEINETVIRDSERLIKEVEDEVR

SEQ ID NO: 10454 - protein, 60 aa, Artificial Sequence
  Synthetic sequence.
SLEEDLRRVLEEVKRELKELSKRSKEVNRKTEETARRLSEKSEKVNRETKKRVEDLMREN

SEQ ID NO: 10455 - protein, 59 aa, Artificial Sequence
  Synthetic sequence.
EKAIRDAIRRLKELVERVKRTNEEVVKESEELIERVRERNDDAVRKSRRLIERLTEKVK

SEQ ID NO: 10456 - protein, 60 aa, Artificial Sequence
  Synthetic sequence.
SLKETLEEVLKEVKRRIEDLSRRLEEVLRRAREELKRLSDDSRRVVEEAEERVRRLMEEN

SEQ ID NO: 10457 - protein, 59 aa, Artificial Sequence
  Synthetic sequence.
KEEIKRVIDELRRLIEEVEKRNREVVEEIKRLIKEVADDNRRALERIRRLIRKLEEEVK

SEQ ID NO: 10458 - protein, 60 aa, Artificial Sequence
  Synthetic sequence.
SLTERLREVLKKVEDTLRKLSERLRDVLRKAEKTIEEISRRSEEANRETKERAERLMEEN

SEQ ID NO: 10459 - protein, 59 aa, Artificial Sequence
  Synthetic sequence.
KDRIEDVIRELDRLLEEVRRINEEVLRRIEELIKRVKEENDRVMETSRRLIETVKEEVK

SEQ ID NO: 10460 - protein, 60 aa, Artificial Sequence
  Synthetic sequence.
DKVRKILKEMRDLVRRNKEEIDRSIRKIEELIERNKREIDKSIEELKRLLDEVRKIVKDE

SEQ ID NO: 10461 - protein, 58 aa, Artificial Sequence
  Synthetic sequence.
EMVRDVARVVKEVHDDNRRLTEKSERVVREAHRRNEEIVKASEEAVREAKRRLEELRR

SEQ ID NO: 10462 - protein, 60 aa, Artificial Sequence
  Synthetic sequence.
DKVREILKRLEDLVRTNKERIDESIEELERLADENRRRIKKSIDDLRRLIEEVERIVKDR

SEQ ID NO: 10463 - protein, 58 aa, Artificial Sequence
  Synthetic sequence.
EVVRDVERVLEEVDRANRDLVRRSKEVVDKVHETNKKLVEESKEAVDRVTELLERARK

SEQ ID NO: 10464 - protein, 59 aa, Artificial Sequence
  Synthetic sequence.
DEVEELVKKLEKVLREIEEMSERLSDENRKVLEKIKEDSKRLNEELERVLRRIREASRD

SEQ ID NO: 10465 - protein, 59 aa, Artificial Sequence
  Synthetic sequence.
SELLERLREVLEDVKRKLDEIHRRNEESLERLEREVKRLNEDNRRSLKTVDDRLRETKR

SEQ ID NO: 10466 - protein, 60 aa, Artificial Sequence
  Synthetic sequence.
SEKEKLDAVLREVEEAAKKNIDKNRRSLEEVAEVVRELVKENRKSLEEVKEMIERIIREI

SEQ ID NO: 10467 - protein, 56 aa, Artificial Sequence
  Synthetic sequence.
VEKIVEDLKRVLEESHKLSEDVDRLIKRVVEEAKKLSRDVNEDVKRVVKEVKDEAD

SEQ ID NO: 10468 - protein, 60 aa, Artificial Sequence
  Synthetic sequence.
SEKEKLDDVLRKVKDTLAENIKNNKESLDRVREEIERNIRRNEESLDRARRTVEKIIEEI

SEQ ID NO: 10469 - protein, 56 aa, Artificial Sequence
  Synthetic sequence.
VEKLVEELRRLLKESHELSREVNDRLRRALEESHELSKEVNETLRKLLEDIRREAK

SEQ ID NO: 10470 - protein, 60 aa, Artificial Sequence
  Synthetic sequence.
KDEERLKKVIDEVRKRVEENIRTNEDSLRKAEETLKRNIRKNEKSLEDARREIEELIREI

SEQ ID NO: 10471 - protein, 56 aa, Artificial Sequence
  Synthetic sequence.
VEKLIKKLRDLLEESHRLSEEVNRTLKRALDESHERSKEVDKRIEEMVERVRRKVK

SEQ ID NO: 10472 - protein, 60 aa, Artificial Sequence
  Synthetic sequence.
SEREKLEKVLEEARREIERLAEENRRSLDRARKEVKRLIDNNRKSLDDVRKRVDKLVKDI

SEQ ID NO: 10473 - protein, 56 aa, Artificial Sequence
  Synthetic sequence.
VEKLVEELKKVLDDVRKESERVNRTLKKLLEDIERLSREVNKRIKEMVRKATEDVR

SEQ ID NO: 10474 - protein, 60 aa, Artificial Sequence
  Synthetic sequence.
SEKEELDKVLKEAEDKIEENIRDNERSLRDVERAVRRIIENNRESLEELDKAVKEIVRRI

SEQ ID NO: 10475 - protein, 57 aa, Artificial Sequence
  Synthetic sequence.
DVKTLVEELRRALEESHKLSEDVNRALKKVLEEIADLSRKVNDKLRELLKRLEEEAR

SEQ ID NO: 10476 - protein, 60 aa, Artificial Sequence
  Synthetic sequence.
SKEEKLDKKLKEAERTIRENIKENRESLERARKTLEENIRNNEDSLRRVEEEVRRIIEEI

SEQ ID NO: 10477 - protein, 56 aa, Artificial Sequence
  Synthetic sequence.
VDDILRRIEEILRRSHRLSKEVNKRIKELLDRSHELSKRVNDELDKVLKEIRREAK

SEQ ID NO: 10478 - protein, 60 aa, Artificial Sequence
  Synthetic sequence.
DEDEELKKVLDRAKKRVDELVRNNEESLERVKRAVDRLIEKNERSLERAEDELRKLVKEI

SEQ ID NO: 10479 - protein, 56 aa, Artificial Sequence
  Synthetic sequence.
VEKLKKELDDMLRKLEELSRRVNRTLEELLRRIEELSREVDERIKKVLKEIKDRVK

SEQ ID NO: 10480 - protein, 60 aa, Artificial Sequence
  Synthetic sequence.
SEKEELDDVLRRVEEKVRRNVRKNEDSLKKVEDEVRRNIRNNEKSLEDAERDVRKLAKDV

SEQ ID NO: 10481 - protein, 56 aa, Artificial Sequence
  Synthetic sequence.
VKKLLKELEDLARESHKLSRDVDRKLEDALRRSHRLSREVNRKIEEMVRKLREDTR

SEQ ID NO: 10482 - protein, 60 aa, Artificial Sequence
  Synthetic sequence.
KEEERVTDALRRVRETAKKNIEYNRRSVERVERTLKELVKNNTRSLERVRKAVKELVERI

SEQ ID NO: 10483 - protein, 56 aa, Artificial Sequence
  Synthetic sequence.
VDKLIERLERVLEKSHRDLRRNSKDNKRILDEIKKESEEVNRRLEEVLRKIKEDVE

SEQ ID NO: 10484 - protein, 61 aa, Artificial Sequence
  Synthetic sequence.
DKVRELEKTLRDLLRENHRISEDLNKKLKDMARRNKKHSEDVIEKIKRLLDRLREIVKRDG

SEQ ID NO: 10485 - protein, 59 aa, Artificial Sequence
  Synthetic sequence.
DELVRRVREVLREVEERLRDNIKDNRRSLDDHRRVIEETRRESKRAVERAEDEVKKLED

SEQ ID NO: 10486 - protein, 61 aa, Artificial Sequence
  Synthetic sequence.
SKVEDLIRRLKTLLDDLRRISREVDEKIKEILKEVERHSKEVIDRIKDILRRVEEIVRRKG

SEQ ID NO: 10487 - protein, 59 aa, Artificial Sequence
  Synthetic sequence.
KRLVERVEKVAREVEEAVRKLIEKNKESVERAEETARRLIERSKRAVDEARRKIEELRR

SEQ ID NO: 10488 - protein, 61 aa, Artificial Sequence
  Synthetic sequence.
SKVEELIERIERLLEEVRRISDKVDEDLERLIRENEKHSKKIIKELEKLLKELEDIVRREG

SEQ ID NO: 10489 - protein, 59 aa, Artificial Sequence
  Synthetic sequence.
KRLVERLRKVVEDAEREIRRLIEKNKRSLERHKRELERTIKESRDVLKKVEDRVRELAR

SEQ ID NO: 10490 - protein, 61 aa, Artificial Sequence
  Synthetic sequence.
SKVEDLERRIRKILREVEEISERVNRALKRLLDENRKHSEKIIRELEELLRRLEEEVRTKG

SEQ ID NO: 10491 - protein, 59 aa, Artificial Sequence
  Synthetic sequence.
KSLVDRVRKAVEEAEERIRRLIENNERSLRRHEEAIKKTIEESDKVLEDVRRRAEELLK

SEQ ID NO: 10492 - protein, 61 aa, Artificial Sequence
  Synthetic sequence.
SKVERLIERLKELLDENHKISERVNKELERLARENDKHSKDLIRDIERILREVEEIVRRDG

SEQ ID NO: 10493 - protein, 59 aa, Artificial Sequence
  Synthetic sequence.
RRLVEEVRRVLREVREAAKENIRNNRESLKRHKDALRKTIEDSARVVKRAEERIRELER

SEQ ID NO: 10494 - protein, 61 aa, Artificial Sequence
  Synthetic sequence.
SKVDELVERIERLLRELTKHSKEIIDRLKKLLEDNERINRDVIRRIEEILKEVKRIVERDG

SEQ ID NO: 10495 - protein, 59 aa, Artificial Sequence
  Synthetic sequence.
EELVRKVREVVDRARERVEELIRRTEDVLKKHREELKKLIEESRRVLEEAKKTADELKK

SEQ ID NO: 10496 - protein, 61 aa, Artificial Sequence
  Synthetic sequence.
DEVRKLKEDLRRLLKENKEKVEKVIRENEKLLRENKKMVEDAERDLRRLLKELEDLVRKRG

SEQ ID NO: 10497 - protein, 59 aa, Artificial Sequence
  Synthetic sequence.
KELVDEVRRVARRVKEENKRLLDEVRKVSEEVERTNRELVRRVEEVVREVRERIDELLR

SEQ ID NO: 10498 - protein, 61 aa, Artificial Sequence
  Synthetic sequence.
SEAEDLERRIEKLLEDNTRLVERVIEENEKLLRDNAEHSKEVEDRLRDLLRRLEEVVRKRG

SEQ ID NO: 10499 - protein, 59 aa, Artificial Sequence
  Synthetic sequence.
EELIKRVEEVVRKAKKTNEDLLREVEKVSREVKKANEDLLRRSKEVVDEVEKDIERLKR

SEQ ID NO: 10500 - protein, 61 aa, Artificial Sequence
  Synthetic sequence.
DDIERIIEKLKELLERNKRHTEEVIKELERLLRENERHSREVKKRLEELLKRLEDVVRREG

SEQ ID NO: 10501 - protein, 59 aa, Artificial Sequence
  Synthetic sequence.
EEVIRRIEEAVREVKEANKDLVRESRRVARRVEEENKRLVEESRRVVEKVEKRIRDLLR

SEQ ID NO: 10502 - protein, 61 aa, Artificial Sequence
  Synthetic sequence.
DEIDEARKELEEILRENREKVDEVRKRLEKLLRENEEVVKEIIRRLKELLKELERVMREEG

SEQ ID NO: 10503 - protein, 59 aa, Artificial Sequence
  Synthetic sequence.
EKLVREVRKDAERAERELRRSVEDIRRVVERVKRENERLLREVEKVVEEVKEELRKIET

SEQ ID NO: 10504 - protein, 61 aa, Artificial Sequence
  Synthetic sequence.
DEIERVIEELKKRLDENRRVLEEIIRRLEELAKRNKRHSEELEKRLREELDKVRKRLEETG

SEQ ID NO: 10505 - protein, 59 aa, Artificial Sequence
  Synthetic sequence.
RELIERMREVVEEVERALRKSLKDVEDVVREVEKKNKELLEKSKKVVEDVRRTLEKLRE

SEQ ID NO: 10506 - protein, 61 aa, Artificial Sequence
  Synthetic sequence.
SEVEEAIKTLKKLLDDNKRHTEEVIRRIEELLKRNEEHSRKVIEDLERLLRKLEKMVRDRG

SEQ ID NO: 10507 - protein, 59 aa, Artificial Sequence
  Synthetic sequence.
EEVVRRMEEAVRRAEETNKDLVRRSREVVRRANETNKKLLEDSKRVVERVEKRLEELLR

SEQ ID NO: 10508 - protein, 61 aa, Artificial Sequence
  Synthetic sequence.
SELEEIERELEELLRENKKLVDRVREELKKLLDELRKHSERVIREIERLLEELERVVRKRG

SEQ ID NO: 10509 - protein, 59 aa, Artificial Sequence
  Synthetic sequence.
EELIKRLTDVVRKVKEDNKRLVEEARRVVEEVKREIKRLLEESREVVRRAERRLEELRR

SEQ ID NO: 10510 - protein, 61 aa, Artificial Sequence
  Synthetic sequence.
SEIEDAERKLKKLLEDNTDMARRLIERLRKILEENKRHSERVKRELEEILKELEDLLRRKG

SEQ ID NO: 10511 - protein, 59 aa, Artificial Sequence
  Synthetic sequence.
EELVKRVEDVVRKVDEDNKRLVEEVRRVVEEVRKTLEDSLRESERVVREVKKRLEDLKR

SEQ ID NO: 10512 - protein, 60 aa, Artificial Sequence
  Synthetic sequence.
SEREKMEKVVREAKKDLDRSLKRVKEVAEEVKKELDRSLEEVKRVSEENKKEVDRIRKKG

SEQ ID NO: 10513 - protein, 56 aa, Artificial Sequence
  Synthetic sequence.
VDTLVRRLEKILEENRRIVKEIEDRLRKLLEDNKRVVDEIIKRNEDSVRDVERRAK

SEQ ID NO: 10514 - protein, 59 aa, Artificial Sequence
  Synthetic sequence.
SEREKVEEVVREAKERLDESVKRVEEVSRENKKEIDRLLEEVKKVIEEAKRRLEELRRR

SEQ ID NO: 10515 - protein, 56 aa, Artificial Sequence
  Synthetic sequence.
VDEVLKELRRILRDNERMVKEVIERNRKSVEDLERIARRIIEEIERLLKELTDRAR

SEQ ID NO: 10516 - protein, 60 aa, Artificial Sequence
  Synthetic sequence.
SEDEEVEEAADRHRRSVEDSSRDLKKVLDEDRRTVAESSRKLKEILREVEREVKRVEDDG

SEQ ID NO: 10517 - protein, 56 aa, Artificial Sequence
  Synthetic sequence.
VEELKKRLKELSDESRKSLERVKRKLEETSRRSEESLRRVKKDAERLVREIEKRAK

SEQ ID NO: 10518 - protein, 60 aa, Artificial Sequence
  Synthetic sequence.
SEDEKVKKVLDDVRRKAEDSSRRITEVLRRHEETVRRSSEKLKKLLDELREDADRVRRAG

SEQ ID NO: 10519 - protein, 56 aa, Artificial Sequence
  Synthetic sequence.
VKDLERKARDIVRKSEESLERVVRELERLSRDSERSLKKVKEDLERVVEEIRRRAD

SEQ ID NO: 10520 - protein, 59 aa, Artificial Sequence
  Synthetic sequence.
SEDEEVEKVLREDEESVKRSSDEIRKLLEDHERTVRESSDELKKALDEVRKRLDELKRR

SEQ ID NO: 10521 - protein, 56 aa, Artificial Sequence
  Synthetic sequence.
VEDLKREAERTSEESRRSLEEVRRRLEELSERSRESLKRVKDELKRVVEEIEERAR

SEQ ID NO: 10522 - protein, 60 aa, Artificial Sequence
  Synthetic sequence.
SEDEEVKRVLDELRKRLKESSDRLREVLKRDKRTLEKSSEDIDRALKKVERALTEVLKEG

SEQ ID NO: 10523 - protein, 56 aa, Artificial Sequence
  Synthetic sequence.
VKELLDTLRKLVEESEESLREVVERLDKTSEDSKESLRRVIETLDRLVKDIDEKAK

SEQ ID NO: 10524 - protein, 59 aa, Artificial Sequence
  Synthetic sequence.
SELEKLKKEIDDLSRDLDRILKELKKRVEELTRRSEKVLEDLRKTLEDIVKTLEDLARG

SEQ ID NO: 10525 - protein, 59 aa, Artificial Sequence
  Synthetic sequence.
SELVKRAADVVEKHRRSLERLLRTVTKIVKDHHERNEEIVDEVRKVVERAKERLEEIRK

SEQ ID NO: 10526 - protein, 59 aa, Artificial Sequence
  Synthetic sequence.
SEVDELRRRVKKLSDDSKRVLDELSRRLKELSERLAEIVKEVHRRNEELVDRLRRLKDK

SEQ ID NO: 10527 - protein, 59 aa, Artificial Sequence
  Synthetic sequence.
SELVEEVKRVVEKHHEDNKRIVEALAEMVKDHKRTIDELRRRLEESVKDAEKKLRDVSR

SEQ ID NO: 10528 - protein, 59 aa, Artificial Sequence
  Synthetic sequence.
SELEELERRLKELSDESRRVLRELLERLKELSKDLERILEDLKEKVKKIEKDLRELKKR

SEQ ID NO: 10529 - protein, 59 aa, Artificial Sequence
  Synthetic sequence.
SDLVREVARVVKEHHDENEDIVRRVKEAVDEHRETIERLRRAVERVVKEVERRLKEEAR

SEQ ID NO: 10530 - protein, 60 aa, Artificial Sequence
  Synthetic sequence.
SKDEELERVVKEVREVLDDVNREVTKVSDDVKKRLDELLEEVRRVSDEVRKRLDEVLRER

SEQ ID NO: 10531 - protein, 56 aa, Artificial Sequence
  Synthetic sequence.
VEEAKRRLEKLVRDIRRLTEEHKKRHEDLVREVEEIVKKLKDDHRRLVEDIERAIR

SEQ ID NO: 10532 - protein, 59 aa, Artificial Sequence
  Synthetic sequence.
SVLDELREKAKKNIKESEELLRRNEDHSRRDTERSKKLLEDLERRVKEVVREAERIKKK

SEQ ID NO: 10533 - protein, 59 aa, Artificial Sequence
  Synthetic sequence.
KDVVRDLERVVKEVEDSNRKVADDSRRSTEDNKRKNEKVERDARELLKEIEEIVRRLEK

SEQ ID NO: 10534 - protein, 59 aa, Artificial Sequence
  Synthetic sequence.
DSLERLREIVERIVREARRLLRENEEHSERDTREVERLLEEVERRLRRVVEEAEKIKKR

SEQ ID NO: 10535 - protein, 59 aa, Artificial Sequence
  Synthetic sequence.
EDVVREARRIVDELRKEVKEIVERSRKSTEDNERRNRKVIEDLKRLVKELEDRIREIKK

SEQ ID NO: 10536 - protein, 60 aa, Artificial Sequence
  Synthetic sequence.
DFEERLKEVLKDAERVVDENKKENKKVLDKAKKVVDENRDRNRRVLEEVEREIRRLIDEI

SEQ ID NO: 10537 - protein, 58 aa, Artificial Sequence
  Synthetic sequence.
KEVEEVLKEIKDILRESSKTSKDLVRRTEEILEESSRDSDRVAKESKKLLEEVKEEVR

SEQ ID NO: 10538 - protein, 60 aa, Artificial Sequence
  Synthetic sequence.
SFEEKLDKVVREVEDKIRRLVKRNRDAVKRVADEIRKLKDRNEEVVDRAREKIKRLIDEI

SEQ ID NO: 10539 - protein, 58 aa, Artificial Sequence
  Synthetic sequence.
KEVEEVLTRLKEKLKRVEESSEKVVRDSERLLEKIKKLSKDVEDESRKLLERVEREVR

SEQ ID NO: 10540 - protein, 60 aa, Artificial Sequence
  Synthetic sequence.
SEVERLLKELKELLEELKKKVDDVLKDLEELLKRLEDHTREVVKRSEDLLRELEEMKRRG

SEQ ID NO: 10541 - protein, 59 aa, Artificial Sequence
  Synthetic sequence.
EEVVRELRRVLEEVRRTAERLLEKLDTVLKKVEDKIRELLKESTRVNKDAKREIDRLRK

SEQ ID NO: 10542 - protein, 60 aa, Artificial Sequence
  Synthetic sequence.
SEVETILEDLRRLLEELKKHSDEVVKEIKDLLREIEKHTREVVKTSKKLLKELEELRKRG

SEQ ID NO: 10543 - protein, 59 aa, Artificial Sequence
  Synthetic sequence.
EELVRKIEKVLKEVRETIKKIAEDSDRVLEEAKEVAKRLKDESDRVNEEVRKRIEELKK

SEQ ID NO: 10544 - protein, 60 aa, Artificial Sequence
  Synthetic sequence.
SDVDRVLEEIRKLLEDLKRHSEKVSEENEDLLRKNTELNKRVSEDNERLLEELKRLRERG

SEQ ID NO: 10545 - protein, 59 aa, Artificial Sequence
  Synthetic sequence.
EELKKKLDEVLERAKRTIDRLLETSDRSLEKVERDLRRLNEELDRSLERAERTIRELAK

SEQ ID NO: 10546 - protein, 60 aa, Artificial Sequence
  Synthetic sequence.
SEVDEVLERIKRLLERLAEHSDKVVRDIEKLLDDNRKENERLLDKLRRELKRLEEMRRRG

SEQ ID NO: 10547 - protein, 59 aa, Artificial Sequence
  Synthetic sequence.
EELRRKLEKVLREAEKVIDELLKKTDEVLKRARETIEDLNRKLDKVLKEVRDKLDRLRD

SEQ ID NO: 10548 - protein, 60 aa, Artificial Sequence
  Synthetic sequence.
SSIEKVKREVDEVIKTSKKSSEDSEKLVRDVEERLRKLVKDVRDRVKRVIEEMERLVRER

SEQ ID NO: 10549 - protein, 58 aa, Artificial Sequence
  Synthetic sequence.
ELVERLKEVLKRLEEVSEESERRNREVVRRLEDTARKLTEELRRVLTELRDVLRRLEK

SEQ ID NO: 10550 - protein, 60 aa, Artificial Sequence
  Synthetic sequence.
KDEETLKRLLEKAKEVVDRLKDENEKVTRDNHESVKKAKDANKRSNEKSERVARDAIRRV

SEQ ID NO: 10551 - protein, 56 aa, Artificial Sequence
  Synthetic sequence.
VRELAKKVEKAIRELEELSRENREAVKRISDEIKRLSDENAKDSERIIKEIDDRVR

SEQ ID NO: 10552 - protein, 60 aa, Artificial Sequence
  Synthetic sequence.
SDDETVTKLLKEAEKVVRELTKRNKELLRKNHESVREAKKRNEDLSRKLEEVVRRLIEEI

SEQ ID NO: 10553 - protein, 56 aa, Artificial Sequence
  Synthetic sequence.
VKDLAKKIEDVIREMEELTRRNEKRIEEISDEIRRLSDTNRREIERIREELRRRAK

SEQ ID NO: 10554 - protein, 60 aa, Artificial Sequence
  Synthetic sequence.
REDERLEEIARKIKKVVDELVERNKKLTEDNHESVRRAEKRNRELSRELEEVAKRAIERI

SEQ ID NO: 10555 - protein, 56 aa, Artificial Sequence
  Synthetic sequence.
VEDIERKVEDIIRRLEDLSRRNEEKVRRISEEIKKLSKDNERTIKEIIKEIEERVK

SEQ ID NO: 10556 - protein, 60 aa, Artificial Sequence
  Synthetic sequence.
DELDRLREEIKALIKESRESLKRLEEESRRLAEELRKLIRELKERIERIIEEARRLAKEI

SEQ ID NO: 10557 - protein, 59 aa, Artificial Sequence
  Synthetic sequence.
DDVRKKVEDVLEEARRRITDDEDKTKKVHDESRRVVEEVRERVKRLLDKARTVVKEIEK

SEQ ID NO: 10558 - protein, 60 aa, Artificial Sequence
  Synthetic sequence.
SEVEDLERKIEELIERAKRLVEELEERSRRLIRELEELSKKNEEDIERLIKEAKKLAEDI

SEQ ID NO: 10559 - protein, 59 aa, Artificial Sequence
  Synthetic sequence.
EEMRRRVRELLKKAEEVVRRLEKDSDRVSKESEDMVRELLRRNEEALRKAEEVVREIKR

SEQ ID NO: 10560 - protein, 60 aa, Artificial Sequence
  Synthetic sequence.
KDIDELRKRIETLIREAKKLVDDVRKRSEDLIERLKKLSEDNARDIERLLREAEDLARKI

SEQ ID NO: 10561 - protein, 59 aa, Artificial Sequence
  Synthetic sequence.
REVKERVRRLLEKAADVVRRLIEESNRVSDDSRRVVKELLDRNKELLDRARKRVEEIRK

SEQ ID NO: 10562 - protein, 60 aa, Artificial Sequence
  Synthetic sequence.
DDIERLKREIERLLKEAEKISRDNEERSKELLDRLRKLSEDNKRKIDKLVEELKRLADKI

SEQ ID NO: 10563 - protein, 59 aa, Artificial Sequence
  Synthetic sequence.
EKVKRDAREALRKAKKKVDELKRKNDEVHRRSREEVKRLLEENRKLLEDLRRMVREITQ

SEQ ID NO: 10564 - protein, 57 aa, Artificial Sequence
  Synthetic sequence.
RKVEEVEKHSRESIKEIERLVEEVRKHSKDSIRRIEKLVEDVERHSRKVIEELERDK

SEQ ID NO: 10565 - protein, 59 aa, Artificial Sequence
  Synthetic sequence.
KDMVRRLEKILKEDKEVVKKAEEELRELLKEDREVVKRAEEELERLLKETEDVVRKVET

SEQ ID NO: 10566 - protein, 57 aa, Artificial Sequence
  Synthetic sequence.
SALEEVKRHSEESIKAIEELVRRVEKHSRESSKRNEELIREVEDHSRRVIEELKRKK

SEQ ID NO: 10567 - protein, 59 aa, Artificial Sequence
  Synthetic sequence.
EDVVRAAEKLLEEDRDAVRRAKEKLDELLKRDRDSSREAIRELERLLKETRDVLREVER

SEQ ID NO: 10568 - protein, 60 aa, Artificial Sequence
  Synthetic sequence.
SEIEKILKDVDKKLKDSSRESEESVKESRDLLRESSERSERSVRETRKRVDDLLRLVDER

SEQ ID NO: 10569 - protein, 59 aa, Artificial Sequence
  Synthetic sequence.
EDMKREIDKLVEKLKKVLRDNKRLHEKVIRELEEVVTRNEELHRRVIKEAKEVVDRVRK

SEQ ID NO: 10570 - protein, 60 aa, Artificial Sequence
  Synthetic sequence.
SEVEEVLRRIEELLREDKRHVEEVVREIRELLKRNKDMVDEVLKRIEDLLREIDEARKRG

SEQ ID NO: 10571 - protein, 59 aa, Artificial Sequence
  Synthetic sequence.
EEVIRKLDDILRKVKRVSEDNKRETDKVREEVAEVVKRSKDKLDKVRKDVKRVIERVRT

SEQ ID NO: 10572 - protein, 60 aa, Artificial Sequence
  Synthetic sequence.
DEVEKAAEDVERRLREDEDHARKVVKRIRELLEEDTRTVDKVLREIEKLLKDITDLRRRG

SEQ ID NO: 10573 - protein, 59 aa, Artificial Sequence
  Synthetic sequence.
KELTEKLDRLLERVEEVSKRNEDATRTVEKEVEEVVRRTKKKLDDILERVERVARELKR

SEQ ID NO: 10574 - protein, 60 aa, Artificial Sequence
  Synthetic sequence.
ELIKKARKDVEEVRERSERLVDELRKRNKKLADESRRLIDKLRKDVEKVLREIEDLLRKR

SEQ ID NO: 10575 - protein, 59 aa, Artificial Sequence
  Synthetic sequence.
KKLMEEVERLIKRLEDVNEKSERDVREINKESERVNEETEREVEDAIRKLREVLRRAKK

SEQ ID NO: 10576 - protein, 60 aa, Artificial Sequence
  Synthetic sequence.
KEVEDLERRVKEILDRMKRLIDENRKKIEKSIRELERLIDENRKEVERVKKELKDLKREG

SEQ ID NO: 10577 - protein, 59 aa, Artificial Sequence
  Synthetic sequence.
KEMEKKLEDIVRRVREVVRRAHETNERLVDRSRKAVEKAERTNRRLVEEIRKVAEEVRK

SEQ ID NO: 10578 - protein, 60 aa, Artificial Sequence
  Synthetic sequence.
DEIRELEERVRRILDELRRLVERNREVIERSIRELEKLLDRNRRKVEEILRRIDDLTRRG

SEQ ID NO: 10579 - protein, 59 aa, Artificial Sequence
  Synthetic sequence.
ERVKEAIKELVKDVDRVMREVDRANRELTKTSKKVLEDVDRTNRRLVKEVRDVVERARK

SEQ ID NO: 10580 - protein, 60 aa, Artificial Sequence
  Synthetic sequence.
KEVEDLERTVRTILKRMRELITRNEEEIRRSIEELKKLLKENKDTVRRILEEMKELKKEG

SEQ ID NO: 10581 - protein, 59 aa, Artificial Sequence
  Synthetic sequence.
EDAKRKLDELTKRVEKVVREADERNKRLTKRSKEVLDEVHRANEEALKEVEEVVRRVTK

SEQ ID NO: 10582 - protein, 60 aa, Artificial Sequence
  Synthetic sequence.
DEIEELRKKAEEIIRRMEDLVRRNTETIKRSIETLKKLIDENRRRVRKIIETMKELKRRG

SEQ ID NO: 10583 - protein, 59 aa, Artificial Sequence
  Synthetic sequence.
EEVKEAIERLVRRVEEVVRKVREENKRLNEESEEVVRRADRTNREILKRVRDAVREVRR

SEQ ID NO: 10584 - protein, 59 aa, Artificial Sequence
  Synthetic sequence.
DAEDTLRDITRKVRKVLEEHRETIERTIRKNRESLERVKRAIEELIERSRRALEEVTRS

SEQ ID NO: 10585 - protein, 59 aa, Artificial Sequence
  Synthetic sequence.
DEMLKRVEDIVKKLIEDLREMAKRNRDISKEVDDRLKKILDEVRKHSEEVIKRLKDEER

SEQ ID NO: 10586 - protein, 59 aa, Artificial Sequence
  Synthetic sequence.
SAEETLERLAREVRKVLEEHARKIKKTIDDSRRVLEEHRKTIKRTIDESRKVIKDVRDD

SEQ ID NO: 10587 - protein, 59 aa, Artificial Sequence
  Synthetic sequence.
EEVLRRVTEEVKELIERIERLLKENRKHSKKIIDRLRELLEENRRHSEELRKRLEDERR

SEQ ID NO: 10588 - protein, 56 aa, Artificial Sequence
  Synthetic sequence.
SSLDEIRRKVREAIERLERLLEENRRKVEEVKRRNERLLDRNREVVDEVIKRLEEM

SEQ ID NO: 10589 - protein, 59 aa, Artificial Sequence
  Synthetic sequence.
REVDEELKRLVEEVKKVVDDVRRENKRLLEEVERVSEEVKKTNEKLLERVKRVVEEAER

SEQ ID NO: 10590 - protein, 55 aa, Artificial Sequence
  Synthetic sequence.
SSLDTAREHTRDVIKKIDDILRRNEKLVDDVIRELERLLRENAEVVERVIDRLRR

SEQ ID NO: 10591 - protein, 59 aa, Artificial Sequence
  Synthetic sequence.
REVVEELKELRKRSEEVVDRAEKALRRSVRKAEKVVEEVERANKRLLERVKKVVDDMRR

SEQ ID NO: 10592 - protein, 61 aa, Artificial Sequence
  Synthetic sequence.
EVRERVKEVIERSEKSVRELERIVEELARRLRESVEDLERKIRELSKELRRVVEELVRTRG

SEQ ID NO: 10593 - protein, 59 aa, Artificial Sequence
  Synthetic sequence.
EEVVRRIEELLKEVHKENKRVADELKKLVEDLHDRNRRVKEEVKRRVDEVRRKAEEVAR

SEQ ID NO: 10594 - protein, 61 aa, Artificial Sequence
  Synthetic sequence.
EVDERIRRLVEESRKSVEDLARIVDELVERLRRSVRDLEEKSKRNKEELEKVLRDLARTRG

SEQ ID NO: 10595 - protein, 59 aa, Artificial Sequence
  Synthetic sequence.
EEVVERVERLIEKVHRDNRRVAEKLREDVRRVHEDNKDVARKSHKLVKEVRDTVREVRR

SEQ ID NO: 10596 - protein, 56 aa, Artificial Sequence
  Synthetic sequence.
DVLKEVEEDSRRNHERNRRVAEKVTDDSRRNVKRLEEVAEEIKDDSRKNKERLDKL

SEQ ID NO: 10597 - protein, 59 aa, Artificial Sequence
  Synthetic sequence.
KEIEKILRDVLKENEDSLRELKEILERLLEENRKAVEKLKRILEELLRRNDEMLKRVRT

SEQ ID NO: 10598 - protein, 56 aa, Artificial Sequence
  Synthetic sequence.
SVDEEVRRDSKKNKEDLDRVAEKVKRDSEENMRRLEEVARKVTEDVKRNKKTLEDL

SEQ ID NO: 10599 - protein, 59 aa, Artificial Sequence
  Synthetic sequence.
EEIRRILKELLERNERALEELKKRLRKVLEENKTVLEELRRRLEELLRRNKRMVDEARR

SEQ ID NO: 10600 - protein, 59 aa, Artificial Sequence
  Synthetic sequence.
DEVEKLVEDVARVNKKSLDEVRRLLEELEKVSRDHRREVERSLREAEKVLEDLKREAEK

SEQ ID NO: 10601 - protein, 55 aa, Artificial Sequence
  Synthetic sequence.
DEIRKVKKHNEDVLRKVRKILKDAERISKRALDENERILKEVEKRVRDVIRELER

SEQ ID NO: 10602 - protein, 59 aa, Artificial Sequence
  Synthetic sequence.
DEVDDVVRRLEEENRKSEERAKDTLRKAKKVLDELKKRVKESEDRVKEVLDDVEERVRR

SEQ ID NO: 10603 - protein, 55 aa, Artificial Sequence
  Synthetic sequence.
KRVRDALRHNEDVLRRNDEIVDELRKRVEDVLKKNEDDVRRVAEEVRRVIEELRK

SEQ ID NO: 10604 - protein, 59 aa, Artificial Sequence
  Synthetic sequence.
DRVEEVVKRAKDENRKSEEEVKKSLKDLEDLSREHEKRIRDLLKEVKEILDRIREEVEK

SEQ ID NO: 10605 - protein, 55 aa, Artificial Sequence
  Synthetic sequence.
DEIRKLERHNEEVLKKNETIARDLEKRSREVVKRLEDILRKVEREVEKALEEVRT

SEQ ID NO: 10606 - protein, 56 aa, Artificial Sequence
  Synthetic sequence.
SVEEELRKLKEEIDRVLEENKKIIDDIRKELDDVNRENKKIIDDIRKEIDDVLERV

SEQ ID NO: 10607 - protein, 59 aa, Artificial Sequence
  Synthetic sequence.
EKDLKKLLEEVRELLERSRRASEELLREVKRLLDESRKESKRLADDVRRLLEELERRTK

SEQ ID NO: 10608 - protein, 56 aa, Artificial Sequence
  Synthetic sequence.
SVEDIIRKIEKELDDVNRENEEIIRRIKKELDDVNRRNEKIARDSKKRVDDVLRKV

SEQ ID NO: 10609 - protein, 59 aa, Artificial Sequence
  Synthetic sequence.
EEVVKKIREEVRKLLEESKRRSDELAKEVRELLKRSEDKSRRNLEEVEKLLKEVEDRTR

SEQ ID NO: 10610 - protein, 60 aa, Artificial Sequence
  Synthetic sequence.
KDLEDVLDKVRKDLERSKKHSDDVVKTIRELLKESEKHSEELVKRVEKLLEELRRMTTRG

SEQ ID NO: 10611 - protein, 56 aa, Artificial Sequence
  Synthetic sequence.
ESILRELERRVKKVVEENDEITRRVEREVEKVDKKNKDITDTLRTRVKKAVDEARK

SEQ ID NO: 10612 - protein, 60 aa, Artificial Sequence
  Synthetic sequence.
SDIERLLREVEKVIRDSEEETRKLLEEVEKALKDSRDSSEDVKRKVDDILRKLRELRRRN

SEQ ID NO: 10613 - protein, 60 aa, Artificial Sequence
  Synthetic sequence.
MERIERLLREVRKRVEEAAKRNKDVIKEIEERVRTVHDENRRLLEEIAKRVRDVLEEVRT

SEQ ID NO: 10614 - protein, 57 aa, Artificial Sequence
  Synthetic sequence.
KVEEELEKEVRRALEESKRLLDRLTEHSKRVLDELRELLERVERDVRRVLEELKRER

SEQ ID NO: 10615 - protein, 56 aa, Artificial Sequence
  Synthetic sequence.
KDVVDRLEKELKKVNDEARKRIEELLRESDRVLEEVKKKMRELERELKKVLKEVRD

SEQ ID NO: 10616 - protein, 57 aa, Artificial Sequence
  Synthetic sequence.
DEVEDADRKVRTVLEDLRRRLEELKKHSDDVSRRNEKLLRELKEHSDRLVEEIKRDK

SEQ ID NO: 10617 - protein, 56 aa, Artificial Sequence
  Synthetic sequence.
KRVVDELLKKLRDVLEEVRRTVDELVKRSEESLRRAREVIRRLLEKTREVLEEVRT

SEQ ID NO: 10618 - protein, 55 aa, Artificial Sequence
  Synthetic sequence.
STEDVLRKIKEDVKRVIDDNRRILDEVRRTSKRVLDDLRRNLKHIAEEVERVLRE

SEQ ID NO: 10619 - protein, 56 aa, Artificial Sequence
  Synthetic sequence.
SKELLEKAKRVVDEIKRLAEESLKRLEDLSRDHKRRAKELNDEIRKVVDELRKRAT

SEQ ID NO: 10620 - protein, 55 aa, Artificial Sequence
  Synthetic sequence.
SLEEVLDEIRKLVERALRDLERNLRHVTRTSEEVLRRNEEILRRIEEKVDRVVRN

SEQ ID NO: 10621 - protein, 56 aa, Artificial Sequence
  Synthetic sequence.
SKELLDEIRRVLEEVKRRVEELNKELKDLSDKHKEKAKRTDETITDVLRKAEERER

SEQ ID NO: 10622 - protein, 60 aa, Artificial Sequence
  Synthetic sequence.
SVEELLREVAELVKRVDEDLRRLLEEVRRSNEEVIRRLEEILKRIEEENRKVVEELRRRG

SEQ ID NO: 10623 - protein, 59 aa, Artificial Sequence
  Synthetic sequence.
EETVKRLLDELRELLERLKRTIEELLKRNRDLLRDAEEKARRLLEENRKLLKKARDTAT

SEQ ID NO: 10624 - protein, 60 aa, Artificial Sequence
  Synthetic sequence.
SLEELVRDVERLVKESIEELERVVEDVRRLNTELKEKLERVAREIKKRNDDLVRELRTAG

SEQ ID NO: 10625 - protein, 59 aa, Artificial Sequence
  Synthetic sequence.
EEVIDRLRKELEDIIRESRKNLEDLLRENKRLVEEVERTLRELLRTNKELLERIREEVR

SEQ ID NO: 10626 - protein, 60 aa, Artificial Sequence
  Synthetic sequence.
SVEEMLEKIRRRATESVKRLRKILKEIKERNEKAIRDDRRLLEEIERRIREVVKRLRDAG

SEQ ID NO: 10627 - protein, 59 aa, Artificial Sequence
  Synthetic sequence.
EETVKRLEEEVEKIVRDSERNAREMLERNRRLIEESKKRTKDLLKEVEDEVRKLEEEVR

SEQ ID NO: 10628 - protein, 60 aa, Artificial Sequence
  Synthetic sequence.
SVEEIVRRIREELKKVEEDSERIVRTVEDVLRKVLETVERIVRESEKRSRDAVRRIREKL

SEQ ID NO: 10629 - protein, 59 aa, Artificial Sequence
  Synthetic sequence.
DEVATRLLKEVKEELDRLREENERLLRELKETVEKLKRDAEKVVEDDERLVRELEKRVD

SEQ ID NO: 10630 - protein, 60 aa, Artificial Sequence
  Synthetic sequence.
DIEELLEEIRRRAEEAHRRNEDLLRKIKELVKKARKDNEKVVRDIERRLREVLERVRKKI

SEQ ID NO: 10631 - protein, 59 aa, Artificial Sequence
  Synthetic sequence.
REEVKEVLKRVEDLLRTSEEETKELLKRVEDELRRSKEDSEDVLRKVEELLERIDRRVT

SEQ ID NO: 10632 - protein, 60 aa, Artificial Sequence
  Synthetic sequence.
KEIEEILEEVKRLLDKLKEDSDRILERVRELLERSKEKSREILKRVEDLLRELEKLVRDD

SEQ ID NO: 10633 - protein, 59 aa, Artificial Sequence
  Synthetic sequence.
EELRRVLEEIRRLLEEVRRKIEEASRRLKEDADRVHRKNEEILKRIEELIEEVKRRVEK

SEQ ID NO: 10634 - protein, 60 aa, Artificial Sequence
  Synthetic sequence.
KEVEDILREVDKLLKESKRKSEEALKRVKRLLDELKKTSKRILREVEKLLERLRRLKKDD

SEQ ID NO: 10635 - protein, 59 aa, Artificial Sequence
  Synthetic sequence.
KDLKKIVDDIRRKIDKVDKDNERLIKELEDRVRKAREDIRDISRRIRELVKRVVDEVEK

SEQ ID NO: 10636 - protein, 60 aa, Artificial Sequence
  Synthetic sequence.
DEVETILRDVKRLLEESRRESERVLEEVRRLIEELKKRSRDIMEEVKKLLEELREIVRRD

SEQ ID NO: 10637 - protein, 59 aa, Artificial Sequence
  Synthetic sequence.
EEARRLLEEADRLVREVDKENEDILRRIEESVREVEERIRRISRAIEESIRRVKEEVER

SEQ ID NO: 10638 - protein, 60 aa, Artificial Sequence
  Synthetic sequence.
KEVEDLLREIERLLKESRERTKKVEEDVKRLLDESRKTSEDVLREVERLIRELEKIVRED

SEQ ID NO: 10639 - protein, 59 aa, Artificial Sequence
  Synthetic sequence.
DKARKLVEEAKRRLDTVNEENKDVVRKIKEDLERVDEENRDVLRRIKRIVERVEEEVRR

SEQ ID NO: 10640 - protein, 58 aa, Artificial Sequence
  Synthetic sequence.
DEAERLLRRIEEILKRSKDVSDKLLEDNEKLVRDVKRRLDEHLRKNREALKKLREELK

SEQ ID NO: 10641 - protein, 56 aa, Artificial Sequence
  Synthetic sequence.
DEVVRRIEELVKKLEEDNKRVVEEIKKLNDDLRREVKRVLDEARKLNKEIVDELRK

SEQ ID NO: 10642 - protein, 59 aa, Artificial Sequence
  Synthetic sequence.
SEVDELRRRVEEVERRSEENSRKHLEDNEKMVDDLRKNLERHLKENKELVERVRRVVED

SEQ ID NO: 10643 - protein, 56 aa, Artificial Sequence
  Synthetic sequence.
DRVVEDLKRRADELVRRNERAAEEVRRLNEEVVEDLKRVVKEVKDLNDELVKEVRR

SEQ ID NO: 10644 - protein, 60 aa, Artificial Sequence
  Synthetic sequence.
SVEEVLKEIEKEHRRSEEEVKDVLRKARKINEEVERRVKEVVDRIRETIARVRKEVKDRN

SEQ ID NO: 10645 - protein, 59 aa, Artificial Sequence
  Synthetic sequence.
KDVLKKLLDRSRRLVEKVRDDLRKAEEKNRRVAEEIKETLKRMEDRVREELKEIKKKAK

SEQ ID NO: 10646 - protein, 60 aa, Artificial Sequence
  Synthetic sequence.
SVEEVLKEIEDLHKKSIDEVREVLKEAEDLNRRAVKEVEDALRESEELNRRVTKEVRDEN

SEQ ID NO: 10647 - protein, 59 aa, Artificial Sequence
  Synthetic sequence.
KEVLDRLLEKSEKLARDVRKRLKEVLDKNRKVVEEIRKVLEELLRHSERKLERIRERLK

SEQ ID NO: 10648 - protein, 61 aa, Artificial Sequence
  Synthetic sequence.
DVEDVVRELKKLLDEITRRSEEVVKRLHDRNEEAKEEVRRVVKEVRERLKKVVDDVRRELK

SEQ ID NO: 10649 - protein, 59 aa, Artificial Sequence
  Synthetic sequence.
REVLRKLKKEIKDLLDRIEELNKKVLDESEKLIKEIREDLRRVKEEIKEELKRIREEVR

SEQ ID NO: 10650 - protein, 61 aa, Artificial Sequence
  Synthetic sequence.
SVEEVVRRIKEKLETVVDESRRVVKDLHDKNKEIVEESRKVLRESEKVDEDVVEEVRRRLG

SEQ ID NO: 10651 - protein, 59 aa, Artificial Sequence
  Synthetic sequence.
DEELEKLLREIEDLLRKIRKLNKEVLDRSRKLLEDIRRLNKRALERNRKIAKEIRDEVK

SEQ ID NO: 10652 - protein, 56 aa, Artificial Sequence
  Synthetic sequence.
DSAEKLERDVRRALERIRKRLEENDRRVEEILERIRRRLREDLETSREVLERLRKE

SEQ ID NO: 10653 - protein, 56 aa, Artificial Sequence
  Synthetic sequence.
ESVIEKLERLLDELLEEVKRVVETSEKKLDELLEEVKRVVEESKKALDDLLREVEK

SEQ ID NO: 10654 - protein, 61 aa, Artificial Sequence
  Synthetic sequence.
DKVDEVLRRVRELLERLRKLLEDNKKTTDELLEELRRILKEDEDRTRKLLKRLRDVKREEI

SEQ ID NO: 10655 - protein, 56 aa, Artificial Sequence
  Synthetic sequence.
DRMMKRLKEELERIRKKVREVLERSSRAVERIEREVDEVVKRSSDTVKRILDEVRK

SEQ ID NO: 10656 - protein, 61 aa, Artificial Sequence
  Synthetic sequence.
SEAERVRRRVEELLRELREHSRRVLEEVKRLLEKLREDNERSLRRIKKLLDELRRVRERDL

SEQ ID NO: 10657 - protein, 56 aa, Artificial Sequence
  Synthetic sequence.
EEVLRDIERRVREIEKEVREVTRAIEESVKKIEKESRDVLRAIAETIRKIEEEVKK

SEQ ID NO: 10658 - protein, 61 aa, Artificial Sequence
  Synthetic sequence.
DEAEEVLKTVKKLLDDLRRRNEDSLRRIEELLKRLRDHSKRVLEEVRRLLEELRRVKERDL

SEQ ID NO: 10659 - protein, 56 aa, Artificial Sequence
  Synthetic sequence.
EEVLRKIKKDVEKIVRDSERVIKTIEEKIDRIKKEVKRVTDEIRKRVEEIAEEVRR

SEQ ID NO: 10660 - protein, 60 aa, Artificial Sequence
  Synthetic sequence.
SELEDVLRRSRDLLRRLKELLERLLETVRKLIEEAKELLKKILEDSRKLIREVEEMVRRG

SEQ ID NO: 10661 - protein, 58 aa, Artificial Sequence
  Synthetic sequence.
EEIRRVIKESKDLSRALEETVRRVERKIEDLLRRIKEEAERVIKESEKLIEDAERATK

SEQ ID NO: 10662 - protein, 59 aa, Artificial Sequence
  Synthetic sequence.
DEDEEVERELKKIKDKSKKVLDKSRKTIDELRKEVERTLRRWTKRSKDLLDKVEAAKRR

SEQ ID NO: 10663 - protein, 55 aa, Artificial Sequence
  Synthetic sequence.
EEVLRKVDTILKEIKRRNEKVLKELRDIIDDLAKKLDEVLRRDEELAKKVTEELK

SEQ ID NO: 10664 - protein, 59 aa, Artificial Sequence
  Synthetic sequence.
SEDEDARRTLREMLEESRKHLKEWEDTSRELEKKSREVLKETRKTIAKLADRVRKAKEN

SEQ ID NO: 10665 - protein, 55 aa, Artificial Sequence
  Synthetic sequence.
EEVLEDIRRKVEKLEEDNRRVMKKDEDAVRRVEEENRKVLKELKERIDRLAEELK

SEQ ID NO: 10666 - protein, 60 aa, Artificial Sequence
  Synthetic sequence.
DEDREAEETIKRLLDRSRKTLEESRKTSEDLRRKSEKVLRETRKSLEDSLRKVREMKKRN

SEQ ID NO: 10667 - protein, 55 aa, Artificial Sequence
  Synthetic sequence.
EKVLRDLEEIVRRAAKANKDVLDEDRRVMEEAREENKRVIDEYRKILKEATDELR

SEQ ID NO: 10668 - protein, 60 aa, Artificial Sequence
  Synthetic sequence.
SEDEEAKKTLDELLKKAEELVKKIKETSERLLRKSDKLLEETKKTIKELDDEVKEVKKRN

SEQ ID NO: 10669 - protein, 55 aa, Artificial Sequence
  Synthetic sequence.
EEVLRRIEEIIRRVTELLKKVLKEDREVVEEARKKNEEVLDRLKKIIEEAEERLR

SEQ ID NO: 10670 - protein, 59 aa, Artificial Sequence
  Synthetic sequence.
DEDEKAKRMLEEAEKKSKKHVDEVRETSKRLLEESKKLLEETDRSLRKSLERVDRVKKN

SEQ ID NO: 10671 - protein, 55 aa, Artificial Sequence
  Synthetic sequence.
KRVLDDIKTKVERLEERNKKVLDDDREMVTRAEEENRRVIKKYRDILEEARKRLK

SEQ ID NO: 10672 - protein, 59 aa, Artificial Sequence
  Synthetic sequence.
SEDEDLDRVAEKLKREHKKSVEEIKRVLKRADEESKKLVRDTERVIEEIKREVEEARRR

SEQ ID NO: 10673 - protein, 55 aa, Artificial Sequence
  Synthetic sequence.
EEVLKKLREIVRRVKEENRKVNEEVEKRLRELEEENKKVIEDLKKTVEELVERLR

SEQ ID NO: 10674 - protein, 59 aa, Artificial Sequence
  Synthetic sequence.
DDLEDIKRRLDEMREEVKRHVKRLKEVAKEIEDEHKETVRRNKEVAKKLAREIDDARRR

SEQ ID NO: 10675 - protein, 59 aa, Artificial Sequence
  Synthetic sequence.
KDKVDKVLREVTEEVKRLEEEIKKVDKEIEEIVRRVERENEEVVRDIARIVEELERKLR

SEQ ID NO: 10676 - protein, 60 aa, Artificial Sequence
  Synthetic sequence.
RELEEVIKRIEKTVTDNERANKESVDRIREIVDRLKKEIEESVRRMRDSVKKLEEEIRRR

SEQ ID NO: 10677 - protein, 59 aa, Artificial Sequence
  Synthetic sequence.
EELIRRLEKVLKEHHKRVEEIVKENEDVARDLDRRIKEIVERNRKVLEDLRRRIKELKK

SEQ ID NO: 10678 - protein, 60 aa, Artificial Sequence
  Synthetic sequence.
SEIEDALRRAERVSRESAKKLEDALRKYEKVSRDLKRRLDEVLKRYEDTSRKIAKDLRDN

SEQ ID NO: 10679 - protein, 56 aa, Artificial Sequence
  Synthetic sequence.
EETIERLIEKNKREVDKLLKKIEEVIKRNKDEVDKLLKKIEEVIDRNRRAMEEIAR

SEQ ID NO: 10680 - protein, 60 aa, Artificial Sequence
  Synthetic sequence.
SIEDELRKIVEDIEREIKKLEDDLRRVSKDHRDEVRRILEKLKEHIERLEEDADRLKKAK

SEQ ID NO: 10681 - protein, 58 aa, Artificial Sequence
  Synthetic sequence.
ETVREMIKRLEELVRRVKRRIEDVIRRNREVVDESRRRIEKAIEDNERVLKKIEEEVK

SEQ ID NO: 10682 - protein, 59 aa, Artificial Sequence
  Synthetic sequence.
SIEEEIKKVVKELEDEARKLLKKIEEHSEDLKRKLEDLLRKVEDHIRRLREEIERIKRE

SEQ ID NO: 10683 - protein, 58 aa, Artificial Sequence
  Synthetic sequence.
ETVKKAIKELRDLVDKIEEDLKRVLDENERVLREIARKIDEIIEKNERELRRVLEEIR

SEQ ID NO: 10684 - protein, 57 aa, Artificial Sequence
  Synthetic sequence.
DEAEELERRLREEVKRVETDLRRTTRELEREVEEVRRRLEKTSRENNDRSEKAERED

SEQ ID NO: 10685 - protein, 56 aa, Artificial Sequence
  Synthetic sequence.
KEVVDRLREIITDLVRKLEENVKRLEEIIKRLEEELKRNVDRLRENSKRLAERLRT

SEQ ID NO: 10686 - protein, 57 aa, Artificial Sequence
  Synthetic sequence.
SEAEKVLEEVRRLIEEIRRRLKETTDDVRRLVRELKEEAKRLLEEDKRLVDDLRRRN

SEQ ID NO: 10687 - protein, 56 aa, Artificial Sequence
  Synthetic sequence.
KEVVDKIRKVAEELKKELKDNADRVRRIAERLKEELKRVAEKSDRIIRTLEEELKR

SEQ ID NO: 10688 - protein, 57 aa, Artificial Sequence
  Synthetic sequence.
SEVERLVREVEKDLERERRRLEKTVRDSERLVRELKETLDRLLKRDKDVVDDARRKN

SEQ ID NO: 10689 - protein, 56 aa, Artificial Sequence
  Synthetic sequence.
KSVVDRLREIVKELKDRNRKVVKELEDIHRDSDRELDDVVRRSDEIIRELVERLKT

SEQ ID NO: 10690 - protein, 59 aa, Artificial Sequence
  Synthetic sequence.
DLEEIIKTIREINERLNRRVREVEERLRRTSRELEERIRDVVRKLREINDRLRKEVEAR

SEQ ID NO: 10691 - protein, 55 aa, Artificial Sequence
  Synthetic sequence.
ERLVRENEEAVKRLTKELDDLLRKNEELIRRLEEEAKRVLERNEKIARDVREELK

SEQ ID NO: 10692 - protein, 59 aa, Artificial Sequence
  Synthetic sequence.
DLEEIIRKIREINRELNETVKKVVRELEEDTRRVKRRIEEIVKELERTTRELDKRVKDS

SEQ ID NO: 10693 - protein, 55 aa, Artificial Sequence
  Synthetic sequence.
EKLVEDNRKEVRDLEEEARKLLRENHELTKRLIEEAERILKKNEELIRKIEEEER

SEQ ID NO: 10694 - protein, 59 aa, Artificial Sequence
  Synthetic sequence.
SLEELLEELERILREVEERIKEVVRRLEEDTRRVEEEIRRIVEELKRINRELEELVRRT

SEQ ID NO: 10695 - protein, 55 aa, Artificial Sequence
  Synthetic sequence.
ERLVKEVRDTVKELEDELKELLDRNHELTRRLEEEAKRLLEENKKRADDVKEELR

SEQ ID NO: 10696 - protein, 59 aa, Artificial Sequence
  Synthetic sequence.
RLDEVIRRVEEVIRDVERRVAEVVKRLRDSSKTVKEKIETVIRRNKEINKRLEDLIRES

SEQ ID NO: 10697 - protein, 59 aa, Artificial Sequence
  Synthetic sequence.
EDDLRRTLEEVKRTIDKLKEDAERLLEENKDLIRRLEEELKESSKRNDTLVKKLKKELK

SEQ ID NO: 10698 - protein, 60 aa, Artificial Sequence
  Synthetic sequence.
REMEEALKRNNELSERLRRELKRVLEENHRLSRDLEKKLRDLLERVRELVERLDRMKEEG

SEQ ID NO: 10699 - protein, 59 aa, Artificial Sequence
  Synthetic sequence.
EEVRRVLEEIRRDTEELEKDARRVLTELRRNLERLRRKVEKVLEEIRRILEELERRVRK

SEQ ID NO: 10700 - protein, 60 aa, Artificial Sequence
  Synthetic sequence.
DKLEKLEEKLEKDVRRWDDELRRDLEDSKRLVDTIRKRLEKLLRDHRELVRRIRELLRDG

SEQ ID NO: 10701 - protein, 55 aa, Artificial Sequence
  Synthetic sequence.
EVVRRLEEEVRRLEEKVKEVLRRNEEEVRRLEKDIERVLRESTKIVEDLKDEVRK

SEQ ID NO: 10702 - protein, 60 aa, Artificial Sequence
  Synthetic sequence.
SVEEVVEELERIHREVKREIDEVVDRLREINEEVRREIKEVLDKIREDLERLKEEIDRDL

SEQ ID NO: 10703 - protein, 59 aa, Artificial Sequence
  Synthetic sequence.
DDILREMLRKSEELVRESREDLKRLLEEHRKLVEESRRELERLKKEVKDAVEEVRRRLK

SEQ ID NO: 10704 - protein, 60 aa, Artificial Sequence
  Synthetic sequence.
SVEEVVEELKKIHEDVKRKIDEVLKRLKRINDELRKRIREVLERLRREAEKLMEAIRRDA

SEQ ID NO: 10705 - protein, 59 aa, Artificial Sequence
  Synthetic sequence.
DDILREMLKESKELVKRSEKTLRELEKRHRDLVREVEETLKELEREVERKVREVERRVR

SEQ ID NO: 10706 - protein, 60 aa, Artificial Sequence
  Synthetic sequence.
SVKEVLDEIRKINDDARRRLEEVLKDLKRINDELKERVDRVHDRNRRLLEELKKEIRTKL

SEQ ID NO: 10707 - protein, 59 aa, Artificial Sequence
  Synthetic sequence.
DDILREMLERNKELVKESKKVLEELEREHRELVREVKKRLDDSTEKIKTEVDKVKKELD

SEQ ID NO: 10708 - protein, 60 aa, Artificial Sequence
  Synthetic sequence.
SVEEVIKEIEKIIRDLKEELKKVLTELEKRNEELKRRVEEVHEESRRLLDTIRKEIERKL

SEQ ID NO: 10709 - protein, 59 aa, Artificial Sequence
  Synthetic sequence.
DEVLEELLRRVKKTVKEVREDLDRLRKEHEELVDRVREELERSLREIKERLERIKRRLD

SEQ ID NO: 10710 - protein, 59 aa, Artificial Sequence
  Synthetic sequence.
KEAEELLEKVRKLVKEIEDRLRKSSEENRELVKRVEDELRETTKKNKKLVDEIKERREK

SEQ ID NO: 10711 - protein, 56 aa, Artificial Sequence
  Synthetic sequence.
EDVLRRIEEILERVERAVREVLRRNKEINDRLRERVEDVVRKNEDILRRVLDEVRK

SEQ ID NO: 10712 - protein, 59 aa, Artificial Sequence
  Synthetic sequence.
DEVERLIEEVDKLVKTIEEELRRSSEKNKDAVRRVKRRLEKSNEDNREVVRRVDKERRD

SEQ ID NO: 10713 - protein, 56 aa, Artificial Sequence
  Synthetic sequence.
EDVLRTIKEILRELRERVEEVAKRNKEINDRLNEDVERVVRENKELNDRLRERVDR

SEQ ID NO: 10714 - protein, 60 aa, Artificial Sequence
  Synthetic sequence.
DEAEKLIEEVKRLVEDLERKLDESSRRNEETVKRIDKELKDSNKKNRDTVKKVTDTAKDS

SEQ ID NO: 10715 - protein, 56 aa, Artificial Sequence
  Synthetic sequence.
EDVLRTIKKILDDLERRVEEVVRRNREILKDLERKVRRVFEENEKLNRELEERVKT

SEQ ID NO: 10716 - protein, 60 aa, Artificial Sequence
  Synthetic sequence.
SKADEVEKDVDRKLKEVKKRLDETRESVRRKLEEVRRELEESEKSVETVLREVKKTKDRG

SEQ ID NO: 10717 - protein, 56 aa, Artificial Sequence
  Synthetic sequence.
EEVLKKLKDIATELRERLDRNNKELTDIHRELKERLDRNNTKLSEIHKRLEEELDK

SEQ ID NO: 10718 - protein, 60 aa, Artificial Sequence
  Synthetic sequence.
SEVDEARKRVRDVLEEVRKALEETEKSVRRTLEEVEKRLKESEDSVRKVLEDVRRELERG

SEQ ID NO: 10719 - protein, 56 aa, Artificial Sequence
  Synthetic sequence.
EEALRELEEIARRLERELEKNNKDLTDIHETLRRRLEDNNRKLSKIHEDLARELRK

SEQ ID NO: 10720 - protein, 58 aa, Artificial Sequence
  Synthetic sequence.
KEAEDMLREVKRLIDRIKKVLEDVLKAIEELIRRLEDIHRKVNEDSERLTEDLKRTIG

SEQ ID NO: 10721 - protein, 59 aa, Artificial Sequence
  Synthetic sequence.
KEKIEELLRRVEELIRRIEEEVRKLLEDVERKIRESVKEAEELLRRSKKEIERVKREDT

SEQ ID NO: 10722 - protein, 58 aa, Artificial Sequence
  Synthetic sequence.
SEAERVIRESERLTDELRKELEKALRRSKKLSDELRKIHEDANREVRKLIEDLKRTIG

SEQ ID NO: 10723 - protein, 59 aa, Artificial Sequence
  Synthetic sequence.
EEILKKLLDESRDTVRRVEDTVRKLVRRSEEFVRKSKERVKRLLDDVRRKIEDVKRKTK

SEQ ID NO: 10724 - protein, 59 aa, Artificial Sequence
  Synthetic sequence.
DEEERLLREAEEMHERNKRLIDKLRREVEESLKEVEREIRRLLTDIARLVRRVEELKKN

SEQ ID NO: 10725 - protein, 55 aa, Artificial Sequence
  Synthetic sequence.
EEVLREIRKLVEESRKILEKVIRDWRRITEELKDRLRRVLEELKKLVDELRKTLT

SEQ ID NO: 10726 - protein, 59 aa, Artificial Sequence
  Synthetic sequence.
SDRERLLEEIKDLNRRNKEILERILRRSEELLKKAEDLLDKIKRDSDRAARKVEELKRR

SEQ ID NO: 10727 - protein, 55 aa, Artificial Sequence
  Synthetic sequence.
EEVLRRLEKIVRDSERELRRVREEDKKVADEIREKLKRVHDESERIVRELKETLR

SEQ ID NO: 10728 - protein, 60 aa, Artificial Sequence
  Synthetic sequence.
KELEDVKKRVDDLLRENERVVRELLESSKRLNEENEEAVRRLDESSKELAKRVKEIKDRG

SEQ ID NO: 10729 - protein, 58 aa, Artificial Sequence
  Synthetic sequence.
RDVRRVLEFVKEVIKEIERIHKKVNDDNRKLIEESIRRLKKVLDDNKRVIDELRKTLK

SEQ ID NO: 10730 - protein, 60 aa, Artificial Sequence
  Synthetic sequence.
DEEEEVKKRVEELLDELRKSIKKSVDDSKRVLDEARKSVERSREELEKLLRALEDILRKG

SEQ ID NO: 10731 - protein, 56 aa, Artificial Sequence
  Synthetic sequence.
LRRLEEEAKRLVEEVRRRDEEHLKRSEELLKEVEERDRELLKRARDLFEDVRRKIE

SEQ ID NO: 10732 - protein, 60 aa, Artificial Sequence
  Synthetic sequence.
SEKEEVAKRLEEALKRLEDTIRKVSEENERVLRTLEDRARKSAEKVERLLEELRKRLEDS

SEQ ID NO: 10733 - protein, 56 aa, Artificial Sequence
  Synthetic sequence.
LEELKKRVEELTREVEEEIRRLKETSKRLEEEVKRLIEDHDRRVRELKDEVERRIR

SEQ ID NO: 10734 - protein, 57 aa, Artificial Sequence
  Synthetic sequence.
DEAREVIKTLRKLLRDSAEILTRVTEEDREVLRELAEIIKKVTDEDRRVLEEARREL

SEQ ID NO: 10735 - protein, 59 aa, Artificial Sequence
  Synthetic sequence.
DRILEELLERIKRLHEENKKAVDRWREESKKLKEEVKKKVKEWKDTSEELLRRVKERAR

SEQ ID NO: 10736 - protein, 57 aa, Artificial Sequence
  Synthetic sequence.
KEVEEVIKTLRRLSEKLAREHKKVIDELRDLLRRSEEELKRVAKADEDLLDEIRRKV

SEQ ID NO: 10737 - protein, 59 aa, Artificial Sequence
  Synthetic sequence.
EEILEEVKERIDRLVKENKEIVDRSRELAKELHDRNREMLTKWLEDSKRLVEEAEKKAR

SEQ ID NO: 10738 - protein, 59 aa, Artificial Sequence
  Synthetic sequence.
DKEKEVTDELRKAKRDNDEVVKEIEKESRRLLEEVKETVKRDKKVLRELEEEVKEAKKK

SEQ ID NO: 10739 - protein, 55 aa, Artificial Sequence
  Synthetic sequence.
KKVLDEIRKVLTEAKKMHDDVLRRDREVLETARKLSEDSKKENEDVLRKVAEELR

SEQ ID NO: 10740 - protein, 58 aa, Artificial Sequence
  Synthetic sequence.
DEERDLERKLEEVIRRAKETSERLNRELERVIEEVRRRHEEAKRRAEEVIRRILKRLG

SEQ ID NO: 10741 - protein, 56 aa, Artificial Sequence
  Synthetic sequence.
KDEVDELVERLKRDIDRWAEDVKKLIEDLRRMVERNLREIDKLLKDLKRVVDETKK

SEQ ID NO: 10742 - protein, 60 aa, Artificial Sequence
  Synthetic sequence.
SEADKLLDEVRKRVEDMERRLEELVREDRKLVEDHHRDNKRLLDRVKKLAEDMERLIDRG

SEQ ID NO: 10743 - protein, 59 aa, Artificial Sequence
  Synthetic sequence.
SEKAEDVRRRLKELAERVRRVVRRVEEESKRTLKELEKSSKELAKKLRDLVETVERRLR

SEQ ID NO: 10744 - protein, 60 aa, Artificial Sequence
  Synthetic sequence.
SRVDDLLREAERLAEEHHRLNKKLVDEDRELVRRHHETNRRVLEEVKRLVEEAEKLIRRG

SEQ ID NO: 10745 - protein, 59 aa, Artificial Sequence
  Synthetic sequence.
SEEAKRVAERVRRLLERLRESSKRVKETSKETLERLRRSSEKVEEDLRKLIEDVERAAR

SEQ ID NO: 10746 - protein, 60 aa, Artificial Sequence
  Synthetic sequence.
RELEELVKRDREEVRKHHELNKELLDRARKLVRDHHERNKRLVREDEELVREAKELIERG

SEQ ID NO: 10747 - protein, 59 aa, Artificial Sequence
  Synthetic sequence.
SDEARKAKRESERTLKELEESSREVEKELRRLLKELRESSKKVEDDSRKSLERVERALR

SEQ ID NO: 10748 - protein, 60 aa, Artificial Sequence
  Synthetic sequence.
SKADELVKKDREKVEEMERRLRKILREVEELVKEHHERNKRVLDEVKKRVDDAKELIKRG

SEQ ID NO: 10749 - protein, 59 aa, Artificial Sequence
  Synthetic sequence.
SRKAEEVEKDSRRTLERVKDVLRKVEETLRELLDRLRESSERVTEALKRLMEEVREALR

SEQ ID NO: 10750 - protein, 61 aa, Artificial Sequence
  Synthetic sequence.
SKLEALVKEVEELVKKAKKDLDRLVEEDKKLAEEHHDRNRKLVDTVRELVERAKEDIDRRG

SEQ ID NO: 10751 - protein, 58 aa, Artificial Sequence
  Synthetic sequence.
KELEEVVKELRRLLKELEEVVRRVARESEKSLEEVRRSSEEVKKALDKLLKELEDAVR

SEQ ID NO: 10752 - protein, 59 aa, Artificial Sequence
  Synthetic sequence.
SELERIVEEVKKLVEDHKKKLKDIVEEVEELVRRHEKKLEDILRRNEKRVRELKEEVRR

SEQ ID NO: 10753 - protein, 59 aa, Artificial Sequence
  Synthetic sequence.
RKKAEEVKRRLEELLKEANKASEEVKRTLDKLLEDVNRESERVERASDELLKRLRDDAR

SEQ ID NO: 10754 - protein, 61 aa, Artificial Sequence
  Synthetic sequence.
SELEELVKTVKKLVEDHKRRLKELLERARRSTEDLKRKLEKLVRDVRKLVEDAKDAIRKSG

SEQ ID NO: 10755 - protein, 59 aa, Artificial Sequence
  Synthetic sequence.
KDELKKVEDALRRLLEELNEVSEEVERALRELHREVEEAIRRVEKELDRLLKEVEDAAR

SEQ ID NO: 10756 - protein, 59 aa, Artificial Sequence
  Synthetic sequence.
RELEEILKESEKSVEDIKRELEKIKKKSKTDLEKWKDDLRKIRKEIADLVRKVTREVED

SEQ ID NO: 10757 - protein, 58 aa, Artificial Sequence
  Synthetic sequence.
EKVKRVLDELKRSLEEVRRALEEVREVLRESLKRLRDLAEDLKRELRELLKELEERAR

SEQ ID NO: 10758 - protein, 60 aa, Artificial Sequence
  Synthetic sequence.
SEKEDVERRIRRLIERLRRMIEELRRRNTDILRKVRELVEEVKKADERSIREVEKLLRDV

SEQ ID NO: 10759 - protein, 56 aa, Artificial Sequence
  Synthetic sequence.
LDELIERAERLVREIERKLRKAIEDSKDLLRRIEERLRRLIEKSEKLLRDIKREVD

SEQ ID NO: 10760 - protein, 61 aa, Artificial Sequence
  Synthetic sequence.
SEIEKLVKEIEDHLRRLKEEIEKSSRELKKHLDELERRADKIVRDLRRLVEEIKDTIRREG

SEQ ID NO: 10761 - protein, 59 aa, Artificial Sequence
  Synthetic sequence.
REAVERLRKALKESKERLKKALEDNRRTLKKSEEDLKKVMEEVKETLDRVKKEVERALD

SEQ ID NO: 10762 - protein, 61 aa, Artificial Sequence
  Synthetic sequence.
SEIEKLARDAEEHLRRLLEELRKSSDDLRRHLEELKKKLKEIVDRLKELVDRIKDTIRREG

SEQ ID NO: 10763 - protein, 59 aa, Artificial Sequence
  Synthetic sequence.
KKVIDDLRRILEESARRLKRAAERNDETLKESADRLRRAIDRLREVAEKLSRDVRRAAK

SEQ ID NO: 10764 - protein, 61 aa, Artificial Sequence
  Synthetic sequence.
SEIEDIARRLREHLEDLKKKIKDSSDELRKHLEEVKRRIERTSEKLTDDVRKIEEKIRKDG

SEQ ID NO: 10765 - protein, 59 aa, Artificial Sequence
  Synthetic sequence.
EERIRDLEKILEDSERELRDMARKNRETAERSERELRKVLRENDRTAKKLTDDVRRTAK

SEQ ID NO: 10766 - protein, 61 aa, Artificial Sequence
  Synthetic sequence.
DEIDKLVEDVERHLEKLLREIERSSEELKKHVEDLREKLRDLVRRLKEVVDEIRKTVRDKG

SEQ ID NO: 10767 - protein, 59 aa, Artificial Sequence
  Synthetic sequence.
KEDVDRLREMLERSRRRLKRAADENRRTAEKSRKELKEVAERVRRALERMRREVEEELR

SEQ ID NO: 10768 - protein, 61 aa, Artificial Sequence
  Synthetic sequence.
SEIEEIAKKLEEHVKRVVEEIRKSSEEAKRHVEDVKRKIEELVRELARLVKEIKEAIRRDG

SEQ ID NO: 10769 - protein, 59 aa, Artificial Sequence
  Synthetic sequence.
KERIDELREIAKRSRDKLKKVADENRRTLEKSLRDLARAVEELRRRAKRLEEEVRRERT

SEQ ID NO: 10770 - protein, 61 aa, Artificial Sequence
  Synthetic sequence.
SDIERLVEEVEKHLKELEDEIRKSSEELKRLAEEISRDIRRTSEELKKLIEDIKDTIRRDG

SEQ ID NO: 10771 - protein, 59 aa, Artificial Sequence
  Synthetic sequence.
KEKIDRLRKILEESEKRLEELARENERTVKEVKKEIDDMVRENEETAKRLLDEVRETLR

SEQ ID NO: 10772 - protein, 56 aa, Artificial Sequence
  Synthetic sequence.
DELEKLLEDLRRKIRKIKEDLRKTSKENRDELRKSKKRLEDLVREVRRLVEEIRKL

SEQ ID NO: 10773 - protein, 55 aa, Artificial Sequence
  Synthetic sequence.
EEVEKTLRELIKEIEKVLEDDERTVRELIERNKELLDRLAKEVDRLIEEIKREAD

SEQ ID NO: 10774 - protein, 57 aa, Artificial Sequence
  Synthetic sequence.
SEADKVRKELDDVRRRVKKALDDIRRELEKLVKEVEDALRDHERSNEELVREVREKL

SEQ ID NO: 10775 - protein, 55 aa, Artificial Sequence
  Synthetic sequence.
DRVVEEIRDMMRKLKRELERIVEEAKKVVEDLKRRLEEVSRRSADLVRRLKERAR

SEQ ID NO: 10776 - protein, 55 aa, Artificial Sequence
  Synthetic sequence.
SDLERVKKDLEDVVRRVEEVLREHKRTNDEIIREIERLIEELRKENERLAREVRD

SEQ ID NO: 10777 - protein, 55 aa, Artificial Sequence
  Synthetic sequence.
ERVVDEIRKVVKELEERLRRLSEESRKLVKDIKEKLDKLAEDSRRLVEKLERDAK

SEQ ID NO: 10778 - protein, 61 aa, Artificial Sequence
  Synthetic sequence.
REFEELVERVKRVVEELTRRLRETSEETKTVLEKLRKELEEASRRIEDVLRRLTEKIRKDG

SEQ ID NO: 10779 - protein, 55 aa, Artificial Sequence
  Synthetic sequence.
EELEETLERLVEAIRDALRKDEETMRRVAEAIRRLLEDHRRSLEEVLEKIRDALR

SEQ ID NO: 10780 - protein, 61 aa, Artificial Sequence
  Synthetic sequence.
SEAEKIVEDIRRVIRELKEKLKKTSEDTEDTVRKLSRRLRELAKRSAELVERVTREIRKDG

SEQ ID NO: 10781 - protein, 55 aa, Artificial Sequence
  Synthetic sequence.
EELEETLRRVAEEIRRLLEEDRETLRRVERKIREMLKELEEINRRLIKEVDEEVK

SEQ ID NO: 10782 - protein, 61 aa, Artificial Sequence
  Synthetic sequence.
DEVEEIVRRIEEVLKDLRRRLETLARESRDLVRKIKEELRRHSDESRRLLERIKERIRRDG

SEQ ID NO: 10783 - protein, 55 aa, Artificial Sequence
  Synthetic sequence.
DELKKEADRVKKEIRDMLRKLKKINDDLIREIEEALKDNERTNREIIRRIEEELR

SEQ ID NO: 10784 - protein, 61 aa, Artificial Sequence
  Synthetic sequence.
DEAEKIVRDIEETVRRLARELEKHSEDSRRLVERIKEELTRHSKKVADVVRELKKRIKRDG

SEQ ID NO: 10785 - protein, 55 aa, Artificial Sequence
  Synthetic sequence.
EELEKRMRRLVKEIERMLEENKRTNEELVREIEEALKKNEETLRRLKREIEEALR

SEQ ID NO: 10786 - protein, 56 aa, Artificial Sequence
  Synthetic sequence.
SEAEELVKDAERVVEELERRLRKVSEDIDREVKKIKRELDEHSKRVKETVDDVRRR

SEQ ID NO: 10787 - protein, 55 aa, Artificial Sequence
  Synthetic sequence.
EELKKRVEDLIRTIKELIKRHDDSVKEVEKRIREMLERNRKSVEEVIEELKRTSK

SEQ ID NO: 10788 - protein, 61 aa, Artificial Sequence
  Synthetic sequence.
SELEELVKEVKELVDRSKEELKKLSEELKKLLDDLIKRIEDLSRRSKRLVEELRRRVEERG

SEQ ID NO: 10789 - protein, 58 aa, Artificial Sequence
  Synthetic sequence.
EEMKRVEEELKRLREEDREAVERHDESIRKLREDLRRAVETHKKSNRDLLREVEETVR

SEQ ID NO: 10790 - protein, 59 aa, Artificial Sequence
  Synthetic sequence.
DEVEELIRKIEDLLRRIEEKVTKAIRKSERLLEEIKKKIKEMIDKSERLVEEVERRTRN

SEQ ID NO: 10791 - protein, 55 aa, Artificial Sequence
  Synthetic sequence.
EDVKRVLKKVADDVERLLRDLERRNRKVREDVKRVLEELRKSNERSIRRIDETLR

SEQ ID NO: 10792 - protein, 59 aa, Artificial Sequence
  Synthetic sequence.
REIEEIIKRARELLEEVEEEWRRLIEKSRRLLEELKKRWDKLIEKSKDLLRKIEKTTKD

SEQ ID NO: 10793 - protein, 55 aa, Artificial Sequence
  Synthetic sequence.
DELRKILKRVEDENRRLVEEVERSNRRSMEENERLAEEVRRSNKDVIDKIRERLR

SEQ ID NO: 10794 - protein, 60 aa, Artificial Sequence
  Synthetic sequence.
DELERLSESVKKAERRIERLNEELNERVKEVTKAIDDLNKRLNDESKRVKEELRKVLARS

SEQ ID NO: 10795 - protein, 59 aa, Artificial Sequence
  Synthetic sequence.
EEVIKRVLDDVERAVDEVRKLIEDVLKEHEDILREVKKELDKAIERHKEILKRVREDIK

SEQ ID NO: 10796 - protein, 60 aa, Artificial Sequence
  Synthetic sequence.
SVLEDLARKVERVIREAKKVNEELNRRSEEVRRRADEVVADLNRESKKVDDELKKVLARS

SEQ ID NO: 10797 - protein, 59 aa, Artificial Sequence
  Synthetic sequence.
EEVARRVVEELKKVLKEIEDEIRRVIERHKEALDEVRRLVKELKDRHDKILREVREKIR

SEQ ID NO: 10798 - protein, 60 aa, Artificial Sequence
  Synthetic sequence.
SSEDRLRETVEDVIRRARDANRELNKASRDVEEESKKLNKELNDRSRKVERDLEEVLRRS

SEQ ID NO: 10799 - protein, 59 aa, Artificial Sequence
  Synthetic sequence.
EEVIERLIRDLRRVLEEIKREIEEALRDHERVLKENEDMVREILRRHEEILKRMTDEIR

SEQ ID NO: 10800 - protein, 60 aa, Artificial Sequence
  Synthetic sequence.
SVLERVADELRKVEEAIDRLNKELNDAVERVERESRRVNKELNDASERVERELDEVLKRT

SEQ ID NO: 10801 - protein, 59 aa, Artificial Sequence
  Synthetic sequence.
EEVAKELIDRIRKLLDDIRRKLEEVLKRHEEVLKRNEDTIRKVLKRHEEILEKVKRDIK

SEQ ID NO: 10802 - protein, 60 aa, Artificial Sequence
  Synthetic sequence.
SSKERLREAVERVERESDKVNKELNDKSRRVTEELRKLAEELNRRSKEVEEELDKLLARS

SEQ ID NO: 10803 - protein, 59 aa, Artificial Sequence
  Synthetic sequence.
EEVIRRLIEELDRLLEENDRRIKKAIEDHKRILEKAEREVREILRRHEKILEDVREEIR

SEQ ID NO: 10804 - protein, 57 aa, Artificial Sequence
  Synthetic sequence.
DEEEDLRRAIERVIETVRRLVERVEEESKRVADELRKLTKRLEEVVRKVDEDARKEV

SEQ ID NO: 10805 - protein, 54 aa, Artificial Sequence
  Synthetic sequence.
DVKRRLEELLKRAKEVLDELIKRHRDLLRRHEEKVRRLIKRIEDLLRELSKKAK

SEQ ID NO: 10806 - protein, 57 aa, Artificial Sequence
  Synthetic sequence.
SKEEELEKIVRKIREDLRRAVKEVEDESKRVLESTKKALDTIRRVSEKVIEDLRREL

SEQ ID NO: 10807 - protein, 56 aa, Artificial Sequence
  Synthetic sequence.
VDELVRRLEELLKELRKRLEDLIRRHEDINRRNHELIRRAIEEHRRLLREAREREK

SEQ ID NO: 10808 - protein, 57 aa, Artificial Sequence
  Synthetic sequence.
DEIEELIKKLREDLDRSRREVEKNSEDLKELIKRSEERIEKLIEDLERMVDDARRKN

SEQ ID NO: 10809 - protein, 59 aa, Artificial Sequence
  Synthetic sequence.
EKLLKKLEDVIDDVRRRDEDVVRKNEESLKRIEKRDEELIRKIEEVIRRAERKVDEVMR

SEQ ID NO: 10810 - protein, 57 aa, Artificial Sequence
  Synthetic sequence.
SKIEELIKELEKLSRTNEELVKRVLEELTRLVEESAKRIEDIIRRLKEVVDKARREN

SEQ ID NO: 10811 - protein, 59 aa, Artificial Sequence
  Synthetic sequence.
KKLLDKIKKAIEDLERENERALKELEKRLRELLRTDRELIRKIEEEIKKLRREVEEVLR

SEQ ID NO: 10812 - protein, 60 aa, Artificial Sequence
  Synthetic sequence.
SIKERLTEVLKRLAEEIRKVIEENKRTVDRAREEVERVIRKNREVLKRIKERADEVIKRI

SEQ ID NO: 10813 - protein, 59 aa, Artificial Sequence
  Synthetic sequence.
ERVVEELIREAKKIVEDIVRRVKRHSREVERIVEEIRRRAEEHIERLKRSLEEVEKKVD

SEQ ID NO: 10814 - protein, 60 aa, Artificial Sequence
  Synthetic sequence.
RIMEKLEEVLKELRKKIKKLNKDNEETVRRIKKEVDKVIKKNRDVNERIRKRLEEVISRI

SEQ ID NO: 10815 - protein, 59 aa, Artificial Sequence
  Synthetic sequence.
EEVVEKLIEDMERVVAESAKENKKHSDDVKRILDEIRRKAEDHIRKTEELLRRIEERTR

SEQ ID NO: 10816 - protein, 60 aa, Artificial Sequence
  Synthetic sequence.
SIKEKLTEELERLAKRIREANEDNKRTVEEVEKRIREVIKKNRDSNKEIKDDVERVLSRI

SEQ ID NO: 10817 - protein, 59 aa, Artificial Sequence
  Synthetic sequence.
EEVVERLLKKMREAVKKSEDENREHSERVKRIIEKIAREAEEHSKRTKELLDRIREEVR

SEQ ID NO: 10818 - protein, 60 aa, Artificial Sequence
  Synthetic sequence.
RVDEDLKRVLDELKKRVEDLNEENKKTVEDISRRVREVIKRNEDMLREVKKRAREAISRI

SEQ ID NO: 10819 - protein, 59 aa, Artificial Sequence
  Synthetic sequence.
EEVVRELIKKMRDVVRKSEKDNKDHSERVKRILKRIEERAREHTRRLEEVLRKVEEDVR

SEQ ID NO: 10820 - protein, 61 aa, Artificial Sequence
  Synthetic sequence.
RVKEKLREVLERLEREIRKILKDNKETVKRIEEEARRAVEKNKEALKRLEDRVRELLEDKD

SEQ ID NO: 10821 - protein, 59 aa, Artificial Sequence
  Synthetic sequence.
EEKVERLAEELRKIVRKIIEDVRKHSEDVRKILEDVKKEVDDHVREMEEIVKRLEDEIR

SEQ ID NO: 10822 - protein, 60 aa, Artificial Sequence
  Synthetic sequence.
SELEEIVKEIKRILDEHEKKVRRNSEEMKRIVDRHAERVEKLIREIEELLRRLDELVKRG

SEQ ID NO: 10823 - protein, 56 aa, Artificial Sequence
  Synthetic sequence.
EEDLERMAREIKDRLDKIDEENKKSSEELKRELDRLDEKLRDVARRIMEAIDERTR

SEQ ID NO: 10824 - protein, 60 aa, Artificial Sequence
  Synthetic sequence.
DELREIVRRIEKILEDHARTIEEVIERIRDILRKHEKLVEEVLRRIEKLLKELEEMVRRG

SEQ ID NO: 10825 - protein, 56 aa, Artificial Sequence
  Synthetic sequence.
TEDLERMAERVKRELERLNKKAEDALREVKRALDDLDRDLKRVLEEIKERIRRATT

SEQ ID NO: 10826 - protein, 60 aa, Artificial Sequence
  Synthetic sequence.
SELERILTEIEKRIEEHERRIKENSKRMKEIVDDHERKVEEVLRRIRKLLRDLEEMVKRG

SEQ ID NO: 10827 - protein, 56 aa, Artificial Sequence
  Synthetic sequence.
REDLEKVARDVEKRLEDANRENEKSSRELKRRLDELDKKLEEEARRIKKAIDDKTR

SEQ ID NO: 10828 - protein, 60 aa, Artificial Sequence
  Synthetic sequence.
SEVDEVAKEIRRILEEHEEEIRRNSEEAKRILDEHREKLKRNSDDMRRIVKEIEDMRRRG

SEQ ID NO: 10829 - protein, 56 aa, Artificial Sequence
  Synthetic sequence.
EEDLREVAERVKKDLDRLNRENDESSKEIEKDLKRLDDRNRDVSEKLKKEIDELTK

SEQ ID NO: 10830 - protein, 60 aa, Artificial Sequence
  Synthetic sequence.
DRLREIVKRIRDILKEHEDRIRENSKRARDILREHKRKIEEVLRRIEKLVEDLERLKRRG

SEQ ID NO: 10831 - protein, 56 aa, Artificial Sequence
  Synthetic sequence.
EEDLRRAAEEVKKKLDELNEENERSSEDVKRTLKKLNDELREKVRRVMERIDEAVR

SEQ ID NO: 10832 - protein, 60 aa, Artificial Sequence
  Synthetic sequence.
DEVEDVLRKIEKILDDHRKRIEKNSRDMARIIDEHRRKVEENSREMKKLVDDLKKAVDRG

SEQ ID NO: 10833 - protein, 56 aa, Artificial Sequence
  Synthetic sequence.
EEELKEVADRVKEKLDRLNRENEKSSEELKRELDKINDENRETSERLKREIDETTR

SEQ ID NO: 10834 - protein, 60 aa, Artificial Sequence
  Synthetic sequence.
DELREVVKTIEEILRDHERKVRDNSRRMKEIIKRVKEELERVIKEAKELVERLKEAVRRG

SEQ ID NO: 10835 - protein, 56 aa, Artificial Sequence
  Synthetic sequence.
EEDLRKMAEDVKRALDKINRDNEESSRRLKKELDDVLRKVEEVIRRLEEEIDRLTT

SEQ ID NO: 10836 - protein, 59 aa, Artificial Sequence
  Synthetic sequence.
SELEKIEEDIRRILKEHKDTVRKNSEDIDRSVKEVKERIDKILKEIDDLLKELRELVER

SEQ ID NO: 10837 - protein, 56 aa, Artificial Sequence
  Synthetic sequence.
REDLERVVREVKKELDDINRENRKSSEEAKKKNDDVLAELEKRIREIKRRIDEDAT

SEQ ID NO: 10838 - protein, 60 aa, Artificial Sequence
  Synthetic sequence.
SDLEKLVEEIKRLLKELKERVTKNSEDMKREVERHKELVKKLKKRIEDLLRELEDAVRKG

SEQ ID NO: 10839 - protein, 56 aa, Artificial Sequence
  Synthetic sequence.
REDLERVVEEVKKEIDKIVEENRDSSRKLKERLDEANEELERRVEEIERRIDEKAR

SEQ ID NO: 10840 - protein, 60 aa, Artificial Sequence
  Synthetic sequence.
DELREIVTRADETLKRVADKIEENSRRMEEIVREHERKVRELLKRIEKLVRDLSAMVRRG

SEQ ID NO: 10841 - protein, 56 aa, Artificial Sequence
  Synthetic sequence.
EEDLRRVVKRVKETNRRLLEKNKDSSRKLKKRLDEANKTLADALEEVKRRIDERRK

SEQ ID NO: 10842 - protein, 60 aa, Artificial Sequence
  Synthetic sequence.
DELDEIVKRAKETVEKVKREVDANSKDIERILREHRKKVDKNSKDMEDLVRKLEELVRRG

SEQ ID NO: 10843 - protein, 56 aa, Artificial Sequence
  Synthetic sequence.
EDELREAVERLERENRKVLEENRRSSEKVKRDLDRVNRENEEVSERLKKRIDEAAT

SEQ ID NO: 10844 - protein, 60 aa, Artificial Sequence
  Synthetic sequence.
SEIEKIIKELDDLVKEDEDTIRRLEEELRELLKEIDREAKKSDEELEKTLEELAKIARDG

SEQ ID NO: 10845 - protein, 55 aa, Artificial Sequence
  Synthetic sequence.
EELRRVLERVAEDSKRTLDRLERVLKEVERRVDEALKRNKTVLDKVREDVKRLKD

SEQ ID NO: 10846 - protein, 59 aa, Artificial Sequence
  Synthetic sequence.
REIEEMIKRNEKLLEDDKRKVKRIIEKLDKVLEDDRKRAEDLIRKLEKVAEEIARLRDK

SEQ ID NO: 10847 - protein, 59 aa, Artificial Sequence
  Synthetic sequence.
EELLDTLRKVNERVARESEKTIRELEKVLERVNRESKKTIEEVEKALKEVADRVTEVRR

SEQ ID NO: 10848 - protein, 59 aa, Artificial Sequence
  Synthetic sequence.
SEIEKLIKENKDLLEEDKRRVEEVIEKLERVIEEDKRRVDEAIKRLDDVAREIERLRKD

SEQ ID NO: 10849 - protein, 59 aa, Artificial Sequence
  Synthetic sequence.
EDLLRRLERVNEEVARRSEDTIRRLREVLKKIEDDSRRTIDELREVLKRVKTRVTEVRR

SEQ ID NO: 10850 - protein, 59 aa, Artificial Sequence
  Synthetic sequence.
DDIERLIKRNKDLLDRIREEARKLIERLKKVLEDDRRKVERAIERLEEVVDEVRKLKKD

SEQ ID NO: 10851 - protein, 59 aa, Artificial Sequence
  Synthetic sequence.
EEVLRKLKKANEDVEREVRKMIEEVRRVLRKVEEDSKRTIKKLKDVLKKVAEEMEKVRR

SEQ ID NO: 10852 - protein, 59 aa, Artificial Sequence
  Synthetic sequence.
DEVEEAIKELEDALRKDREAVERMIRDLERLADEDRREVEDHVKKIEELIAAVERMSRD

SEQ ID NO: 10853 - protein, 59 aa, Artificial Sequence
  Synthetic sequence.
REVLEKLKEVLKRVEKASRKTNEDVKRVLDEVRRISEETNRRNERVVEEAKERVERVAK

SEQ ID NO: 10854 - protein, 60 aa, Artificial Sequence
  Synthetic sequence.
SEVDEVIKRLEELVERHRRKVEEVIRRLEKLAEDHERKVRELEKRLRELIKRIEELARRD

SEQ ID NO: 10855 - protein, 59 aa, Artificial Sequence
  Synthetic sequence.
SRDFDRLEDVARRVKEDLERTDEEVRRVAEEVRKRVEKTTRDVERVVREVERAIEERRR

SEQ ID NO: 10856 - protein, 61 aa, Artificial Sequence
  Synthetic sequence.
DEAREVIKTLEKLLEEHERRVREVIKRLEELIKRHEDRVREVIETLKRLLEEAEKIVRRDG

SEQ ID NO: 10857 - protein, 59 aa, Artificial Sequence
  Synthetic sequence.
SEDMRRLEEVIRKVKEALKRTNDRLREVVDEVKKRLDKTDEDATRVVEEVKKRIDEAAK

SEQ ID NO: 10858 - protein, 61 aa, Artificial Sequence
  Synthetic sequence.
DEVETVIRRLEELIREHKEKVDRIIKELEKLLRKHEEKVKKVIEELRRLAKEAADIVRRDG

SEQ ID NO: 10859 - protein, 59 aa, Artificial Sequence
  Synthetic sequence.
SRDMERLERVIRKVEEDLDRTNREVEEVIRRVEEEVERLDREAEEVVRDVKEKIDRLKK

SEQ ID NO: 10860 - protein, 61 aa, Artificial Sequence
  Synthetic sequence.
SEAEKVIKELRDIVKRNDEVVKEIIRRLEELVKEHKRLVEEIIKRLRELLKRIEEVVRRDG

SEQ ID NO: 10861 - protein, 59 aa, Artificial Sequence
  Synthetic sequence.
SEDLKRLKDVLDEVIKKTDELLREVERKAREVTKRLRDLDRRVKEVADEVRRRIREATK

SEQ ID NO: 10862 - protein, 63 aa, Artificial Sequence
  Synthetic sequence.
EEEERVKEFLDRVDTEDKKLVEELRKVVERVKRENEKLIKESEDMSKKVEDDARRLIAELRRE

SEQ ID NO: 10863 - protein, 55 aa, Artificial Sequence
  Synthetic sequence.
KEVVRKLEEYLRRSRKLVDELKKKLRELLERSREKVERSKEELKRILEEVRKKAK

SEQ ID NO: 10864 - protein, 61 aa, Artificial Sequence
  Synthetic sequence.
SVSERLRRVLERVAREVKRLIDEDRKVNEEAEREVRKLIKKDEDALKRVAEEVERLIREAS

SEQ ID NO: 10865 - protein, 59 aa, Artificial Sequence
  Synthetic sequence.
EEIIEELIRRLEEIVKRLEEKHRTTVKKIEDIIRELKKTHDKTIEDLRRIIEEIEERVR

SEQ ID NO: 10866 - protein, 59 aa, Artificial Sequence
  Synthetic sequence.
RVREELRKVLKRAAEAVERVLRKNEEVLRRAEERIRRLLEENEKSLEKVERDVTRILEG

SEQ ID NO: 10867 - protein, 59 aa, Artificial Sequence
  Synthetic sequence.
EEKVKKLIREIEEVIDRLRRESEKHIEEIKEIITRLDKEVKDHDERLKREVDKLEERAR

SEQ ID NO: 10868 - protein, 60 aa, Artificial Sequence
  Synthetic sequence.
SVEERLRKVLEEVRRLLEKIIKDNREVLKRAEEKVRELIKRDKDVLDRIAEEVERLKEKG

SEQ ID NO: 10869 - protein, 59 aa, Artificial Sequence
  Synthetic sequence.
EEKVDRLIEELKKLIDDAREKNERHIEEIERIIDDLRRKHEETARRLKEAIDRLREEAQ

SEQ ID NO: 10870 - protein, 59 aa, Artificial Sequence
  Synthetic sequence.
DKEERIERVLKRVEEELKKLKERIEEVLKKVEDMVRKNLEEIRKVSEDHERTVREIRKR

SEQ ID NO: 10871 - protein, 59 aa, Artificial Sequence
  Synthetic sequence.
EKVVEEIIKELERLLEDLKRRADELIKRLEKLVEEHHRKVEELVRRLEESLDKVRRDAK

SEQ ID NO: 10872 - protein, 60 aa, Artificial Sequence
  Synthetic sequence.
SEDEKVKRVVEKVKEESDRLNEELKRVVDEVRKELERLIEKIKRSVERMDRTVRELLKRI

SEQ ID NO: 10873 - protein, 55 aa, Artificial Sequence
  Synthetic sequence.
DRVVEKLKKALDESRKTHKKLIDDLRRALEELEKRVEDLNRENERLLDEIKKRVD

SEQ ID NO: 10874 - protein, 59 aa, Artificial Sequence
  Synthetic sequence.
DVERKIEEVVRDVKRELDRLLEENRRSVERVERALDKLLEDSRRVVEEVKKALDDLRRR

SEQ ID NO: 10875 - protein, 59 aa, Artificial Sequence
  Synthetic sequence.
ETDVKKIIEDLRRLVREVEEHSRRTNRRLEELVKDLARHAKRSIDRLKELVDRARERAR

SEQ ID NO: 10876 - protein, 59 aa, Artificial Sequence
  Synthetic sequence.
DVEKDIERVVEDVKRELRRLLKEDRDVSKKVKDDLDKLLKESEEVVRRVKKELDRLREE

SEQ ID NO: 10877 - protein, 59 aa, Artificial Sequence
  Synthetic sequence.
KSAVDEIIRRLKELVKEMKRHVDKSIKDLEELVRRLEEHIRRSIERLKKLVEEAREDAR

SEQ ID NO: 10878 - protein, 59 aa, Artificial Sequence
  Synthetic sequence.
SVEEEVDKVVKKLEEDLDRLLEESKEVVERVEKALDDLLKRDEDVSEEVRRELERLKEE

SEQ ID NO: 10879 - protein, 59 aa, Artificial Sequence
  Synthetic sequence.
ESMVKKLLDELRKLVEDAREHVERSIRELEKLVKEADDHVRKSIEDLKRLVEEVRETAR

SEQ ID NO: 10880 - protein, 59 aa, Artificial Sequence
  Synthetic sequence.
DVEKEIKDVVDKAKRELDRLLREDREVSREVKEALDKLLEDNRRSVERVERELDDLRRR

SEQ ID NO: 10881 - protein, 59 aa, Artificial Sequence
  Synthetic sequence.
ESVVKEILKRLEKLVEDAKRHVEDSIRKLKKLVDDMRKHSERSNRDLERLVREAREKAR

SEQ ID NO: 10882 - protein, 59 aa, Artificial Sequence
  Synthetic sequence.
SVEEEIRKVVEEVKRELDRLLEKNDRSVKEAKKELDRLLEENRRAVEEVKKALDELEKN

SEQ ID NO: 10883 - protein, 59 aa, Artificial Sequence
  Synthetic sequence.
ESEAKRLIDRLRELVKRVAEHSERSDRELKKLVDDLREHSKRSNDDLRRLVEEAEREVR

SEQ ID NO: 10884 - protein, 59 aa, Artificial Sequence
  Synthetic sequence.
SVEDKVREAVRRAKEALKKLVEDDRRVVKEVEEMLDTLLDKNRDSVRRAKEKLEDLKRK

SEQ ID NO: 10885 - protein, 59 aa, Artificial Sequence
  Synthetic sequence.
ESDAERLIETLERLVKELEDHVRRSIRKLRELVEEMRDHSRRSDEELKKRLKEVEDRVR

SEQ ID NO: 10886 - protein, 59 aa, Artificial Sequence
  Synthetic sequence.
DVEEEIKRVVKKVEEELDKLLEDDERVVREVEEMLDRLLKKNEKVVRDAKRKLDDLRRK

SEQ ID NO: 10887 - protein, 59 aa, Artificial Sequence
  Synthetic sequence.
KDVVDKIIETLRRLVKEVAKEVKRSIDELKKTVEEVRKHSEETDRRIEKLAKEAEEEVR

SEQ ID NO: 10888 - protein, 59 aa, Artificial Sequence
  Synthetic sequence.
SVEEKIREVVERVRRMLEKLLEDNDRSVKEASKALDDLLRESRRVVEEVKKALDDLRRK

SEQ ID NO: 10889 - protein, 59 aa, Artificial Sequence
  Synthetic sequence.
ESEVRRIIRELEELVKRATDHVRRSDKRLRELVDELRKHIRKSIEDLKRLVDEARRRKD

SEQ ID NO: 10890 - protein, 61 aa, Artificial Sequence
  Synthetic sequence.
DEVEEIRKELEKLLEEVRRKLEKIIKDIRDLLREDKRKSERIDRELEKLLRRLEEIVRDRG

SEQ ID NO: 10891 - protein, 59 aa, Artificial Sequence
  Synthetic sequence.
EEMLREVKRVLEEVRRDIERLLEEIRKVVEEWRKRLEDLKKKNEDSAREVKRRIDELRK

SEQ ID NO: 10892 - protein, 61 aa, Artificial Sequence
  Synthetic sequence.
SEVEDIIRRLRELLERHREVSKRINDELRKLLREVEEDSRRLDKEIEDLLRRIREKVTRDG

SEQ ID NO: 10893 - protein, 59 aa, Artificial Sequence
  Synthetic sequence.
EDARRRVERVLREVEDTLRKLDKENEDSARRVKEALDRLLKKNEESIRRAEREIDELRR

SEQ ID NO: 10894 - protein, 61 aa, Artificial Sequence
  Synthetic sequence.
DDVEELKKEIKKLLDDHKKLSKELNEDIERLLREHRKLSEEIDRRLEKLLKELEELVRREG

SEQ ID NO: 10895 - protein, 59 aa, Artificial Sequence
  Synthetic sequence.
KELLDEVERVVREAKKTLDRVDEENKKSIEDAERELERMDRKNEKSVEDVRRTAKELLR

SEQ ID NO: 10896 - protein, 61 aa, Artificial Sequence
  Synthetic sequence.
SEAEEIIRRLEELLKKLKKDSDRLDEEIKRLLDENRRNSKDINRRLKKLLDDLRRLVRERG

SEQ ID NO: 10897 - protein, 59 aa, Artificial Sequence
  Synthetic sequence.
EDVLRRVEEALRRAEEDLKRLKEKNDRSLKEWRDTIRELKRENEESLRRVKEEADRLSK

SEQ ID NO: 10898 - protein, 61 aa, Artificial Sequence
  Synthetic sequence.
SDVERIIEELERLLEDLERRSKRIDEELKRAADRNRRNVEEIIRRLEDLLRRLEELVRRDG

SEQ ID NO: 10899 - protein, 59 aa, Artificial Sequence
  Synthetic sequence.
KDVLREVRRVAEKVRRSIKELKERNEKSLRDWKREVDKLLKDIKKVLDEVRKAADDLRK

SEQ ID NO: 10900 - protein, 61 aa, Artificial Sequence
  Synthetic sequence.
REVDEIRRRLEKEVERNRRNSKRIDDELKEMADRNRENVKRSIEEIKELLKRLKELVDRDG

SEQ ID NO: 10901 - protein, 59 aa, Artificial Sequence
  Synthetic sequence.
EDVRREVERVLKEWEDDVRRLLRKNEDSLREWREKLKKLVREHREVTKKAEEVLRELLR

SEQ ID NO: 10902 - protein, 61 aa, Artificial Sequence
  Synthetic sequence.
KDAEDIIRKLDELLDELAKAAREIIERLRDAARENEENSREINRRLEELLKRLEDAVRRDG

SEQ ID NO: 10903 - protein, 59 aa, Artificial Sequence
  Synthetic sequence.
EDVKRKVEEVARRVRKAIDDLLRDIKRVLDDWKRKVDKLLEDNRKSLEDVKREAERLRK

SEQ ID NO: 10904 - protein, 60 aa, Artificial Sequence
  Synthetic sequence.
SEVERLIKELEDVSRDIKREVTELKRDLKRLAEESKRLVEELEETIRKIVKDIEDTKRRG

SEQ ID NO: 10905 - protein, 59 aa, Artificial Sequence
  Synthetic sequence.
KELVDRVEEALRDHERTLRKVVKEVDKALKDLERDNTELVKRVKKVLDELRRDVEEKAK

SEQ ID NO: 10906 - protein, 60 aa, Artificial Sequence
  Synthetic sequence.
DMERKLDTVLEEVRRVVTRAKEANDRVLKDAKRVVEELSDRNRRVLEDAKRVVDELKEKR

SEQ ID NO: 10907 - protein, 59 aa, Artificial Sequence
  Synthetic sequence.
DEVVDKLLKKLKETLRRMEKESEELLRETEKILRELEKEVEDHLRTVEKTLEDLRREVE

SEQ ID NO: 10908 - protein, 57 aa, Artificial Sequence
  Synthetic sequence.
SEVDKILEDSKRKLEEVEEMVRRLLKKSRDLLEKLERDVERLIRDSERRLEEVARAK

SEQ ID NO: 10909 - protein, 59 aa, Artificial Sequence
  Synthetic sequence.
KDLRRKLKEVHDRSRRVIEKLREELEKVHDEARKVVEKITEKIERAHDKSRRLLEEIKR

SEQ ID NO: 10910 - protein, 56 aa, Artificial Sequence
  Synthetic sequence.
SEVDEFVKRSEDLLKKLEEDVRRIVRESERLLEEVERRVRKILRDLEKKLEDAERE

SEQ ID NO: 10911 - protein, 59 aa, Artificial Sequence
  Synthetic sequence.
KELRDKLEEAHRKVKEKVERLMEDLKRAHDESEKKIRDLKRKLREVLERLRKRVEEIKK

SEQ ID NO: 10912 - protein, 60 aa, Artificial Sequence
  Synthetic sequence.
DLEKRLEEAIRENRDTIRRLAKELERVIEDNKRRLEELKKEIKKVIEELERELRRVRKDG

SEQ ID NO: 10913 - protein, 59 aa, Artificial Sequence
  Synthetic sequence.
REIVDELVRRLKKHSDEARKTVEDLRRKSKKSLREAEETVKRLVEEIERLLEEIKETMR

SEQ ID NO: 10914 - protein, 60 aa, Artificial Sequence
  Synthetic sequence.
SEVDELVKKIEDSERRIEEKVKRIEDELKESEERIRTKVRELHKENEKLLEEIRRKKKDS

SEQ ID NO: 10915 - protein, 59 aa, Artificial Sequence
  Synthetic sequence.
DELRKTLKDALKRHEEVLKRVEERIRRVLKRHEEVLREAEERIRRSLEKLKRDADRVAK

SEQ ID NO: 10916 - protein, 59 aa, Artificial Sequence
  Synthetic sequence.
DEVEELVKELRDSLKRIREVAKELHDRNKELLDRIKRLVDELLKEIEKVLKEIEETKKD

SEQ ID NO: 10917 - protein, 59 aa, Artificial Sequence
  Synthetic sequence.
EEVRRKLEEAVREHERELERMAREIRKSLEDLKRVLEEVAERIKEVLRRLEKRVKEVED

SEQ ID NO: 10918 - protein, 60 aa, Artificial Sequence
  Synthetic sequence.
DEVEELVERLRRSLEKIRDRVRRLLERIKRLAEKIKRDIERLHKKNEDLAREMRKSERKS

SEQ ID NO: 10919 - protein, 59 aa, Artificial Sequence
  Synthetic sequence.
EELRKKLRKVVEDHKRVLEEVKDRLTKVLRELEEVLEKVKRDIKKSLEDLEKVLRELEK

SEQ ID NO: 10920 - protein, 59 aa, Artificial Sequence
  Synthetic sequence.
SDVERLLTKLKEVAKDLARIVKRLDEENEKLSEKAEREIRKLDRDNERLLEELEERKRR

SEQ ID NO: 10921 - protein, 59 aa, Artificial Sequence
  Synthetic sequence.
DRLRKKLKEVLDDLRRVLEELKDHIRRSLDKNRRSLEELEEHIRRSLTELRRRLEELAK

SEQ ID NO: 10922 - protein, 60 aa, Artificial Sequence
  Synthetic sequence.
DEVRELLERIEDEIRRIREEIKKLDEDNKKLAEDIRRKIEELDKENKELLKRIEDKKRES

SEQ ID NO: 10923 - protein, 59 aa, Artificial Sequence
  Synthetic sequence.
DEVRDRLRTILKKLREMLKEVKDRIDDSLRRLREVLDEVAKHIERSLKELKDRVREVEK

SEQ ID NO: 10924 - protein, 60 aa, Artificial Sequence
  Synthetic sequence.
SDKEEIKKVVDDVRRDIRRLEKELRDLNERFRKRVEELKKRLEEVNDRARREVERLKSRI

SEQ ID NO: 10925 - protein, 56 aa, Artificial Sequence
  Synthetic sequence.
VDTLKRRLEDVLRKAREEVEKWKEDLERLLREAERRVREYEEDTRRLLKELEDETR

SEQ ID NO: 10926 - protein, 56 aa, Artificial Sequence
  Synthetic sequence.
NVEDEVRRVVTELEKTLREVLKRSKEALDRLRETLERLLKELEDVHREANEDLTRL

SEQ ID NO: 10927 - protein, 59 aa, Artificial Sequence
  Synthetic sequence.
ESVVKRLVRELERLLREVEKHLEDSKRELEDLLRRLRERLEELKKRHEDLLREAREETR

SEQ ID NO: 10928 - protein, 57 aa, Artificial Sequence
  Synthetic sequence.
SLEETIEEVVRRNKETLDRARKKSEDVLRELERVLRELKRRTDEVARKLKEELDKLD

SEQ ID NO: 10929 - protein, 59 aa, Artificial Sequence
  Synthetic sequence.
EDVVRRLLEELERLSRDLERHVKRSEEEARDLLRKAREHVERSVKEIEDLLEDLKREAT

SEQ ID NO: 10930 - protein, 57 aa, Artificial Sequence
  Synthetic sequence.
SLEETVRKAVRRNRETLRRLKRESEEAVKEAKEVLDRLREETERVLRKLEKRLRELR

SEQ ID NO: 10931 - protein, 59 aa, Artificial Sequence
  Synthetic sequence.
KSMVDELLRTLEKLSDEIRRHVEKSKEDLERLLRELKKHVKRSVEEIEKLLEKLDKEAN

SEQ ID NO: 10932 - protein, 61 aa, Artificial Sequence
  Synthetic sequence.
SEVDEILKRIKEVLKRNKENVERIKKRIKEELDRNRKNVERILRTIEKLLKELEDIARREG

SEQ ID NO: 10933 - protein, 59 aa, Artificial Sequence
  Synthetic sequence.
EELRKKVKEVMDRWRETLDRLREEVERVLEDWRRKLEELRRRVEKVLRDAERVIKKVEE

SEQ ID NO: 10934 - protein, 57 aa, Artificial Sequence
  Synthetic sequence.
SEREEIERVLDENRRSLEELEREVEDALRTWEEELKKVEEAVRKVLEDVRRELEKDL

SEQ ID NO: 10935 - protein, 56 aa, Artificial Sequence
  Synthetic sequence.
VEKIKTEVDDLSRKLRETVERLKTELKKVIDRNRKTLEDLERRARKLIKEARDAAK

SEQ ID NO: 10936 - protein, 57 aa, Artificial Sequence
  Synthetic sequence.
REREKIEDLLRRNEKSLRDVARAVERILEEWRKVVEDLTERNKELLKEVEKVVRELL

SEQ ID NO: 10937 - protein, 56 aa, Artificial Sequence
  Synthetic sequence.
VDEIAKELKRLSDKLREMLKRLTDKAKRLIERNEKTSRDNERELRKLIKEAEDAAT

SEQ ID NO: 10938 - protein, 60 aa, Artificial Sequence
  Synthetic sequence.
SKEERLERLIEENKKSLDELSKRVEEVIKENKDVLKRLKEKIERLIEKNRRELERLKKDV

SEQ ID NO: 10939 - protein, 55 aa, Artificial Sequence
  Synthetic sequence.
EELERELRDHSRRLKEIVERIERKVREHIRELEKIVKEVEREVEEHIEKLERTVR

SEQ ID NO: 10940 - protein, 59 aa, Artificial Sequence
  Synthetic sequence.
SDEDRLRELLKKNRESLKRLSDEIRRLIEENRDALRRVKETIKELLRKLKEVVERVRKD

SEQ ID NO: 10941 - protein, 55 aa, Artificial Sequence
  Synthetic sequence.
EEVRKTLEEHSRDLRRKVEELAREVKRHIRELEKILKEVKDEIEEVIRRIEETAR

SEQ ID NO: 10942 - protein, 59 aa, Artificial Sequence
  Synthetic sequence.
SEIEDAAEKVRRNSEEAKRILDEHRERVKRVLEEIERLVKRAEERIEELIRTIERLRKD

SEQ ID NO: 10943 - protein, 59 aa, Artificial Sequence
  Synthetic sequence.
EEVRKKLEDILRKNEETSREIKKRLDRIDDDLRRVLEKAAKRLRDLLEKLREAVRRVET

SEQ ID NO: 10944 - protein, 59 aa, Artificial Sequence
  Synthetic sequence.
SEIEKVKKEVEENSREAKRIVDEHKRLVEENSKEMEKLLKEAEDTIRKLLKEIKELKDR

SEQ ID NO: 10945 - protein, 59 aa, Artificial Sequence
  Synthetic sequence.
ERMREKLRRALEENRRTSERLKRKLDDIDRDNERTSREVKEKLKRILEELKRTLEEVER

SEQ ID NO: 10946 - protein, 59 aa, Artificial Sequence
  Synthetic sequence.
SEIDKARDEVRKNSDEMRKIIERHREKVEDNSRRMKETVRRVEEEIERIIREIEELKKR

SEQ ID NO: 10947 - protein, 59 aa, Artificial Sequence
  Synthetic sequence.
RRLREELRRIAEENKKTSDDLKKRLDRIDKENERTSEELKEENDRLLEKLRRAADRVKR

SEQ ID NO: 10948 - protein, 59 aa, Artificial Sequence
  Synthetic sequence.
REIEEFEKDVRRNSEDMERIAREHEKLVRDLLRELKRLVDDLKRRLEELAEEIKSLREQ

SEQ ID NO: 10949 - protein, 59 aa, Artificial Sequence
  Synthetic sequence.
ERLRERLKRILDKNKETSDRIKKRLEDLNRELERVARELKKTIDELLRELEEVVERVRK

SEQ ID NO: 10950 - protein, 60 aa, Artificial Sequence
  Synthetic sequence.
SLEEEVKKLLEELKKVADKLTKEVREADKKLEEVLRRVKRRLDEVDRRLEEEIKKVKSRI

SEQ ID NO: 10951 - protein, 59 aa, Artificial Sequence
  Synthetic sequence.
EELLERLKRRIDRLIEEARRLVEKWRDELKKLIDEVRKLVEDHERKVRDIEKKVRDESR

SEQ ID NO: 10952 - protein, 59 aa, Artificial Sequence
  Synthetic sequence.
DAEEKARRVLEELDEALKRLAKKIKESIDKLKDVLRKLAEIIKRSLDELDEVLKRLASK

SEQ ID NO: 10953 - protein, 55 aa, Artificial Sequence
  Synthetic sequence.
EEILEELRRALEELKREVDELDRRNEEALERLKERVKRLNEDNRRTLERLEREVD

SEQ ID NO: 10954 - protein, 60 aa, Artificial Sequence
  Synthetic sequence.
DVEELLRRLLEELRRVVKEVEDINRRSLEEARRVLKRLEDDHRRVLKELEDVLERLRRQG

SEQ ID NO: 10955 - protein, 59 aa, Artificial Sequence
  Synthetic sequence.
RETIEELLRKVDRDLKRIRTTSEDLVRKNEELLEKLERESRRVVEESRKRLKEAEERTR

SEQ ID NO: 10956 - protein, 59 aa, Artificial Sequence
  Synthetic sequence.
SVEEKLKDLEKENKDSLDEIRKLNEDSLEEAKRVLKKLEDTHRTVLRKLEKVLDELRKR

SEQ ID NO: 10957 - protein, 59 aa, Artificial Sequence
  Synthetic sequence.
DDAIRKLRKKVEDTSRDLKRTSDDLVRRNRKLLKELEEESRKVVKESDEILRKMKEEVR

SEQ ID NO: 10958 - protein, 60 aa, Artificial Sequence
  Synthetic sequence.
SVEEKLDELEKRIKEVLERIERINEESLRRAEEVLRDLEETNRRALERVRDVLRRLEERG

SEQ ID NO: 10959 - protein, 59 aa, Artificial Sequence
  Synthetic sequence.
DDAIRKLLETVDRRLKELTETSKRLVEENRDLLRRAKEESKRLVDESEKVLEEMDRETR

SEQ ID NO: 10960 - protein, 59 aa, Artificial Sequence
  Synthetic sequence.
SADETLEELEKELRRVVDEVRRTNEEANKRLREVLRKLEKKNDDVLRDLERVLKELEDR

SEQ ID NO: 10961 - protein, 59 aa, Artificial Sequence
  Synthetic sequence.
EETIKKLREDVKRELDRIKTSSKKLVDDIERRLRRMEEESRKLAEDSRRILEEMRKEVT

SEQ ID NO: 10962 - protein, 56 aa, Artificial Sequence
  Synthetic sequence.
SEVEKLVDEIKKELKRLRETSKKLLDEIRELLERLKRSSKKLVDDIKRILEELKRR

SEQ ID NO: 10963 - protein, 56 aa, Artificial Sequence
  Synthetic sequence.
KDKLEKALRDARKVVEDIERTNREILKRVRDMVERIREDNDTVLEEVERMAEEVRK

SEQ ID NO: 10964 - protein, 61 aa, Artificial Sequence
  Synthetic sequence.
REIEELKKKVEKVLRELRKSSEEMKRRVEDLIRRLKKSSKDLERKVKDLLKKAEEKVRRDG

SEQ ID NO: 10965 - protein, 59 aa, Artificial Sequence
  Synthetic sequence.
EEARRRLEEVVRRLRKVLDDVRKINKEVVDRLKKALDEVKRTNEDVVRDLRKVLEELKT

SEQ ID NO: 10966 - protein, 59 aa, Artificial Sequence
  Synthetic sequence.
SEIEKLKEEIRRLLEEIKRHAEENKRRVETALRDIERHVEENTRRVAKVEEEIKKLKDR

SEQ ID NO: 10967 - protein, 56 aa, Artificial Sequence
  Synthetic sequence.
KDELDKVEEEAKRVAEEVKEIHDRVLEEVRRVVDRVLKAHDEVLRRLERVVREVKR

SEQ ID NO: 10968 - protein, 60 aa, Artificial Sequence
  Synthetic sequence.
EEEKRLRELEKRNEDVIRKAAEDVREILRKNEEVLKEAEDRIKRLIDEDRRVLEEVKRDD

SEQ ID NO: 10969 - protein, 55 aa, Artificial Sequence
  Synthetic sequence.
EELEREVRKHDKEVKEVIDRLREKSERHIREIERIVDELRKKHEATVRKLKKDVK

SEQ ID NO: 10970 - protein, 60 aa, Artificial Sequence
  Synthetic sequence.
DEDETLRELEKKNDKALDDARRTIEEVIRRNEEVLKRAAEEIEKLERKNKRVLEEVKRRD

SEQ ID NO: 10971 - protein, 55 aa, Artificial Sequence
  Synthetic sequence.
EELAEEVKRHDDRVRKEIEKLKREVEKHDREVKETIDRLAKKVDDHLKELRDTTR

SEQ ID NO: 10972 - protein, 59 aa, Artificial Sequence
  Synthetic sequence.
DEIKEIEETVERLVEELKRIVEEWREESKRNVDELEKRIRDIKRRIDEAIKTLEELKRR

SEQ ID NO: 10973 - protein, 60 aa, Artificial Sequence
  Synthetic sequence.
VEELRRALDELLEKARKVVEEVEKMIKEVNDRNKKVVDELKRTLDKILKDLEEVAREVDR

SEQ ID NO: 10974 - protein, 59 aa, Artificial Sequence
  Synthetic sequence.
SEIEKMKRDSDENIKRMEEIARKWEKESRDNIREIEKRVEDLKRRIEKVIREIEKLRRD

SEQ ID NO: 10975 - protein, 60 aa, Artificial Sequence
  Synthetic sequence.
LEEAKRKLEEVLDKNRRVVEKVERRIDRINDRNREVLERAEKELDDILRKLEEVVRRAEK

SEQ ID NO: 10976 - protein, 61 aa, Artificial Sequence
  Synthetic sequence.
DEIREAKKRLDDIVTELRDHIRRSKERHERLVKELERHIRELEKKVRELIKRLDDAVRRDG

SEQ ID NO: 10977 - protein, 59 aa, Artificial Sequence
  Synthetic sequence.
EEVKREITRLLEDLKRVSREHREEIRKLLETTREVSKRHREKVEDLLRKLEEVLERVRT

SEQ ID NO: 10978 - protein, 56 aa, Artificial Sequence
  Synthetic sequence.
SELEEIARLAEEIERKLRESLRESDKMHKKLNKENEDLLEKIRKEVEDIIKKLRDL

SEQ ID NO: 10979 - protein, 59 aa, Artificial Sequence
  Synthetic sequence.
ERVEEAVRRVVEKIKDVVEKHSDASRRLNEELKESVDRLRREVEKLVEKIRKVVEDLRK

SEQ ID NO: 10980 - protein, 60 aa, Artificial Sequence
  Synthetic sequence.
SDLERVEKESRDHIDTLRRIVERVEEHVRRSIKTLDELVDRARRSVERLIEELEEMKRKD

SEQ ID NO: 10981 - protein, 59 aa, Artificial Sequence
  Synthetic sequence.
RRVEEELRRLLEENRRVVEEVEKELDRLLKESEDAVRRVEEALDRLLKELERVAKEVKD

SEQ ID NO: 10982 - protein, 60 aa, Artificial Sequence
  Synthetic sequence.
SDLEKVKKDSDDHIRELERLVRRAEEHVRDSVRRLREIVEELDRDVRRLIEELKDLKRKI

SEQ ID NO: 10983 - protein, 59 aa, Artificial Sequence
  Synthetic sequence.
EDVKKKLDDLLRENREAVKRVERALDKLLTDDRRVVEEVERALDELLKRIEKVAREVEK

SEQ ID NO: 10984 - protein, 60 aa, Artificial Sequence
  Synthetic sequence.
RDVDELRKESEDHIRELRKLVEDVRRHVKRTNDDLERLVKEVDDTLKELIKEVKELKRRV

SEQ ID NO: 10985 - protein, 59 aa, Artificial Sequence
  Synthetic sequence.
EDVKKKIKDLLDTNREVVERVLRTLRDLLRRNKEVIDRILETLDELLERVKREIEKDAK

SEQ ID NO: 10986 - protein, 60 aa, Artificial Sequence
  Synthetic sequence.
DDAERAKEESERHIKRLKDLVEELRKHSERTDEEIKELLRRLEKTVRDLIRELERLKEEI

SEQ ID NO: 10987 - protein, 59 aa, Artificial Sequence
  Synthetic sequence.
EDVKRKLDKLLKENEDVVREVDRALKELLRKNAEMLERAKERLDRLLEEVKKVADEVRR

SEQ ID NO: 10988 - protein, 60 aa, Artificial Sequence
  Synthetic sequence.
SIEEELERLLRKNEDSLRRVRDEIRRLEEEIRRVLKKWRDEARKLLREIERVLKEVAERK

SEQ ID NO: 10989 - protein, 59 aa, Artificial Sequence
  Synthetic sequence.
ETLLRDLERKSKEVDERLEELLRRAKERVEELIREIEALLDRNRRNVERLIRELERRTD

SEQ ID NO: 10990 - protein, 61 aa, Artificial Sequence
  Synthetic sequence.
EELERLLEDVKRTLKELRDRAKEVLDRVRKTLEELKRELKRVLDEVTELLERLRRIVKREG

SEQ ID NO: 10991 - protein, 56 aa, Artificial Sequence
  Synthetic sequence.
KRIIKEARERVETVNRETKKILEEIARTVEKVDEESRRILEKVKRDAERVLREIKK

SEQ ID NO: 10992 - protein, 60 aa, Artificial Sequence
  Synthetic sequence.
DELEEVEKEVKRILEESRRLLEELEREVRELLERSKRILEELEEEVRRLLEKLKRVRTRG

SEQ ID NO: 10993 - protein, 55 aa, Artificial Sequence
  Synthetic sequence.
EELERLKRELDKVHEEVREKVERAKRELERVHKRSEEEARRLKEEVDKVLDELRK

SEQ ID NO: 10994 - protein, 59 aa, Artificial Sequence
  Synthetic sequence.
SELDELRKRVEEIVEENDRVLRELEKRVRELSERNKKTLKELTKRVREILERLKELKDR

SEQ ID NO: 10995 - protein, 59 aa, Artificial Sequence
  Synthetic sequence.
EEVKEVVRRLEEKVKESLDRAEKVLRRLEREARESNRRHEEEVRRLKEEIDRVVTELRR

SEQ ID NO: 10996 - protein, 58 aa, Artificial Sequence
  Synthetic sequence.
SLEDVLREVEERIRKSLEEHRKVTDEAEKELRRIVEDHKRVLEEVKKEIEDVIKELKK

SEQ ID NO: 10997 - protein, 60 aa, Artificial Sequence
  Synthetic sequence.
KEKVAREIRETVKKLHEDNRRMSEEIKKTVERLLDKLRRSLERIRREAKDLVRKIEDLRR

SEQ ID NO: 10998 - protein, 58 aa, Artificial Sequence
  Synthetic sequence.
KLEEVLRKVAEDIKRSLEDLKRVLKEVADHIRRSLEELRRVLERVKKEIEDVLRELEN

SEQ ID NO: 10999 - protein, 60 aa, Artificial Sequence
  Synthetic sequence.
ADKVAEDIRRDVRRLDEENRELAERIKRAIEELDRKNKDLARRIEDAVRRLLEKIKEAVR

SEQ ID NO: 11000 - protein, 58 aa, Artificial Sequence
  Synthetic sequence.
DLEEVLKEVEKRIRDSLKDLKRVLDEVLDHIRRSLKENRDSLRKLEEDLRRVLEELRR

SEQ ID NO: 11001 - protein, 60 aa, Artificial Sequence
  Synthetic sequence.
EKKVAEKIRKEVKELDEKNKELARRIRDVAKKLDERNKDVSRRLAEEVERLLRKIKEKVR

SEQ ID NO: 11002 - protein, 58 aa, Artificial Sequence
  Synthetic sequence.
DLERVLEKVARDIEESLRRNKESLKRLKEHVEESLKENRKSLEDLRKKLKDVLDELKK

SEQ ID NO: 11003 - protein, 60 aa, Artificial Sequence
  Synthetic sequence.
KKKVADKIREEAKRLDKENREASDRARDVVRRLDEKNKKLSEEMKRTVERLLETLDRKMR

SEQ ID NO: 11004 - protein, 58 aa, Artificial Sequence
  Synthetic sequence.
DLERFLEEVARKIEKSLEELRRVLEEVRDRIRRSLEENTKSLERLTEEVRRVLERLKD

SEQ ID NO: 11005 - protein, 60 aa, Artificial Sequence
  Synthetic sequence.
EDKVAKEIEDEVRRLDEKNRKLAKEIRDEIRKLDKENKDLSKELRDRVEELLRKIEETVR

SEQ ID NO: 11006 - protein, 59 aa, Artificial Sequence
  Synthetic sequence.
KAAEEIRKKVEDYKRESEKILEEVEDHSRRSKETLKRLLDDLRRAVEELKRRLEELKRR

SEQ ID NO: 11007 - protein, 56 aa, Artificial Sequence
  Synthetic sequence.
REVADELKKRLKRANEESERVLRELAERNKTALEEAERVLRRLKEEIEKVLRKLKK

SEQ ID NO: 11008 - protein, 59 aa, Artificial Sequence
  Synthetic sequence.
SEVEDLRRRVEEIKRRVEEILRENKEVSEKSIRELERLLEELKRLVDELLKRLEELKRE

SEQ ID NO: 11009 - protein, 59 aa, Artificial Sequence
  Synthetic sequence.
DDLRRALKDVVDEVKKVVDELREENDRLRKENKRAVDEVRKELERLLRDVERVIRRAEK

SEQ ID NO: 11010 - protein, 59 aa, Artificial Sequence
  Synthetic sequence.
EELDRLRRHADESRKRAEEILKRNEEEIRRLVEELKRILKTNEDVLRDLEKKLEDLKRR

SEQ ID NO: 11011 - protein, 59 aa, Artificial Sequence
  Synthetic sequence.
DKLRTTIDEVRRRSKKVLDDLRDRNRRLLEEVDRAIKEVRETNEELLRRLKRVIDEVRR

SEQ ID NO: 11012 - protein, 59 aa, Artificial Sequence
  Synthetic sequence.
SAEELLRTIEKRIEDNHRRLEEILEEIARLIEDMLRTDERIVREIKELLKEVLDRVRRA

SEQ ID NO: 11013 - protein, 59 aa, Artificial Sequence
  Synthetic sequence.
EEVVKKLVEDVERELERSLREAEDLLRRVEEVIRTSKKESKDVLEKIERLLRDLERRTR

SEQ ID NO: 11014 - protein, 59 aa, Artificial Sequence
  Synthetic sequence.
SVAEELKKEVDDLLRDLKKKLDDVRRDHERLLRELEEHLERSRERVERLLRTLEDVARK

SEQ ID NO: 11015 - protein, 56 aa, Artificial Sequence
  Synthetic sequence.
RKVIEKIERDIRKILKEVEEVLRTLKKKSDEILERAKRVTEKIERDVTEILERIKK

SEQ ID NO: 11016 - protein, 59 aa, Artificial Sequence
  Synthetic sequence.
SVADELRKTAEELLKRLREHLDTSRRRVEDLLRRNEKKLRDVLREVKKLLDELRELKER

SEQ ID NO: 11017 - protein, 56 aa, Artificial Sequence
  Synthetic sequence.
EDVIREIKDRVRRILDEARRVSEKLRRDVEKINRESREVLERIKELIKRILKEAKD

SEQ ID NO: 11018 - protein, 57 aa, Artificial Sequence
  Synthetic sequence.
SELEELLREVDDSLKKLETEAKKLLDEVRDSLRKLEETLRRVLREVEEELKELEKEN

SEQ ID NO: 11019 - protein, 59 aa, Artificial Sequence
  Synthetic sequence.
KRVEDVLREIRRRAREINERLKKILKEAKEVAEKVNEETRRVLKEIKELIERVLRELRK

SEQ ID NO: 11020 - protein, 60 aa, Artificial Sequence
  Synthetic sequence.
REAEEAKEEVEELNRRNKKELDDARRRVDELDKRNKDRLKESSDRVKRLVEELERVKEEG

SEQ ID NO: 11021 - protein, 56 aa, Artificial Sequence
  Synthetic sequence.
KDVLKRLAELIKESIRELERVLEELAEKIDRSLKELDDVLRKNETDLKRVIEDLKR

SEQ ID NO: 11022 - protein, 60 aa, Artificial Sequence
  Synthetic sequence.
DEAEKAKRDSEKVVEDNRKMLEDSTRRAERLNEENKKELKKSTEEAEKILREIDETKRRG

SEQ ID NO: 11023 - protein, 56 aa, Artificial Sequence
  Synthetic sequence.
DEVLKRLKEEHRRLIEELEEVLRRNEEIIRRSIEDLERVLDRNRRELEDVIRRLKE

SEQ ID NO: 11024 - protein, 60 aa, Artificial Sequence
  Synthetic sequence.
REAEEVERKVEELNRRNRKVLDDARKESEEVVRRNREFLRRLEERVRTILRELDKRKRDG

SEQ ID NO: 11025 - protein, 56 aa, Artificial Sequence
  Synthetic sequence.
DEVLRRLAEDIERSIRELEKVLRELERIHRELIKELKEVLKRLEKDAKEVIERLRT

SEQ ID NO: 11026 - protein, 61 aa, Artificial Sequence
  Synthetic sequence.
SLAEEIDKTIRELAKRHEKTVEDIKKIITELEKKHRDTAEELERIVREIEKKIRELKKRLK

SEQ ID NO: 11027 - protein, 59 aa, Artificial Sequence
  Synthetic sequence.
EELERVLREAEETLRRLIEKDEKVNREADEKSERLIREDEKVLEDVAREVERLLRELDK

SEQ ID NO: 11028 - protein, 61 aa, Artificial Sequence
  Synthetic sequence.
DEDREARELVERLREEHRRTAEEIKKIIEDLERKHRETMERLKRIIEKIERDIRRLKRDLK

SEQ ID NO: 11029 - protein, 59 aa, Artificial Sequence
  Synthetic sequence.
KELERVLEKVARDLKKLVDDDRRVNETANRRSRKLIEDDKRVLEEAAKEVKRLLDELDK

SEQ ID NO: 11030 - protein, 56 aa, Artificial Sequence
  Synthetic sequence.
DTERTVKEKIRKWKEDVERVERRLEELVDRARKLSKENVDRMRELVRRLEDRVRKD

SEQ ID NO: 11031 - protein, 56 aa, Artificial Sequence
  Synthetic sequence.
REVLEDARRKIDELNERVERVAETVRRKLDKILEDNKRVVERVKEEIRRVLEELER

SEQ ID NO: 11032 - protein, 59 aa, Artificial Sequence
  Synthetic sequence.
SEEEVLREAAKTVEKLLDEIRRSLEKVSKRVEDSNRELKESLDRVRERVRELLEELRKN

SEQ ID NO: 11033 - protein, 56 aa, Artificial Sequence
  Synthetic sequence.
KDDVERTLREIAKLVDEVDKENKRALRENEERVKTLNRENEEMLKRIEEEVRRATK

SEQ ID NO: 11034 - protein, 59 aa, Artificial Sequence
  Synthetic sequence.
DLEEVAKEVKKALDELLKRNEDSARRVKEAIRELLKRINDVTREVEETLDRLLKEVEDG

SEQ ID NO: 11035 - protein, 60 aa, Artificial Sequence
  Synthetic sequence.
AERVVKRLEELLREAAEHSKRSNDELERLLDRLRREVERYERELEKRKKEAKELADKLRK

SEQ ID NO: 11036 - protein, 59 aa, Artificial Sequence
  Synthetic sequence.
DLERRLDELLKRIEDRVRELVRTLEESLRELERRVREIIRRLEEHLRRIEKMVRDLKRA

SEQ ID NO: 11037 - protein, 56 aa, Artificial Sequence
  Synthetic sequence.
ERVIKKAEEDVRRLLREIEEVSERHKREVDRLEREIEEVSREHKERVEKLLREIER

SEQ ID NO: 11038 - protein, 59 aa, Artificial Sequence
  Synthetic sequence.
KLEEDLKRILDELRRMAKEIIDRLEDHLRKIKKDVDKLSKENKDHLKEIEDTVRELKRN

SEQ ID NO: 11039 - protein, 56 aa, Artificial Sequence
  Synthetic sequence.
ERVIKRVDEEVKKLAEEIRKVSEEHEKRVKKLLKEIEKSSEDHRRRVEELLREIDR

SEQ ID NO: 11040 - protein, 59 aa, Artificial Sequence
  Synthetic sequence.
SEEEEVEEELERHHRDVEEYVKRLKELLDKLRRKNETTVRDIARLAKKHHDDVDELKKR

SEQ ID NO: 11041 - protein, 55 aa, Artificial Sequence
  Synthetic sequence.
REVLKRFKDKVKENRDESERVHREIKERLEELKRKNEDVLRKVKKILDDNEERLR

SEQ ID NO: 11042 - protein, 57 aa, Artificial Sequence
  Synthetic sequence.
KDLEKLVEDIRRLLEELKKTVEDNKREIKELLDRLREKVKENLKRHKELNKRLRDTG

SEQ ID NO: 11043 - protein, 59 aa, Artificial Sequence
  Synthetic sequence.
KEVKDRIEEVLRELREAVRRHHEKVKEVLRELKEALDKHHKDVTDSLRDVERLVEEARR

SEQ ID NO: 11044 - protein, 58 aa, Artificial Sequence
  Synthetic sequence.
SEKEILDEIRDRIRKLLEEIKDYLEKSKKKIRDLLEKIKKVLEDNKERVDRLLDVIRK

SEQ ID NO: 11045 - protein, 55 aa, Artificial Sequence
  Synthetic sequence.
DDVRREAKRLLEEVAEAVRRIHETSKRLLERVDEEMKRVEETIRKTNKEVEDAKR

SEQ ID NO: 11046 - protein, 57 aa, Artificial Sequence
  Synthetic sequence.
SDVEKLIRDAEKKMDDFRKDSERLVRELEEKLKRHEERVRDLLRELKELLEEVRRKD

SEQ ID NO: 11047 - protein, 55 aa, Artificial Sequence
  Synthetic sequence.
EKIKEAVDRIKKALRDSHKELAEVVERIKRKLDETNRELKDEARKIKEELRRVEK

SEQ ID NO: 11048 - protein, 60 aa, Artificial Sequence
  Synthetic sequence.
SEVETVKKRLEDSTKESEDTVRKVKRELERLIERSEDTLRRIKKRLDDLIRTIEDLKRRG

SEQ ID NO: 11049 - protein, 59 aa, Artificial Sequence
  Synthetic sequence.
KELLDTLRRLLEENKRRHKETVDEIERLIKEVERANREILTRIKKALDDVRRAVEEIKR

SEQ ID NO: 11050 - protein, 60 aa, Artificial Sequence
  Synthetic sequence.
REVEEVLRKVREDSKRNKDELKRLLDEARKESEDNKRDLEKLLKEVREEVRRVEEILRKT

SEQ ID NO: 11051 - protein, 55 aa, Artificial Sequence
  Synthetic sequence.
EDVLREIETLLDKNHKDNKKVLDDIRELLKENADRNRRVLEEIKKLVEDVERKVK

SEQ ID NO: 11052 - protein, 58 aa, Artificial Sequence
  Synthetic sequence.
DEDEKALREIKKLIEDNERLNREVNERIERLIDRARRLMERVNREIERLIKEVRERLG

SEQ ID NO: 11053 - protein, 58 aa, Artificial Sequence
  Synthetic sequence.
EELEKTLRDIRKRSKEDADKVKKSLEEVEEEIRRIEKRLRESLKKVEDDIERIRREAT

SEQ ID NO: 11054 - protein, 56 aa, Artificial Sequence
  Synthetic sequence.
SEIEKLTKEIRDLIRTSREEIKKLMEELERNVREAEESIKRLLEKAEELIRRIAEE

SEQ ID NO: 11055 - protein, 56 aa, Artificial Sequence
  Synthetic sequence.
KEDVKRELERIKKSSDDVRKKVEDESRKHREEVERLERELDRKLEDIRRKVEETKT

SEQ ID NO: 11056 - protein, 61 aa, Artificial Sequence
  Synthetic sequence.
SEIEKLAEDVERIAKKIEDVVRELRKANEDIIKEVRDINKELRDKVEEILRRIEKIVRDRL

SEQ ID NO: 11057 - protein, 59 aa, Artificial Sequence
  Synthetic sequence.
KEILDRIRKKLRETLERVRDRLRKYLEDLERRLEELRREHRKTLEELKEKLKRLADRVK

SEQ ID NO: 11058 - protein, 57 aa, Artificial Sequence
  Synthetic sequence.
SEVEDLERRAREVNKRIKDLIDRLRERVRKIEEDIRRLNKELKEEVDKIIEEIRKDG

SEQ ID NO: 11059 - protein, 58 aa, Artificial Sequence
  Synthetic sequence.
KLIEELLREHEKMLKEIEDRIRKIERELDELLKTLEDKHREILDELEKELRKAKERRR

SEQ ID NO: 11060 - protein, 60 aa, Artificial Sequence
  Synthetic sequence.
SDIERILEENEKTNRENRKRIEDIRRELEERLDRNRRRIEEILRRAEKMLEEIEDIFRRS

SEQ ID NO: 11061 - protein, 59 aa, Artificial Sequence
  Synthetic sequence.
EDKLRDLKKKLRDSLRTLEELHRKLKKDLDEILRRLEELHRKLKEDLDRILKAVRDTAK

SEQ ID NO: 11062 - protein, 60 aa, Artificial Sequence
  Synthetic sequence.
SEIEDIKRRNEENNRRNKKRIDDILEELKRRVEENRRRLEDIERKLREDKERLKDIFRRS

SEQ ID NO: 11063 - protein, 59 aa, Artificial Sequence
  Synthetic sequence.
EDKLRKLEEDLRRSLETLREIHRKLKEELDRILEELKRLHERLKRRLDEIADEVARTAR

SEQ ID NO: 11064 - protein, 60 aa, Artificial Sequence
  Synthetic sequence.
SDIEEIERRNRENNERNKRRIEEIEKRNREENKENEKDIERILRRAEELLKRAKEILRES

SEQ ID NO: 11065 - protein, 59 aa, Artificial Sequence
  Synthetic sequence.
EKKLRELKKKLDDSLRTLEELHRELMKRLDESLKTLKELHDELKERLDRILKEIRDDAK

SEQ ID NO: 11066 - protein, 60 aa, Artificial Sequence
  Synthetic sequence.
SELEKTLEDLKRHSEENKKKLEEDLRDMERNLKENKDRLKKILEEAEKTLKDLERRFREG

SEQ ID NO: 11067 - protein, 59 aa, Artificial Sequence
  Synthetic sequence.
KDKAEELERRLDELVKENREIHERVKKALDDIVKELEELHERLKRRLEEILRRIAETVR

SEQ ID NO: 11068 - protein, 57 aa, Artificial Sequence
  Synthetic sequence.
SSVERFEKAVKESIENIRRLLEELEREIRESMKHLRELVKELKEALDRIVERLRRTV

SEQ ID NO: 11069 - protein, 55 aa, Artificial Sequence
  Synthetic sequence.
EEDLKRLDKENKDIEKKIRDLVKEARDENRKLKRDIERTLRELEERLKEVEDRET

SEQ ID NO: 11070 - protein, 57 aa, Artificial Sequence
  Synthetic sequence.
SDIEKRLEENERHNERSEERIRELLKELEDHLRRTKREIEKKLEDLKRLLDRLREED

SEQ ID NO: 11071 - protein, 58 aa, Artificial Sequence
  Synthetic sequence.
EELKRVKDELDKSLKHSRELIERAKERLEEIKKRSKELVDRAEKRLDEILKEVKDDFD

SEQ ID NO: 11072 - protein, 57 aa, Artificial Sequence
  Synthetic sequence.
DEIKEREDDVKRHLDRTREEIEKLLKEMEEHTERSRRKIKKVAEDAEERLRKVEEEN

SEQ ID NO: 11073 - protein, 58 aa, Artificial Sequence
  Synthetic sequence.
KELEEVKRKLDRILEESEKLVREAEKRLDELLKDNKRLVEELEKELDRILEELRKRVD

SEQ ID NO: 11074 - protein, 57 aa, Artificial Sequence
  Synthetic sequence.
DSIEDLERRAKESDDHLEKLIRELRDELRRSLETVRRNIEDLRRTLEEVLRRLEEDG

SEQ ID NO: 11075 - protein, 59 aa, Artificial Sequence
  Synthetic sequence.
EEMLREIKKELEETNKRAEDDVRKIREELREHNERHKERSKRIKEELKRTLDELKKKRK

SEQ ID NO: 11076 - protein, 60 aa, Artificial Sequence
  Synthetic sequence.
SRIETLVRRMKELLKEVEDKSEKSKRRWEDRLKKVAEDSKRRVEEMDRELDEVRRKRERG

SEQ ID NO: 11077 - protein, 59 aa, Artificial Sequence
  Synthetic sequence.
ERLLRELKRIVDEVKKELDRLDTEHNKAIEDVKRELRKLDEEVRRIVERVKRELDRLEK

SEQ ID NO: 11078 - protein, 60 aa, Artificial Sequence
  Synthetic sequence.
SEIEDLIRRIRETLKRVEEDSRRSKEEAKRKLDKVKEDSERLVEKMRRDLEKVKRETDKG

SEQ ID NO: 11079 - protein, 59 aa, Artificial Sequence
  Synthetic sequence.
EELLKRLKEVVEDVIRKLDRLDKEHTEIVEEVERRLDKLDKDVERIVEEVKKALDETEK

SEQ ID NO: 11080 - protein, 60 aa, Artificial Sequence
  Synthetic sequence.
SEIEKLIEDIRRRLKKLEDESRKSVKDARDMLRRVEERSRDSVRKMREELERVEDESRRG

SEQ ID NO: 11081 - protein, 59 aa, Artificial Sequence
  Synthetic sequence.
DELLKRLEDVVRDVKRKLDELDERHTRIVEDVKRRLDDLDREHRKIVEEVKKELDKLLK

SEQ ID NO: 11082 - protein, 60 aa, Artificial Sequence
  Synthetic sequence.
SEIEKLIEELRRELEKVKDELERSIEEMDRELDDVRRDSKRLVDEIKRELREVTERTKRG

SEQ ID NO: 11083 - protein, 59 aa, Artificial Sequence
  Synthetic sequence.
EELLKRLEEVAEDVKRALEELLKKHTRVVERVEKALDELDKELERIVREAEKELDRREK

SEQ ID NO: 11084 - protein, 60 aa, Artificial Sequence
  Synthetic sequence.
SEVEEEEKTAEKILEEVAEEIKESIKRIREEVKKNEDDSERSVREMERRLREVEERIRRG

SEQ ID NO: 11085 - protein, 59 aa, Artificial Sequence
  Synthetic sequence.
EELLRRLKRVVERVKERLDRLLEEHTRVVEEAKERHRELDERHEKIVRDVVRELDRRVK

SEQ ID NO: 11086 - protein, 60 aa, Artificial Sequence
  Synthetic sequence.
SEVEKVVKELEDELRRVAEDSERSIREMEKRLDDFRKRVRETAEKMKEDLRRVEERARRG

SEQ ID NO: 11087 - protein, 59 aa, Artificial Sequence
  Synthetic sequence.
ERILKRVEDIVRRVEEELDKLDEKHTRVVKKVSDALDRIVEELEKIVREVAKRLEDLRK

SEQ ID NO: 11088 - protein, 60 aa, Artificial Sequence
  Synthetic sequence.
SEVEKKIEEMRRTLDEARRRSEESKREIKKELDEARKRVEESLKRLRETLKKVEDERRRG

SEQ ID NO: 11089 - protein, 59 aa, Artificial Sequence
  Synthetic sequence.
ERLLRRVAKVVEDVKRELDRLDEDHTRAVEEVERALDDLLKKHEDVVREVKTELEKLLK

SEQ ID NO: 11090 - protein, 57 aa, Artificial Sequence
  Synthetic sequence.
SELEELIRDIERKLEKVKRDSERSMREIEEDLKRVRKKTEESERRIRDLLDKVRKRK

SEQ ID NO: 11091 - protein, 56 aa, Artificial Sequence
  Synthetic sequence.
TEDLRRVAKRVEEELDRSNEEHSKIVDKAKRDLDKSNKEHSKVVEDAERTLDRVED

SEQ ID NO: 11092 - protein, 57 aa, Artificial Sequence
  Synthetic sequence.
SELEELEERIERLLEKVRRESEKLLRELEKKLKDVERKIEDSIRKIRDDLRKVRERK

SEQ ID NO: 11093 - protein, 56 aa, Artificial Sequence
  Synthetic sequence.
TEDLRRVLDRVKKDLDRSNEEVRREADRIMKELDKLLKKHSDVVKEVLEALDDTDR

SEQ ID NO: 11094 - protein, 60 aa, Artificial Sequence
  Synthetic sequence.
SEIEEIKRRLEETNKRVREKNKRSVDRIKEHLERSRRRVEEIIRRIEKLLEELEEKARRT

SEQ ID NO: 11095 - protein, 59 aa, Artificial Sequence
  Synthetic sequence.
EKLLRDLEKALRDSIRTLKRSVEENDRINKEANEDSERLLRELKKVLEKAKKDVDELRR

SEQ ID NO: 11096 - protein, 60 aa, Artificial Sequence
  Synthetic sequence.
SLEEELRELARRLKEEVRKLEETLEKVLEDSARNIKRLIDDLKRVNDELRKRVDDLIREV

SEQ ID NO: 11097 - protein, 59 aa, Artificial Sequence
  Synthetic sequence.
KEALDRVRKKLEDALKKLRDEVREMKKKNDKTNKEVKDKADELRKKHEDTLEELKKRVK

SEQ ID NO: 11098 - protein, 57 aa, Artificial Sequence
  Synthetic sequence.
SEVDEIIKRIEDLLKEVRDESKRNEDRIREKLKRLKKKSEDNAEKIKDELKKIRDRK

SEQ ID NO: 11099 - protein, 59 aa, Artificial Sequence
  Synthetic sequence.
KEVLDTLRDAIRRVKEELDRNLEKNTELIKRVKETLDDLLRRNKELIRKAEETLDEERR

SEQ ID NO: 11100 - protein, 61 aa, Artificial Sequence
  Synthetic sequence.
DELEKIRKELEDLSRENKEKLERIARELKRLSEENTETLEKLKEEIRRLLEKLKRIVEKDG

SEQ ID NO: 11101 - protein, 59 aa, Artificial Sequence
  Synthetic sequence.
KEMLDRIKELLDTHRRILEDIKREIDKLLEDHRRRLEELLRDLKRALDRVREEVDRLRR

SEQ ID NO: 11102 - protein, 57 aa, Artificial Sequence
  Synthetic sequence.
DDVRRIEEEIRRTLRELRETLKRVERRNREENEDLKDKMRRMKKENEDTNERVKKEG

SEQ ID NO: 11103 - protein, 56 aa, Artificial Sequence
  Synthetic sequence.
KERLDKLLEDLAKEARKVIEDLKEILRRTKESIDEVEKTLREILKKSKETADRVET

SEQ ID NO: 11104 - protein, 57 aa, Artificial Sequence
  Synthetic sequence.
SDLERLKKRNDDANRKLKETLDRVEKENRDVNRKLEKELKEVEEKNRRENKKVRDRG

SEQ ID NO: 11105 - protein, 56 aa, Artificial Sequence
  Synthetic sequence.
KEELDKILTRSEEVARRIIEELKKILEETRKSAERVIRRLEEILKESEREVREVET

SEQ ID NO: 11106 - protein, 57 aa, Artificial Sequence
  Synthetic sequence.
SEVEETIKRVRDTLKKHNEESEKAIRELEEELKRLDDKNREAVEDVKRTLDELRRTK

SEQ ID NO: 11107 - protein, 59 aa, Artificial Sequence
  Synthetic sequence.
KDLRKRLEELLREVEEDLKRNIEKLDKALKEAKEVIERSIEHLRRVLEEVERVLRELAR

SEQ ID NO: 11108 - protein, 60 aa, Artificial Sequence
  Synthetic sequence.
RKEDEMRKLLDEIEKDLKRNDERVRRVLKRSKENLRRLEERAEKLLETVEREIKRLEEEG

SEQ ID NO: 11109 - protein, 59 aa, Artificial Sequence
  Synthetic sequence.
EREVKRTIDELKDELRKHNDKTEKLIRRARETDKELNDRVAKREEEARRELEEVDRRVR

SEQ ID NO: 11110 - protein, 60 aa, Artificial Sequence
  Synthetic sequence.
SLEEAVEKLLRDSEENLKKNEEDVRRLLKKSKENADRLRDEVRKLLETAEREIKRLEDEG

SEQ ID NO: 11111 - protein, 59 aa, Artificial Sequence
  Synthetic sequence.
ERLIRETEKDVKRRDEEHNTRTEREIREAKKEDEKLNKEVRDTEKRLRDELRRVEERVR

SEQ ID NO: 11112 - protein, 60 aa, Artificial Sequence
  Synthetic sequence.
SKEDKVRELLRRSKENLDRVREEVRKLLKKSRDTLEELRERAKRLLEEVEEVIKRLEEEG

SEQ ID NO: 11113 - protein, 59 aa, Artificial Sequence
  Synthetic sequence.
EKEIEETIRRVEDMDRRLNERLRKKIEDAERMDEALRERVERLIRRVRKELEDVERRVR

SEQ ID NO: 11114 - protein, 56 aa, Artificial Sequence
  Synthetic sequence.
SELEEVARRIEKMIRDLEKDLRELERKVRESDERLKRDLERNEKEHRDTIEAMRRR

SEQ ID NO: 11115 - protein, 59 aa, Artificial Sequence
  Synthetic sequence.
KDVRDALKKLLDELKKAVEDVRREIERLIREHKRVTEEVERADKELNDRTRKAADELRR

SEQ ID NO: 11116 - protein, 57 aa, Artificial Sequence
  Synthetic sequence.
EEVERLEEEVRRRKKEWEDRLEEVKRRNEKAKRESERENEKIAREVREVVKELRERG

SEQ ID NO: 11117 - protein, 56 aa, Artificial Sequence
  Synthetic sequence.
KRRLEELLRDHSRMIRRVEAELDKSLEDHKRALDENEKRIDEWLERLRKIVEEVEK

SEQ ID NO: 11118 - protein, 56 aa, Artificial Sequence
  Synthetic sequence.
SKIEEIERRVRELEETWRRKLEEVEKDSRRSVKKMEEDLERAARETEEIKRRLREE

SEQ ID NO: 11119 - protein, 56 aa, Artificial Sequence
  Synthetic sequence.
ERKLEELLRKHNEVIKRVKEELKRLDKEHTDIVEEVKKELDKLDEDLKRVADEKRK

SEQ ID NO: 11120 - protein, 57 aa, Artificial Sequence
  Synthetic sequence.
DEDEDLERLLRKLKRVLDEIRKRIRENIEENREVVERAAREVKKSIDENRKVVDDVQ

SEQ ID NO: 11121 - protein, 56 aa, Artificial Sequence
  Synthetic sequence.
GEEVRKKIEDLERELRRTLEEIHKENEKSKRKIEKALRDIREENKKHIREIEETKR

SEQ ID NO: 11122 - protein, 60 aa, Artificial Sequence
  Synthetic sequence.
SDIETLTRDVERSIKELEDHLKKHHEEVKERIRRLEEHADELRRRAEKLKEELKRMKDRG

SEQ ID NO: 11123 - protein, 58 aa, Artificial Sequence
  Synthetic sequence.
KVEEDVKRLVKKLDEVNERHRREIERNRKELEDVSRRHKEKVDRILEDIKEALDRVRK

SEQ ID NO: 11124 - protein, 57 aa, Artificial Sequence
  Synthetic sequence.
SESETVKKENEDHIRKLEDDLRKLEEDNKRHVDDIERRLRDLKRENERFAEEVKKRG

SEQ ID NO: 11125 - protein, 59 aa, Artificial Sequence
  Synthetic sequence.
EEVKKTLETLVRTNRRAIREVERRLKESLDHNREVLKRAEEDLRRSIRHLREVVREADR

SEQ ID NO: 11126 - protein, 60 aa, Artificial Sequence
  Synthetic sequence.
SIEDELRELKERLERVVEELRRLHEKTIEDLKRVVEKSEKTLRDIRRELERVVEEVRRRR

SEQ ID NO: 11127 - protein, 59 aa, Artificial Sequence
  Synthetic sequence.
KEVLDRLRKKVEDTIRKMKDEAKKLDDEHKKAVRRLEERNEETARRVRKAVEDIERETK

SEQ ID NO: 11128 - protein, 60 aa, Artificial Sequence
  Synthetic sequence.
SIEDILRKLTKDLEDVIRRSRKTSEDLKEELKRVLDKHKEKLDRILEDVERVVREVEERR

SEQ ID NO: 11129 - protein, 59 aa, Artificial Sequence
  Synthetic sequence.
KEILDRLEEEVRRLIEELDKENDEARKEHREVAKRNEEEIKKLEEEAKDSIRRLREESR

SEQ ID NO: 11130 - protein, 57 aa, Artificial Sequence
  Synthetic sequence.
RESEELDKRLKEIAKDIRDKLDEIRRENEKTAKEIEDTIREIERDNERIDREMERRG

SEQ ID NO: 11131 - protein, 59 aa, Artificial Sequence
  Synthetic sequence.
KRFKDVIRRLEEELKKLLKRAEEEIRDSKRHLRELLKKVEKVIRESKANLDRTLKKLRD

SEQ ID NO: 11132 - protein, 60 aa, Artificial Sequence
  Synthetic sequence.
SEEEDLRRKVEELEERVERYKEELKKEIERIETENKRHVEELERRLRKIAREVDDAKRRQ

SEQ ID NO: 11133 - protein, 59 aa, Artificial Sequence
  Synthetic sequence.
EDLDRLLDEMRREAERLLDELRKVTERIAREVKRSNEENKKVLDEIRKAIKDLLDKLRK

SEQ ID NO: 11134 - protein, 59 aa, Artificial Sequence
  Synthetic sequence.
STEEKVEEDLRRLEEKNRRHVREIEERLERMKEENRDHVRKLEEKLRRLDEEVRKVKEG

SEQ ID NO: 11135 - protein, 56 aa, Artificial Sequence
  Synthetic sequence.
RETLKRAERKLRESLRHNREVLERARRELKKSLDHNDKALEDAERRIREIREELEK

SEQ ID NO: 11136 - protein, 59 aa, Artificial Sequence
  Synthetic sequence.
DLKEVLDKLRELVREVTERIKRTIEEIERLLRKVEREMRETIRTDEELLKTVVDELRRK

SEQ ID NO: 11137 - protein, 59 aa, Artificial Sequence
  Synthetic sequence.
RRKIKKVLDDLRKIIEDIERESRESLERLREIIERLKRRSDKTLKDSKKVIDDIRRRTK

SEQ ID NO: 11138 - protein, 59 aa, Artificial Sequence
  Synthetic sequence.
DLEEVLEDLRRLMEEVKRRIERTIEEDKRLLDEVERRIRETIRRDRELLKEAERDLREK

SEQ ID NO: 11139 - protein, 59 aa, Artificial Sequence
  Synthetic sequence.
RDKIRKVRKELREIIDRIRRESERSLEESRRVIEKIDEKSKRTLEESRRVIEEIKEKAR

SEQ ID NO: 11140 - protein, 56 aa, Artificial Sequence
  Synthetic sequence.
SSEEMLRTVEELIKEARKRLDESLEEVRKRIEDAKRRHEESNDENRRLVEDAKRRV

SEQ ID NO: 11141 - protein, 55 aa, Artificial Sequence
  Synthetic sequence.
KDVLEELREIIDRLRRESEDSLRRLEKIIKDSEDRSRESSEELKEIIKRLLEEDK

SEQ ID NO: 11142 - protein, 56 aa, Artificial Sequence
  Synthetic sequence.
SKDEVLEEVERRIRTAERDLERMVRRNEELIRDAKREHERSNRENERLVTEAKREI

SEQ ID NO: 11143 - protein, 55 aa, Artificial Sequence
  Synthetic sequence.
KDVLDELRDIIRRLREELKKSSDDLERIIRRSVKESRDSSEELRKIIEDLKREAT

SEQ ID NO: 11144 - protein, 56 aa, Artificial Sequence
  Synthetic sequence.
SEKEVLDEVKELIERAKERLRRMLERNERLVRDAERKLKRLLDEDRESIERVKKRL

SEQ ID NO: 11145 - protein, 55 aa, Artificial Sequence
  Synthetic sequence.
ERVLEELKKEIRRLEEEVKKSSEELERIIEKLLEELKRSLEESEDIIRRLEEETR

SEQ ID NO: 11146 - protein, 56 aa, Artificial Sequence
  Synthetic sequence.
RKDELLRRVEEEIKKVKKRLKEMLDTDRKLIEDAERKLEEAERRDSDLIRRAKERV

SEQ ID NO: 11147 - protein, 55 aa, Artificial Sequence
  Synthetic sequence.
DRVLEELERIIEELKREIEKSLRETEKIIKELEDELRKSLEETERIIRKLEEESK

SEQ ID NO: 11148 - protein, 56 aa, Artificial Sequence
  Synthetic sequence.
RSEEVLREVEKAIRRAKEELKRAVETDRRRNTEAARALEEILDTDRRLIEEAKRRL

SEQ ID NO: 11149 - protein, 55 aa, Artificial Sequence
  Synthetic sequence.
EKVLRDLKKIIDDLRRRIEESLRDSERIIEKLRRDLEASLEESRRIIERLKEKAD

SEQ ID NO: 11150 - protein, 56 aa, Artificial Sequence
  Synthetic sequence.
REKELLDKVKELVERAKRELERLVREDDKLNEDLKRRLTKILKEDSDRIKEVKERL

SEQ ID NO: 11151 - protein, 55 aa, Artificial Sequence
  Synthetic sequence.
DKVLEDLRKIIEDLLREIEESLRESREIIKKLEKRAKDSLKETEEIIEELERRDT

SEQ ID NO: 11152 - protein, 60 aa, Artificial Sequence
  Synthetic sequence.
SEVEELLDRVKKVADESRREAKRLLDESKRVIDKSLDEVRRLLKESREVIEEVKKRVDEK

SEQ ID NO: 11153 - protein, 56 aa, Artificial Sequence
  Synthetic sequence.
DEVLKRLEDLLRKVAEEHRRITREDEELLKRAEEEHERFSKEDEDLLRKAEKEVED

SEQ ID NO: 11154 - protein, 60 aa, Artificial Sequence
  Synthetic sequence.
SRVDELVKRVRDVAREVKRINDELLKRVEEVIKESRDRVRELLKKVEDVIRRAAEEIDRI

SEQ ID NO: 11155 - protein, 56 aa, Artificial Sequence
  Synthetic sequence.
KEVVREIEKLLEDVRRTSEDTVRKIRELVAEVDDDHRRASETIRRLLKEAEDRARK

SEQ ID NO: 11156 - protein, 60 aa, Artificial Sequence
  Synthetic sequence.
SEVEELLKDVERVIKRSEDEVRRLEREVEKSSEDVERINRKLLRDSREVIKKVIEDVRRV

SEQ ID NO: 11157 - protein, 56 aa, Artificial Sequence
  Synthetic sequence.
KEVLDRIRELLETARRRHKEATKKIKRILEESEKKSRRSIEEDKRLLDEAKEEVRR

SEQ ID NO: 11158 - protein, 57 aa, Artificial Sequence
  Synthetic sequence.
SVEEVVRDNERRLEEDAERTRRVARRIEKLLDELRKKVEDVIREAKERLERLLEEIG

SEQ ID NO: 11159 - protein, 60 aa, Artificial Sequence
  Synthetic sequence.
AEDLLREVNKRNEEVIRRNKELLDEVEKRIREVIKRLEELLEKVKRELERVADELRKAKK

SEQ ID NO: 11160 - protein, 57 aa, Artificial Sequence
  Synthetic sequence.
DVERVLKENKETLDEDRKRTKEVIDRNKKKLEDLAREVRKVIEEIKKRLKELLDKTG

SEQ ID NO: 11161 - protein, 62 aa, Artificial Sequence
  Synthetic sequence.
EEAEELLRRVNKDNEKVVRENEKLLKEVLDDSERVIKELRDLLEEVRRRIEKVIRDLEERRR

SEQ ID NO: 11162 - protein, 59 aa, Artificial Sequence
  Synthetic sequence.
STDEFIERLKKILRENEEKVKEVLKRNEDLLKEDEDRTRKAIKELEDKLRRVKERVERQ

SEQ ID NO: 11163 - protein, 56 aa, Artificial Sequence
  Synthetic sequence.
VKEIEKELRRVSEESERELRKHDENTKRVSEENKERIDRLRKTLDEVIERAEERAK

SEQ ID NO: 11164 - protein, 60 aa, Artificial Sequence
  Synthetic sequence.
SLDEVIRRLEETLRKDEEDTRDVIRKVRRILEENRKEVKRVIDELRRRLEEVKKRVEDSK

SEQ ID NO: 11165 - protein, 56 aa, Artificial Sequence
  Synthetic sequence.
ADTIREELRKVLEDNKRILRRLLEELKRVSEESRDRLRRLKEELERVIEEVERRAK

SEQ ID NO: 11166 - protein, 60 aa, Artificial Sequence
  Synthetic sequence.
SIARKVLTDLRKIVEDLERDVERSDRDSERVVREVLERNEEVLKRLRDIVEEIKKVIREV

SEQ ID NO: 11167 - protein, 59 aa, Artificial Sequence
  Synthetic sequence.
RDDVERIKRDLERILKEVARKATESVKRNERILEEVKRHAEKSTEDVERLLRELEDTVR

SEQ ID NO: 11168 - protein, 60 aa, Artificial Sequence
  Synthetic sequence.
DEIEDALREARRVTEEVRREIEKSDKESEDVVREVLRRNEEVLRRLREIVKEILDELRKR

SEQ ID NO: 11169 - protein, 59 aa, Artificial Sequence
  Synthetic sequence.
EKRVREVLRDLERLHEESKRTVERSVERNKTILKEVRKHAETSKRELERILEDVKRATK

SEQ ID NO: 11170 - protein, 60 aa, Artificial Sequence
  Synthetic sequence.
SEIDKVKKDLEKITRDVERAIKKSDDDSRKNSKEVLETNERVLEELRRIVKEVLDEIRRV

SEQ ID NO: 11171 - protein, 59 aa, Artificial Sequence
  Synthetic sequence.
RDRARDVDKKIKDLHKKSEDEVRKSVKRNRDLLEESKRHAEESREDIRRLLDEVREEAK

SEQ ID NO: 11172 - protein, 60 aa, Artificial Sequence
  Synthetic sequence.
SSAETVLTELRKIVRDILEKSKKSNDDLRKIVEEILKDNEDVLRELREILRRIKEKIDER

SEQ ID NO: 11173 - protein, 59 aa, Artificial Sequence
  Synthetic sequence.
KEKVDRIRDDIRRLLKKLRDDVERSVRDVRRILKEVKEHAERSEEEVKRLLKELRDRAK

SEQ ID NO: 11174 - protein, 60 aa, Artificial Sequence
  Synthetic sequence.
DEMDKVLKDAEDVTRRVKEELRKVDEESRRVVKRILDENRRVLKELEDRVRDLRRLIREI

SEQ ID NO: 11175 - protein, 59 aa, Artificial Sequence
  Synthetic sequence.
EEDVRKIKEDLERLHRESKRDVERSARDNERILEEVKRHADESRREVKRLLDEAKEEVD

SEQ ID NO: 11176 - protein, 60 aa, Artificial Sequence
  Synthetic sequence.
DDLERVLRELERLVDEIRKEIEKVDRESEELDRRVKETIKELDERSKRLVEEVEDMIRRN

SEQ ID NO: 11177 - protein, 55 aa, Artificial Sequence
  Synthetic sequence.
EEVVRRVEKIVRELRKTVEDSIRRNEKSVEETRREAEKSEKRNRELVKRLEEKAK

SEQ ID NO: 11178 - protein, 60 aa, Artificial Sequence
  Synthetic sequence.
SEAEKVLKELEDLVRRIEEDIRRTNEEVRKLDEDVLEDIKRVDEESKKLVREIEERIRSR

SEQ ID NO: 11179 - protein, 54 aa, Artificial Sequence
  Synthetic sequence.
EFVRRLEELVKRLADKVKESVDTSRTSVKRTEDEARKSVRRNEDLVRRLEEDAK

SEQ ID NO: 11180 - protein, 60 aa, Artificial Sequence
  Synthetic sequence.
SELEKVLEELERLVKRIEEEIKRTNKEVRDLDEEIRKAIERSNRETERLAREVLERIREE

SEQ ID NO: 11181 - protein, 55 aa, Artificial Sequence
  Synthetic sequence.
EEVVRRLEDLVRRLEESVERSVRTSRKSVKETEDRIREVERHDERLVEELERAAK

SEQ ID NO: 11182 - protein, 60 aa, Artificial Sequence
  Synthetic sequence.
SDLEDVLRKVEDLDRKIAEDIRRTNEDVKRLDEEIEEKIRRSNEKLRELVRRVLKAIRDR

SEQ ID NO: 11183 - protein, 55 aa, Artificial Sequence
  Synthetic sequence.
EEVVRRLEESVRRTKERIDRSLKTSRDSVRETERKIKESKDTSEKLVKDLRDAAK

SEQ ID NO: 11184 - protein, 61 aa, Artificial Sequence
  Synthetic sequence.
SEVDDILRRLREIDEKLLRENEESLKRLKDEVDRLKRKNEKSLDDLRKLVEKLIDDLRKRK

SEQ ID NO: 11185 - protein, 55 aa, Artificial Sequence
  Synthetic sequence.
EKVLEEVKRSVDRTRDHLRKSEEDVRRLLDELRRHLEDSERRVRELLRKLREKVR

SEQ ID NO: 11186 - protein, 61 aa, Artificial Sequence
  Synthetic sequence.
SKVDEILRELKRLVDELLRRIEKTLKELEDLVRELLKENTRSLEELRELVERLLEELRRRK

SEQ ID NO: 11187 - protein, 55 aa, Artificial Sequence
  Synthetic sequence.
REFVERVRELLKRLEDELRKSNRTIEKLLRDLARHLEDSIRRVEELLRELEEKAT

SEQ ID NO: 11188 - protein, 60 aa, Artificial Sequence
  Synthetic sequence.
KEVEDILRELEKIAKDLRDEIRESDDESRRLVEELLKRSEDTLKELRDLVKKLLDRLRER

SEQ ID NO: 11189 - protein, 55 aa, Artificial Sequence
  Synthetic sequence.
EEVVKRVEELIRRVEEEVRRSTRRNEKLLEDLRRELERSDRELEKLMDDLRRKLK

SEQ ID NO: 11190 - protein, 60 aa, Artificial Sequence
  Synthetic sequence.
DDVEKILEDLKRIDTELTKRTRDSNKELEDEVRRLMERSRRTLKELEDEVRKLLDRLRKR

SEQ ID NO: 11191 - protein, 55 aa, Artificial Sequence
  Synthetic sequence.
RKVLEDVRRSLERTERELRESDKSVKKLLDELKEELDRSDREVERLLEELRDAVR

SEQ ID NO: 11192 - protein, 60 aa, Artificial Sequence
  Synthetic sequence.
SEVDEILRKLRELVKELIRRTEESNEKLRKLVEDLRDESRKSLEELRELVERLADELRKR

SEQ ID NO: 11193 - protein, 55 aa, Artificial Sequence
  Synthetic sequence.
ERVVREVEELLKELKRRLEESDKSVAELLRRLEKDLRESDRRVEELLKRLEDEVK

SEQ ID NO: 11194 - protein, 60 aa, Artificial Sequence
  Synthetic sequence.
SEAEKILTELEEIDRRLVKRTEDSNRKLRDTVRKLEEESKKSLEELRELVDRLLKRLDER

SEQ ID NO: 11195 - protein, 55 aa, Artificial Sequence
  Synthetic sequence.
REILERVRESLERTDKRLRESDESVKKLLEDLKRKLEESDRRAERLLEELRKRAT

SEQ ID NO: 11196 - protein, 58 aa, Artificial Sequence
  Synthetic sequence.
SELEEVLKRVEETVRRLTKRLEESLEETRRIVDKLREDLRRSLERTERIVRELTEKLG

SEQ ID NO: 11197 - protein, 59 aa, Artificial Sequence
  Synthetic sequence.
EEELREVEKKAEKLVRELEERLKRVIEDSERLVTDLKEKLERVLETSKKLLADLEERAR

SEQ ID NO: 11198 - protein, 57 aa, Artificial Sequence
  Synthetic sequence.
KELDEVLEKVKRIVDELERKLERSLRETKRIVDELREELKKSLKETEDIVRELERDL

SEQ ID NO: 11199 - protein, 59 aa, Artificial Sequence
  Synthetic sequence.
DERLTEVEERAKRLVDTLAEKLKEVERRSEELVKTLEEELRRVLDTSRRLVEELREKAR

SEQ ID NO: 11200 - protein, 58 aa, Artificial Sequence
  Synthetic sequence.
SELEEVLKEVEEIVRRLEEELRKSLKETREIVTKLLKKLKESLEDSERIVRELSRKLG

SEQ ID NO: 11201 - protein, 59 aa, Artificial Sequence
  Synthetic sequence.
DEEARKVLETAKKLVDDLKRKLERVKEESAKLVDELRKELRRVNERSKELVEKLEREAK

SEQ ID NO: 11202 - protein, 57 aa, Artificial Sequence
  Synthetic sequence.
SELEKVLREVEEEVRRLKKKLKESLDRTKEIVDRLKKDLKRSLDETKKIVDELREKL

SEQ ID NO: 11203 - protein, 59 aa, Artificial Sequence
  Synthetic sequence.
DKDLKDVERKAEKLVEDLDRELKEVEKTSRKLVKELEAELREVDKTSKKLVDDLRKDAK

SEQ ID NO: 11204 - protein, 61 aa, Artificial Sequence
  Synthetic sequence.
REVEELLKEVEESTRTSKKIIEDLLRRVKESSDKSKKDIRRLLEEVRRIVDTVRKILERRG

SEQ ID NO: 11205 - protein, 62 aa, Artificial Sequence
  Synthetic sequence.
EELEKRVREVEETLKRLVDENRETLERVARKAKRLVEDDKRDLEEVVRELEELLKRLKEELD

SEQ ID NO: 11206 - protein, 61 aa, Artificial Sequence
  Synthetic sequence.
SSVDRLLERVKRTTDESKERVERLLERVKESSERSEREIKRLLEEVERIVREVKKEVERRG

SEQ ID NO: 11207 - protein, 62 aa, Artificial Sequence
  Synthetic sequence.
EEVEKRVREVERTVEELVKEDREAVKRVEETIRRLLKKNEDTVKKVEDDLRKLLEDLKRDVK

SEQ ID NO: 11208 - protein, 60 aa, Artificial Sequence
  Synthetic sequence.
SEIEELLRRVKKVNDESRERIKELDKRSREVNERSRRKNEELLKRVEEVVREVEERIDRT

SEQ ID NO: 11209 - protein, 62 aa, Artificial Sequence
  Synthetic sequence.
KELEDRVRDAVRRLERSLKENEDRVRESIERNKDSVRRNEEHVDESIKRLEKEVDRVRKRAE

SEQ ID NO: 11210 - protein, 60 aa, Artificial Sequence
  Synthetic sequence.
SEIEKLLEDVRKVAEEVKRAIDRLNEENKRVNEKSKERIDRLLEEVRKVVEEVLRRVKTS

SEQ ID NO: 11211 - protein, 62 aa, Artificial Sequence
  Synthetic sequence.
EEVEKRVRRVVEKLREIVKEVEEKVRRALDENRRSLEENRRRVKRVIEELEKILKEVEDEVR

SEQ ID NO: 11212 - protein, 57 aa, Artificial Sequence
  Synthetic sequence.
DEVEEMEKELKKLLDDSKRRSDELIEEMRKLNEESKKRSRELEKRLRDINKEIRDRL

SEQ ID NO: 11213 - protein, 59 aa, Artificial Sequence
  Synthetic sequence.
SKLLDDLRKTIEKVIRESRELLEELRKENERVIEESEKLLRDLLRENEKVAEEVRRTAT

SEQ ID NO: 11214 - protein, 57 aa, Artificial Sequence
  Synthetic sequence.
SEVEELIRRLEKLLREVEKRARRLIEEAKRLNDESNKESRRLIEELERLVEDVAREA

SEQ ID NO: 11215 - protein, 59 aa, Artificial Sequence
  Synthetic sequence.
EKLLRDLERAIRDVVRKLEELLRRLREENERVIKESEELLERVRKEIEDVLREAREAAR

SEQ ID NO: 11216 - protein, 57 aa, Artificial Sequence
  Synthetic sequence.
SKVEKLITELEKLLKDSNKKTEDVERELERLNKKSNDDSRRIIEEHKKIVEEIARRV

SEQ ID NO: 11217 - protein, 59 aa, Artificial Sequence
  Synthetic sequence.
EELLKRLKDRIKKVVEESEKLLRDLVKENREVIKESEEILRRLAENLKRVKEEVDRRTT

SEQ ID NO: 11218 - protein, 57 aa, Artificial Sequence
  Synthetic sequence.
EEVERLIKELDDLLRRSNARTRDLIRKADEELRRSNEESRRIVERMEEINKRIADEV

SEQ ID NO: 11219 - protein, 59 aa, Artificial Sequence
  Synthetic sequence.
KKLLDDLKRKIETVIKESEDILRKLEEDLKRVIEESKELLDRLLEENKRVMEEARRRTK

SEQ ID NO: 11220 - protein, 57 aa, Artificial Sequence
  Synthetic sequence.
DEVEEIKKEAKRIVEDLKRRNEELKRRLERLVEEVKKRNEESKKRLEDIVRKIKEDI

SEQ ID NO: 11221 - protein, 56 aa, Artificial Sequence
  Synthetic sequence.
LKEVRKTLEKARKENEDVIRKIEEDAKEVLRRDEESNRDINRKVDEVRKRVEERRK

SEQ ID NO: 11222 - protein, 57 aa, Artificial Sequence
  Synthetic sequence.
REVEEVKKDLERIVEEVKKRNEELKRRLEELLKENKRRNEKSDEDLKRIVDRIDERV

SEQ ID NO: 11223 - protein, 56 aa, Artificial Sequence
  Synthetic sequence.
LKDVKRVVEKVRRENEKVLREILTDAEKVSRDDETSNRDLNRKLEEARERVERKAK

SEQ ID NO: 11224 - protein, 57 aa, Artificial Sequence
  Synthetic sequence.
SEVEEIKERLKRLVEEVERRNRKVIRESEETVKENEKENRKSKKRLKEILDEIVERI

SEQ ID NO: 11225 - protein, 56 aa, Artificial Sequence
  Synthetic sequence.
LKDVKRDVERVLKENKEVLDRLRKEDEEVSRRDKKSNEDINRVVEDVKRKLEEKAK

SEQ ID NO: 11226 - protein, 57 aa, Artificial Sequence
  Synthetic sequence.
SEVEKVKEDLKKLVKEVEDRNRESKRRSEETVKENTKKNEDSKRRLKEIVDRIREEV

SEQ ID NO: 11227 - protein, 56 aa, Artificial Sequence
  Synthetic sequence.
LKDVRREVKRVLDEDKDTNDKLNDRDRKASEEDERSNRELNKTIARAEEEVKEARR

SEQ ID NO: 11228 - protein, 57 aa, Artificial Sequence
  Synthetic sequence.
KEVEDVKEKLKELVERNRDENRKTKEELRRLVEKNRKENEESKKRLKEIVEEIRERV

SEQ ID NO: 11229 - protein, 56 aa, Artificial Sequence
  Synthetic sequence.
LREVEKTAEKVSKEDKETNDRIRKDLKKVSDEDKRSNEEVNKRVDKVRKEIEEERK

SEQ ID NO: 11230 - protein, 57 aa, Artificial Sequence
  Synthetic sequence.
EESERLDELIKEVVERVKKLNEEARELIKDVLRRNEEVNTRLEELNRKVEKEVREEK

SEQ ID NO: 11231 - protein, 55 aa, Artificial Sequence
  Synthetic sequence.
RKVLEKIRRALEKVHEDNRRSIRDVERMLEKVEDDNRKTIERSRRLVKRVEEELR

SEQ ID NO: 11232 - protein, 60 aa, Artificial Sequence
  Synthetic sequence.
RSLEELKKEVERVARAVRKVSEDNKRLLDRVREEVKRVSKENRDLVREVERRVEEVKRRV

SEQ ID NO: 11233 - protein, 58 aa, Artificial Sequence
  Synthetic sequence.
ERVDRLKEEIEEILRDLERKVRENKERSKKIAEDLRKHAEDNAREVKKALRDLEEKVR

SEQ ID NO: 11234 - protein, 60 aa, Artificial Sequence
  Synthetic sequence.
SELERVLREIREVSRETRERSERSLEEIRRVVEDVRRKNKESLDRNREVLEEIRKALEKG

SEQ ID NO: 11235 - protein, 59 aa, Artificial Sequence
  Synthetic sequence.
EDRVERVKRELERLVEENERIVRESRKTLEKLVRDVDRTSKRVKDENRKLLRRVEEEAR

SEQ ID NO: 11236 - protein, 60 aa, Artificial Sequence
  Synthetic sequence.
SEVEDLLRRIRKVVEEVERRSRDSLRRNEEVVKEVEERSEKSLRDDKKVIDDVKRRLREG

SEQ ID NO: 11237 - protein, 59 aa, Artificial Sequence
  Synthetic sequence.
KDEVRKAEEELRKLVRKAEEVVKKSKEDLERTTRKVEKVVRKSEEDSRRLLREVAEEAR

SEQ ID NO: 11238 - protein, 60 aa, Artificial Sequence
  Synthetic sequence.
SKLDKILEELRRIVEEVKRRSEESLEEIERVVEEVKRRSRRSNEELKRIVDKIKKDLRDG

SEQ ID NO: 11239 - protein, 59 aa, Artificial Sequence
  Synthetic sequence.
EDDVDRVRREADKIVEDVRRVVERSKRRLDELRRDAEKVVRDSERRIDRIVDDVRRTAK

SEQ ID NO: 11240 - protein, 60 aa, Artificial Sequence
  Synthetic sequence.
SDLEEVLKKLEDILRKIKETNDKALREIEEVLRRVKERSRRSNKEAEKVLREVEKMLEKG

SEQ ID NO: 11241 - protein, 59 aa, Artificial Sequence
  Synthetic sequence.
EDEVRRIKERLERLLRTAERVSREIKKRLEELVDDVRREVKRSKDRLKRLVDEVAERVR

SEQ ID NO: 11242 - protein, 60 aa, Artificial Sequence
  Synthetic sequence.
SKVDEILKDIERVVREVEKKSRKSNEELKRISEESKRRNEDALRRLKEIADRVRERLDKG

SEQ ID NO: 11243 - protein, 59 aa, Artificial Sequence
  Synthetic sequence.
EDKVRDARRRLKELVDRVKRVVEESEKRIRKLVKENRDVSRRIEEELKRIVREIEEEAK

SEQ ID NO: 11244 - protein, 60 aa, Artificial Sequence
  Synthetic sequence.
SKLEEILKKVEKVSEDTKRKSEDSNRRIKKVSDESKELNKKALRDITEMAKEVDRVLKEG

SEQ ID NO: 11245 - protein, 59 aa, Artificial Sequence
  Synthetic sequence.
EDRVDEARRRLERLVEDNARVVKRSEDELRKLVEDNRRVSEEIERKLKELLKRVAESVT

SEQ ID NO: 11246 - protein, 60 aa, Artificial Sequence
  Synthetic sequence.
SKAEEALKELERVADEARRASEKSNREAKKAADDAKRASEKSLREAERAAREAEKALREG

SEQ ID NO: 11247 - protein, 59 aa, Artificial Sequence
  Synthetic sequence.
KDDAKRIKDEADKIVKRAEDAARESKKRLKRLVEDAERAAKESKEELDRLVREAEEKAR

SEQ ID NO: 11248 - protein, 60 aa, Artificial Sequence
  Synthetic sequence.
SEVERVLKELEDLIRKLEEEIERSLRELEKLIEELKKEIKESLDELEKLIRDLIRRLDER

SEQ ID NO: 11249 - protein, 56 aa, Artificial Sequence
  Synthetic sequence.
SEEADKRAKELLDKLRKVIEKSKEDSRKILKDLERTVKRSEEESRKVLEKLERRVQ

SEQ ID NO: 11250 - protein, 60 aa, Artificial Sequence
  Synthetic sequence.
DEVERVLRELRELIKRLEEEIRKSLKELEDLIRRLIEEIEETLKKVEKIIRELKARLEER

SEQ ID NO: 11251 - protein, 54 aa, Artificial Sequence
  Synthetic sequence.
ELREEAKKLLRRLEKTVEKSKRDSEKVLRDLEEVVRESERASKELLKDLKRKVD

SEQ ID NO: 11252 - protein, 61 aa, Artificial Sequence
  Synthetic sequence.
SELERLLREVEKSSRESVETSRKLNEEVEKTTRESKRRIEELLRRVEKIVDEVKKVIDRDG

SEQ ID NO: 11253 - protein, 62 aa, Artificial Sequence
  Synthetic sequence.
DEARERLRRVAEEIKRLAKENKRVAEESKRRAKELLDDNKDTVRRVSERLKELLEDLDRKLK

SEQ ID NO: 11254 - protein, 61 aa, Artificial Sequence
  Synthetic sequence.
DEIEDLLRRVRKTTEESKKRSEDLNKEVKDSTREVKKRIKELLEEVERRVKEVKERMERDG

SEQ ID NO: 11255 - protein, 62 aa, Artificial Sequence
  Synthetic sequence.
EEAEKRVRRAKEEAERLIRDNERKLKESEEELRRLIKETEDVLRKAEEDIRRILADLRRRLK

SEQ ID NO: 11256 - protein, 61 aa, Artificial Sequence
  Synthetic sequence.
SEVEKLLEDVRESTKRVKELSKRLNEEVERTTKESEDRTRRLLEEVKRIVEDVKDKLRKRG

SEQ ID NO: 11257 - protein, 62 aa, Artificial Sequence
  Synthetic sequence.
EEAKKRVKEISDEIRKLAEETREVLERSEKRLRELIRRNEKVNKEVAERLEEILRDLDRKLR

SEQ ID NO: 11258 - protein, 56 aa, Artificial Sequence
  Synthetic sequence.
REKEDAKRRLEEILREVKKDLDRVHRENEKLVEDTARTVERIKRELKKLLDRAREV

SEQ ID NO: 11259 - protein, 56 aa, Artificial Sequence
  Synthetic sequence.
IEELRKRVEDVVRRVKEELERLLKENEDSTREVKKEAERLLDEIRKVLEKVERDAK

SEQ ID NO: 11260 - protein, 56 aa, Artificial Sequence
  Synthetic sequence.
REKEEAEDRMRRILEEVRRTLEEVHKENRRLLEDTRRTVERIERENRKIVEEVRRV

SEQ ID NO: 11261 - protein, 56 aa, Artificial Sequence
  Synthetic sequence.
IETLERRVREVVERVKKELERLLRENKKSTEEVKRTAEDLLRKNREVVEEVKKAAK

SEQ ID NO: 11262 - protein, 61 aa, Artificial Sequence
  Synthetic sequence.
DEVEELERRLEELLKKSRDEVTKLADELDRVLERSREVVKKDRESLKEILKEVERLVREKN

SEQ ID NO: 11263 - protein, 59 aa, Artificial Sequence
  Synthetic sequence.
KELLDRLEKELRESVKRSEERLKELADRIRKSLEDSERLSRRTNERIKRVLEEVTERVK

SEQ ID NO: 11264 - protein, 61 aa, Artificial Sequence
  Synthetic sequence.
DEVEDVSRKLDEALERSRRITEDLEKKLREVIETSKREVDKLAERLDEVIREIEERIRKKN

SEQ ID NO: 11265 - protein, 59 aa, Artificial Sequence
  Synthetic sequence.
KELIEKLEEDIRRVLEKIKREHERLLRKIEESLKDSKRRLDKLRRDIERILERIREALR

SEQ ID NO: 11266 - protein, 60 aa, Artificial Sequence
  Synthetic sequence.
REIEEALRELEEVLRKVKEDNKRLEEEIRRVLEEVKRINEKLLRDAKKELDRVKEILKDT

SEQ ID NO: 11267 - protein, 55 aa, Artificial Sequence
  Synthetic sequence.
EEAKKELRRLVKEVEDVVRTSTRRLEELVKEVRRVSEETKRALDELVKEVREEVR

SEQ ID NO: 11268 - protein, 60 aa, Artificial Sequence
  Synthetic sequence.
DEIEDVERKIKEVVDRVRDINRRLRDTIRRVLEKVTRINEELRDTVRKVLKEVERILREI

SEQ ID NO: 11269 - protein, 55 aa, Artificial Sequence
  Synthetic sequence.
EEIKEKLERLVREVKRISEESAKDLERLVREVEKVVEDSERELRRLVEEVERRRK

SEQ ID NO: 11270 - protein, 60 aa, Artificial Sequence
  Synthetic sequence.
SEIEKVRKEIDEVLKRVRKINEDLLRELEEVSKRSKDINDDDLRTNTEVLKEARRILKDS

SEQ ID NO: 11271 - protein, 55 aa, Artificial Sequence
  Synthetic sequence.
KDVTKELDELVREVEEEVRRSKDTLRRIVEENREVVERSERKLKKSSDDVREERR

SEQ ID NO: 11272 - protein, 60 aa, Artificial Sequence
  Synthetic sequence.
SELEKVLRELEENSRRNEEELRRSNDKVRRVLDEIRRKLEEVLRKVEEVLRRIEEELSDK

SEQ ID NO: 11273 - protein, 60 aa, Artificial Sequence
  Synthetic sequence.
VKDKVKKAEDDVRRLLERNRRLVEESKKSSEEFLRRVEKLVDDARKKVEDALRKVRETAR

SEQ ID NO: 11274 - protein, 60 aa, Artificial Sequence
  Synthetic sequence.
SELEKVLRDLEKNSRENEELLRRSNKKLKDVVDKIKKKLERALEELREVLEKIRRELSRS

SEQ ID NO: 11275 - protein, 60 aa, Artificial Sequence
  Synthetic sequence.
MDDKVRKAEEDVKRILDENRDLVRRSEENSKRLLERVRELVERVKDAADKLLREVREEAR

SEQ ID NO: 11276 - protein, 60 aa, Artificial Sequence
  Synthetic sequence.
SELETVLRELEENSRRNEELLRRSLDRVRRVLEDVTKKLREVLEEVRTVLEDVKRKLSRV

SEQ ID NO: 11277 - protein, 60 aa, Artificial Sequence
  Synthetic sequence.
VRDKVKEAKDRVRKILEDNRRLVEKSEEDSKRILETLRKLVEEMKRELERIETELREAAR

SEQ ID NO: 11278 - protein, 60 aa, Artificial Sequence
  Synthetic sequence.
SELETVLRKLEENSRRNKKLLRDVLEEDKTVLRDVERKLREVLDELRKVLEDIRDKLSRK

SEQ ID NO: 11279 - protein, 60 aa, Artificial Sequence
  Synthetic sequence.
VKDKAETMKKAVEEILDRNRKLVTEAEKRSEDSLRKLRKSVKEVEEKVKRVLEEVKKEAD

SEQ ID NO: 11280 - protein, 60 aa, Artificial Sequence
  Synthetic sequence.
DELERLLEELERNSRENKKRLDESRKRVKEVLDRIEKKLRDVLREVEDVLRKIREKLERK

SEQ ID NO: 11281 - protein, 60 aa, Artificial Sequence
  Synthetic sequence.
VKDKVKELRDRVKELLDRNREEVRKSEEDSKRVLDEVKRLVDELRERLREIRKRVEEEAK

SEQ ID NO: 11282 - protein, 60 aa, Artificial Sequence
  Synthetic sequence.
SELEDVRRELEENSRRNEETLRRSLAELEENSERNRRELERVLAEVEKVLKKATETLSRV

SEQ ID NO: 11283 - protein, 60 aa, Artificial Sequence
  Synthetic sequence.
VRKEVKKVEDDVRRILEENRRLVEESERRSRRILEENEELVEDIKRKLREIEKELRERVR

SEQ ID NO: 11284 - protein, 60 aa, Artificial Sequence
  Synthetic sequence.
SEVEELEREIRELVERNRELVRRLEEEARRLSRRNEELVRELKERAERLVKELKERLDRV

SEQ ID NO: 11285 - protein, 59 aa, Artificial Sequence
  Synthetic sequence.
KDTLDEVRKEVRKLSKENEERLREVLEESRRLSKRNEEILKEIAERVKRLVDKLTDDIR

SEQ ID NO: 11286 - protein, 57 aa, Artificial Sequence
  Synthetic sequence.
SEVEDVERRVRKLLEENDRLLEENEKSARELMKRDKKVSDENEKSVRDLLDRLRKEI

SEQ ID NO: 11287 - protein, 56 aa, Artificial Sequence
  Synthetic sequence.
LEELLKKLRKLSEDNERLLRESNERAKRSTDESERLSRETNERVKDVVTRLKEASK

SEQ ID NO: 11288 - protein, 57 aa, Artificial Sequence
  Synthetic sequence.
DEVDEARKEVDKLAKENTELVKRNKDSVKELVREDEDELRKNRESVDELLRRLEEEI

SEQ ID NO: 11289 - protein, 56 aa, Artificial Sequence
  Synthetic sequence.
LEEVLKTLREVSDRNKKLLEESNERVRKSTKESKDKLRKSNEEVKRVLKELRDTDT

SEQ ID NO: 11290 - protein, 59 aa, Artificial Sequence
  Synthetic sequence.
DELDRLLEEVKRSLEDVEEKLKKLEEEVKRVNDELRKRLTRLLREVERSLKRVEDLIRN

SEQ ID NO: 11291 - protein, 56 aa, Artificial Sequence
  Synthetic sequence.
LEEVRERLKESLDRLRKRVEDLKRRLRESLESVRKLVEDLERALRKSLEELRERVR

SEQ ID NO: 11292 - protein, 59 aa, Artificial Sequence
  Synthetic sequence.
EELDRLLKRVEESLRRVERILKELLDRVRKVNEDVKRTLDDLLRRSKESLDRVRKLREE

SEQ ID NO: 11293 - protein, 56 aa, Artificial Sequence
  Synthetic sequence.
LEEVEERLKRSLRELERLVRELEEELKKSVKSVRDLLEELKRRNEDSLRRLAEEIK

SEQ ID NO: 11294 - protein, 59 aa, Artificial Sequence
  Synthetic sequence.
KELDDLLREVERSLDRVRKRLEDLLREVERVNEEVKKRLRDLLEELKRVADELRKLRED

SEQ ID NO: 11295 - protein, 56 aa, Artificial Sequence
  Synthetic sequence.
LEDLERELKRSLKELRDEVRELEERLRRSVESVRRVLKELEERARRLLKEVRDEIK

SEQ ID NO: 11296 - protein, 59 aa, Artificial Sequence
  Synthetic sequence.
SELDKLLEDVKRSLDEVKRLLKELLDRVKKVNKELEEVLKRLEEDSRRVVEEVEKATRD

SEQ ID NO: 11297 - protein, 56 aa, Artificial Sequence
  Synthetic sequence.
LEDLERKLEDSLRRLEELLRRLEDELRKSLTSVRKRVKELEEKNRELLKRVEEKIR

SEQ ID NO: 11298 - protein, 59 aa, Artificial Sequence
  Synthetic sequence.
KELDELLKRIEDVVRRLEEELKRLLDEARKVNEDLERRLRKLREDVERSLREVDKMIRN

SEQ ID NO: 11299 - protein, 56 aa, Artificial Sequence
  Synthetic sequence.
LKDLEKALEELLDRVRRLVKELRDRLRDSLRSVEEEVKKLKDELDRSRKAVRDKVK

SEQ ID NO: 11300 - protein, 59 aa, Artificial Sequence
  Synthetic sequence.
SELDRLLERVRKSSTDSEKTLKELRDEIRRVNDEVRKVLEELLKESRRVAEEVKKVIDN

SEQ ID NO: 11301 - protein, 56 aa, Artificial Sequence
  Synthetic sequence.
LEDLERELRRLLRRDRELVKKLEEDLRRSLKSVEEEARRLERANRELLREVEEKAK

SEQ ID NO: 11302 - protein, 59 aa, Artificial Sequence
  Synthetic sequence.
SELDKLLRDVEESSRRSEETLRKLEKEVRDSSTESERILRELRDRIKKVADDVEKVIRD

SEQ ID NO: 11303 - protein, 56 aa, Artificial Sequence
  Synthetic sequence.
LEELEKRLEDLLRRDKKLVDDLRKKLRDLEKRDRDLVEELRRELEELLKRVEDAAR

SEQ ID NO: 11304 - protein, 59 aa, Artificial Sequence
  Synthetic sequence.
SELDRLLREVEKSSKRSEETLRDLRREVEDSSRRSEEILRRLLEESEKVAREVRKLIED

SEQ ID NO: 11305 - protein, 56 aa, Artificial Sequence
  Synthetic sequence.
LEELEKRLRELLKRDKELVDELRKRLEELLKRDRELLKRLEEENRRLLEEVERRAR

SEQ ID NO: 11306 - protein, 59 aa, Artificial Sequence
  Synthetic sequence.
KELDELLDEVRRSSETSERILRKLLREAEESTDRSKRTLKELLRELEEVVERVKKMIRD

SEQ ID NO: 11307 - protein, 56 aa, Artificial Sequence
  Synthetic sequence.
LKDLEKALRDLLDRDRKLVEELEDRLRKLAEEDEKVLRELEEELKRLLEEVAEETR

SEQ ID NO: 11308 - protein, 60 aa, Artificial Sequence
  Synthetic sequence.
SLLEKLERDLERVHKESEDLARELRKELKRVHEESRELMKEIDKELRRVLEEVKSLLRRG

SEQ ID NO: 11309 - protein, 62 aa, Artificial Sequence
  Synthetic sequence.
EDVKDKVRRVEEKVEELLDRNRKLVEEVRREVEKVLRDDRRLVREVERKLKEALDEVRERVR

SEQ ID NO: 11310 - protein, 60 aa, Artificial Sequence
  Synthetic sequence.
SEVEEVERRVDEVLKELKRKVDRSREESERIARELERLVEESEKKVRDVVRELEDLLRKV

SEQ ID NO: 11311 - protein, 54 aa, Artificial Sequence
  Synthetic sequence.
DLKEKIKEVEDRVDKVIKENKDLLDDVERRVRKVIKENEDLIKELRKRVEEVAR

SEQ ID NO: 11312 - protein, 60 aa, Artificial Sequence
  Synthetic sequence.
SKVEELEKRVRKVMEKLKKLLKDSEKESDDVARRLEELLEESEREVREVLRELEDLLRKV

SEQ ID NO: 11313 - protein, 54 aa, Artificial Sequence
  Synthetic sequence.
DVDETIKRVEEEVKKVVDDNRRLNEEILRKVKKVIDDNRRLIEKVREDVDRMAK

SEQ ID NO: 11314 - protein, 57 aa, Artificial Sequence
  Synthetic sequence.
SVVETVDKRLKRLLEKVEKSTEDSRRTAEESKKRVDRSTERVKEVLDRLRREVERLK

SEQ ID NO: 11315 - protein, 59 aa, Artificial Sequence
  Synthetic sequence.
KEKVRTVEKRAEDVIREARKLLEESKRRHDKVVEELERLLKKSKEDVDRVIKELEERRK

SEQ ID NO: 11316 - protein, 57 aa, Artificial Sequence
  Synthetic sequence.
DEVEEVKKRLDELRKEVERSTREVREVLKKLLKEVKDSTDDVRRTIEKLLRDVERLK

SEQ ID NO: 11317 - protein, 59 aa, Artificial Sequence
  Synthetic sequence.
KEELKKVEDRVREVIKDLEELLRDSKRTVEKVERELEDLVRKSEEEAERVERELEERAR

SEQ ID NO: 11318 - protein, 56 aa, Artificial Sequence
  Synthetic sequence.
SVVEEVDRLLEELLRKVKKSTDESKETAKESRKEVKRSTEDNDRTVEKLRDEVRRL

SEQ ID NO: 11319 - protein, 59 aa, Artificial Sequence
  Synthetic sequence.
DDRVREVETRVKKVIDDVRRLVTESKKDHERVVKELRELVEESKRRNDRVVEEAKETAR

SEQ ID NO: 11320 - protein, 56 aa, Artificial Sequence
  Synthetic sequence.
SMVEEVKKVLEKLKRDVDKSTDEVRDMLRRLLEEVRESSREVERRLRELKEEVDRF

SEQ ID NO: 11321 - protein, 59 aa, Artificial Sequence
  Synthetic sequence.
KEEVKKVKKEVDEVIRRLKELVRRSEEEARRVIKTLEKLLRDSKKRVEDVIKDLDRTVR

SEQ ID NO: 11322 - protein, 57 aa, Artificial Sequence
  Synthetic sequence.
SMVEKVEEDLKKLTRDVEKSTEESRKTAEDSARDVRRSSREVEDVLRRLRKEVEELK

SEQ ID NO: 11323 - protein, 59 aa, Artificial Sequence
  Synthetic sequence.
KEEVKKVEDKVKEVIERLKKLLDESKKRHEDVIRELEKLLEESERKVRKIIRELEETLR

SEQ ID NO: 11324 - protein, 57 aa, Artificial Sequence
  Synthetic sequence.
SVVEEVKRRLEELEKRVEDSTRDSKRTLDESERELEESSRDNRRTVEELLDELRRLK

SEQ ID NO: 11325 - protein, 59 aa, Artificial Sequence
  Synthetic sequence.
KEEVEKVEREVREVIKKLRDLVRRSREEHEKVIEKLKRLLEESEDTNRKVIKKVEDDLR

SEQ ID NO: 11326 - protein, 61 aa, Artificial Sequence
  Synthetic sequence.
SVTDEVREKLRRLLEELREVVKRVEDISRKTHEETKRVVEKVKRILEKLKREIEEVIRELG

SEQ ID NO: 11327 - protein, 59 aa, Artificial Sequence
  Synthetic sequence.
KEDLERLRRDVERVIREIEKLLRDVEEKVKETIKTDEDLLRRVKEDVERVLEEIDRRLK

SEQ ID NO: 11328 - protein, 61 aa, Artificial Sequence
  Synthetic sequence.
SVAETVKERLKDLHRRTKESNERAKRISDELNKHNEKSVRDVDREVKRLLEEITEVIKRLG

SEQ ID NO: 11329 - protein, 59 aa, Artificial Sequence
  Synthetic sequence.
KEALRKLDEEVKKVADDDRRLNEESRKRAKDSIEESRKLVRDVAERVKEVARKIREDLR

SEQ ID NO: 11330 - protein, 60 aa, Artificial Sequence
  Synthetic sequence.
DEARELIERVKRVLDRVREENTRVNKELHDILRRVEKRNRDLLRELREILKDVKKKADEV

SEQ ID NO: 11331 - protein, 55 aa, Artificial Sequence
  Synthetic sequence.
RELEKELRRLIAEVARIVEESRRNLERIEEAIKRISETSEKEIREIEDRIKKDVD

SEQ ID NO: 11332 - protein, 60 aa, Artificial Sequence
  Synthetic sequence.
SEAERAREEAKKLKEEIKKSNDELRKAAEKLKRDIERSNDELRKAIEELKRRVESLLRRV

SEQ ID NO: 11333 - protein, 55 aa, Artificial Sequence
  Synthetic sequence.
DEVLKEVKRIAEELHRHNREVLERIEKIARELEKHNRDVLDDIRRIVEKLERDLN

SEQ ID NO: 11334 - protein, 60 aa, Artificial Sequence
  Synthetic sequence.
SEEERAREDLERLREEIRRSNEKLEEDSDKLRRDIEESNRRVEEEIRRLKEDVERKLKDV

SEQ ID NO: 11335 - protein, 55 aa, Artificial Sequence
  Synthetic sequence.
EEVLEEVRRLVKKLHEHNEESLRRSEEILKDLERHNRDVLREVEEIVREALERLD

SEQ ID NO: 11336 - protein, 60 aa, Artificial Sequence
  Synthetic sequence.
REAEEAKKEADRLEEEVRDSNRKLEEDSKRLEREIRESNRKLKETAERLLRDVERLLKDV

SEQ ID NO: 11337 - protein, 55 aa, Artificial Sequence
  Synthetic sequence.
KEVLEDIRRIVKELHDHNKKSMEDSRRIIEELKRHNKRVIDEVKKIVDELREKLR

SEQ ID NO: 11338 - protein, 60 aa, Artificial Sequence
  Synthetic sequence.
REAEEAEKELKRLEDDIKKLVEDLDREAKRLKKEVDDSNRELEKESRRVKKEVRELLKDV

SEQ ID NO: 11339 - protein, 55 aa, Artificial Sequence
  Synthetic sequence.
DRMLEKVKRIVDELRKLLKTVLDDVRRIVEELHRHNKESMERTRKILEDLARRLT

SEQ ID NO: 11340 - protein, 60 aa, Artificial Sequence
  Synthetic sequence.
SEAERAREVLERLREEVERSNKRVREELKRLTEDVRRSNKKLREDSEEVRKRVEDLLKDV

SEQ ID NO: 11341 - protein, 55 aa, Artificial Sequence
  Synthetic sequence.
DEMLRRVRRIIEELHRLNKEALDRVRKIIEDLHRKNEDSLKKTEDILRRLEEELR

SEQ ID NO: 11342 - protein, 56 aa, Artificial Sequence
  Synthetic sequence.
SSIEEVLERLRRLSDEVRKRTDDVLERAREISRETEERSRRINEEIERIVEELKKR

SEQ ID NO: 11343 - protein, 59 aa, Artificial Sequence
  Synthetic sequence.
KEAVDRARREVERLVKENEDILKRLEEEVRKLVKRNEDLVEENRREVEKWRKELEDRKR

SEQ ID NO: 11344 - protein, 56 aa, Artificial Sequence
  Synthetic sequence.
SEIDEVLKKLRDDSKKVEEDTRRVLEELERISEKTRKDSEEVLREIEDIVEKLKRR

SEQ ID NO: 11345 - protein, 59 aa, Artificial Sequence
  Synthetic sequence.
REEVERAEEEVRKLVEENKRIVKEAKERVDELVERNKEIVEEIRREVERLKKELEDRRR

SEQ ID NO: 11346 - protein, 57 aa, Artificial Sequence
  Synthetic sequence.
REVEEVTKELRKISKEVEDLTREVLREAREISRRTEEESRRLNKEIAEIVERLRREG

SEQ ID NO: 11347 - protein, 59 aa, Artificial Sequence
  Synthetic sequence.
KEDVRRVAEEVKRLVDKNRRIVEEAKKEVDRLVKRNEDLMRRNREEVERWKRELEEDRR

SEQ ID NO: 11348 - protein, 57 aa, Artificial Sequence
  Synthetic sequence.
SEVDEVLKTLKKLSDDARKKTKEVLDRLRDISRRVEEESRKVLEEIRRKVEEVKKRR

SEQ ID NO: 11349 - protein, 59 aa, Artificial Sequence
  Synthetic sequence.
KDKVRKVKEDVRRLVEDNKRIVKEAREEVERLKERNKDIVRRIKETVDRLKDELRKRAE

SEQ ID NO: 11350 - protein, 57 aa, Artificial Sequence
  Synthetic sequence.
SDVDRVLKELEDISKDVEDKTREVLKRLKEISDEVKKRSEDINREIARIVEDLERRR

SEQ ID NO: 11351 - protein, 59 aa, Artificial Sequence
  Synthetic sequence.
KEKVKDARRVVRELVERNKEIVRRAAEVVKKLKKENAKLVEDNTREVKKWKERLERRRR

SEQ ID NO: 11352 - protein, 57 aa, Artificial Sequence
  Synthetic sequence.
SEVEDLLRKLKEISDESRERIKRLLEELEEISRKSKEDSERSNEELHRIVKRLKEEN

SEQ ID NO: 11353 - protein, 59 aa, Artificial Sequence
  Synthetic sequence.
EEDLRRAEDDVRRLIEDNKRLLEEAKRRVDDLRRKNEEILRESEKNVRRIEKELEDRRR

SEQ ID NO: 11354 - protein, 57 aa, Artificial Sequence
  Synthetic sequence.
SEVEDLLRKAEEISDRSRREIEKLLRELERIVREVRERSKRSNDELHRIVKELKEER

SEQ ID NO: 11355 - protein, 59 aa, Artificial Sequence
  Synthetic sequence.
EKKLRDVEKRARELIRDNERLLEDAKRRVDELRRELKKILDDSRRNVERIMKELDDEKR

SEQ ID NO: 11356 - protein, 57 aa, Artificial Sequence
  Synthetic sequence.
SEVDELLKRLEEISEESRRRSEDSNREVHEIVKEVKKRSEDSNRRLHKIVEDLKREN

SEQ ID NO: 11357 - protein, 59 aa, Artificial Sequence
  Synthetic sequence.
KDELKRAEDRVRELIKENKRILDESKENAERIDRELKKILEDSKRNVEEIAKRLEEDRK

SEQ ID NO: 11358 - protein, 57 aa, Artificial Sequence
  Synthetic sequence.
KDVEKLLRELEKISEDSKRESDKSNKEVHDSSREVERRSRESNRRLHKVVEDLKRTN

SEQ ID NO: 11359 - protein, 59 aa, Artificial Sequence
  Synthetic sequence.
DEDLRRAKREVERLIRENEKILEDSRENLRRIAERSRRVLEESERNVRRLIEELEETRR

SEQ ID NO: 11360 - protein, 57 aa, Artificial Sequence
  Synthetic sequence.
REVEELLKDLRRILEEVKRRIEKLLDELRKISEESRRRSEKSNEELHDIVKKLKDEN

SEQ ID NO: 11361 - protein, 59 aa, Artificial Sequence
  Synthetic sequence.
EKTLRDAEREVKKLIDTLRKILEDARREVKKLIDKNEKILRDSEKNVRDIAEELRRTRK

SEQ ID NO: 11362 - protein, 57 aa, Artificial Sequence
  Synthetic sequence.
DEVRELLREVKEAVDEVRRRSEESNREAHRVSEESEKRSRESNKRLHEIVEDLKRRN

SEQ ID NO: 11363 - protein, 59 aa, Artificial Sequence
  Synthetic sequence.
EEKLKRAEEEIRKVIEDLRRILRESRENAKRIIRRNREILRESKKNVEDLERELEETRR

SEQ ID NO: 11364 - protein, 57 aa, Artificial Sequence
  Synthetic sequence.
SEVEELLKRLRESSRRVRELSKRSNEEVHRSSDKVRRDSEESNRELHKIVEDLKREN

SEQ ID NO: 11365 - protein, 59 aa, Artificial Sequence
  Synthetic sequence.
ERKLREARKEVKKLIEESREVLERSERNIRELIKESRRLLEESRRNVERLKKELEDTRK

SEQ ID NO: 11366 - protein, 60 aa, Artificial Sequence
  Synthetic sequence.
SEEDEARKDVKELEDRLRKINEDSERAVRRIEEELKRILEENDREVKRLLRKIEELLRRK

SEQ ID NO: 11367 - protein, 56 aa, Artificial Sequence
  Synthetic sequence.
IETVIRELRKALEEAARRSKRLIDELKKVLEEVKRANEETNKRLTEVVEEVAERIR

SEQ ID NO: 11368 - protein, 60 aa, Artificial Sequence
  Synthetic sequence.
KEKEDAEREVERLERESRRVNRESEEEIKRLLRESEKVNEDSEREVRRIREELERLLRKK

SEQ ID NO: 11369 - protein, 56 aa, Artificial Sequence
  Synthetic sequence.
IDKVLTELRRSSEEVTRLSEELIERVARSSRKVKELSRKLIEELRKVLKDVARRLE

SEQ ID NO: 11370 - protein, 60 aa, Artificial Sequence
  Synthetic sequence.
EELERLEKDLREVIKDSERSSDDVRRRLEEVIRDNERLLEELDERLKEVIRDVEDLLRKK

SEQ ID NO: 11371 - protein, 59 aa, Artificial Sequence
  Synthetic sequence.
KKLIDDLRRKIEESLKDSRRLDEEARKEIERISRKTREDIKELLDRIKEVLDEIRERIR

SEQ ID NO: 11372 - protein, 60 aa, Artificial Sequence
  Synthetic sequence.
DELEDLERKLKEIIDDSKRLLDELEKRLRESNREVERLLDELRKELEKVIRDVEELLKKK

SEQ ID NO: 11373 - protein, 59 aa, Artificial Sequence
  Synthetic sequence.
KELIDKLVRELEKSLEESRRLIEELRKEIERTSREIEKRIRDLLKEIKDVLDDIRRRIE

SEQ ID NO: 11374 - protein, 59 aa, Artificial Sequence
  Synthetic sequence.
SELEEVEKRAEELARTLEELNRDVNRRLEELLRRLEKINRTVNDELRKLLEELKDVRRR

SEQ ID NO: 11375 - protein, 59 aa, Artificial Sequence
  Synthetic sequence.
KEDLDRLDKRVRDIVRDLERINEETRKTLEEIRERLERILKRTEENLKEIKEEVRKDEK

SEQ ID NO: 11376 - protein, 60 aa, Artificial Sequence
  Synthetic sequence.
SELEKVTEDVRRLLERLRDINRRVNEALRRLAEELKRLNDEVNKLLRELVTELKKASKDG

SEQ ID NO: 11377 - protein, 59 aa, Artificial Sequence
  Synthetic sequence.
KDKLEELKREVERIEKDVREILKRTEDNLRRIVEELKEINERTEDSLRKIVRELSEDRK

SEQ ID NO: 11378 - protein, 60 aa, Artificial Sequence
  Synthetic sequence.
REKDELRKKVEELLKRLEEISKRTKDSVERVLRELDKITKESKKRAKKLVDRLKELLKRV

SEQ ID NO: 11379 - protein, 59 aa, Artificial Sequence
  Synthetic sequence.
ERAIEEVLKTIEELIKEVEDVNRRVNETIRELLERLRRANEDVIRKVEKLIKEVEDATR

SEQ ID NO: 11380 - protein, 60 aa, Artificial Sequence
  Synthetic sequence.
SEKERLRDMLRKIRETLDRISEDTKRSLDEVRRRLEEISKRTKDNARKLVRELEELLRRV

SEQ ID NO: 11381 - protein, 59 aa, Artificial Sequence
  Synthetic sequence.
EEFVKRVEDTLRELLDRVRRENERVNRDIDRLLKEVEERNKRVNDELRKLIEDVKEAAR

SEQ ID NO: 11382 - protein, 60 aa, Artificial Sequence
  Synthetic sequence.
DDVRELIERLERILKRVEDINRDVNRKLRRVLERVRKDNEDSNRKTEKVLRDVKERADEI

SEQ ID NO: 11383 - protein, 59 aa, Artificial Sequence
  Synthetic sequence.
EKLLRDVERELKRVREDLERILRESRDVVRRVKEELDKILEESRRKVEKVRKDLEDTRK

SEQ ID NO: 11384 - protein, 60 aa, Artificial Sequence
  Synthetic sequence.
SEVEKLITDLRRILKEVEERNRELNKRNDETLKRVEETNRRVNKELKEILDRVIDEARRK

SEQ ID NO: 11385 - protein, 59 aa, Artificial Sequence
  Synthetic sequence.
EDLLRRVEEELRKVEKDLKRILDKSRDDLRKSRERLERILRRSEEIVREVEERLRRAAT

SEQ ID NO: 11386 - protein, 60 aa, Artificial Sequence
  Synthetic sequence.
DEVRKIIKELEEILEEVRKRNEKLIRENEETLERVRKINEKAIRELEDILRRVKEAVERK

SEQ ID NO: 11387 - protein, 59 aa, Artificial Sequence
  Synthetic sequence.
EDVLRDAERRVREVREKLERINKTSRDRLKRSKEEADRINKESREVVKRVKEELEKTAT

SEQ ID NO: 11388 - protein, 60 aa, Artificial Sequence
  Synthetic sequence.
DEVERVIRELERILREVEKRNRDVLRKNEETLREVRERNERAIEELRRILKKVKEEAERK

SEQ ID NO: 11389 - protein, 59 aa, Artificial Sequence
  Synthetic sequence.
EDVLRTVRKKVEEVREALDRINETVKKALDDSRRRLEKINRDVRRDVEKVREDLERTAT

SEQ ID NO: 11390 - protein, 60 aa, Artificial Sequence
  Synthetic sequence.
DEVKKLIDDLRKILDRVRKENRRVIEELRKILEDVERRNREAIERLERILRRVVDLMRKK

SEQ ID NO: 11391 - protein, 59 aa, Artificial Sequence
  Synthetic sequence.
EEVLKRVREEVDRVRRELDRINEDSERVLRDVARELERINREVRKRLKEVEKRLREAAK

SEQ ID NO: 11392 - protein, 60 aa, Artificial Sequence
  Synthetic sequence.
SEVEKIIKELREILERVREDNRKIIDDLRKILKEAEDTNRKVIKELKEILKDVSKLMKEK

SEQ ID NO: 11393 - protein, 59 aa, Artificial Sequence
  Synthetic sequence.
EELLKEAEKDVRRVKEKLDKINRDVREELKKVAEDVKRINDRSREELRRVKEELKKDSD

SEQ ID NO: 11394 - protein, 60 aa, Artificial Sequence
  Synthetic sequence.
KEVEKVIEELRKILDDARRENERLLRELEEILKRVEERNRKLLEDLRRILEEVRKKAKDI

SEQ ID NO: 11395 - protein, 59 aa, Artificial Sequence
  Synthetic sequence.
EEVVKRVEEELKKVKEDVERINKEVRDRLREVEERLEKINEDTERTLKKVKDELEETKR

SEQ ID NO: 11396 - protein, 60 aa, Artificial Sequence
  Synthetic sequence.
DELRDVLRRLREVLTELEKENRKSIEELKKLNEDVARDIKRVIDELRKLLKRVKEEIEKN

SEQ ID NO: 11397 - protein, 55 aa, Artificial Sequence
  Synthetic sequence.
EEVRKELEDVRRKAEKILRDNDERLKESNRHMEKLLREVKEELKRVRDAVEEARK

SEQ ID NO: 11398 - protein, 60 aa, Artificial Sequence
  Synthetic sequence.
DEVRDVIKKLKDLNDRLDDENKKSIEDLKRELERLERRNRDSIRRLEELLKDVADKIRRR

SEQ ID NO: 11399 - protein, 55 aa, Artificial Sequence
  Synthetic sequence.
KDVRKRLRESNEHMKELLKENKELLKRLEDEVKRILERNKKELDRVLRRAEELRK

SEQ ID NO: 11400 - protein, 60 aa, Artificial Sequence
  Synthetic sequence.
RSVEEVRKVLEELKREHEKISKKTEEVLEDLKRRHEEIIKRVRDVLREIEEDLRRIRSRV

SEQ ID NO: 11401 - protein, 59 aa, Artificial Sequence
  Synthetic sequence.
DEKVEKVIRELRRSVEDSKRRNDEAIRRLEESVRKSSDEVRRAIKELRDLLKKVRDTTK

SEQ ID NO: 11402 - protein, 60 aa, Artificial Sequence
  Synthetic sequence.
STVERVREEADRLRKEHERISDETRKVLRKLEEDHERISRRTEELIERIEREVRKIESRV

SEQ ID NO: 11403 - protein, 59 aa, Artificial Sequence
  Synthetic sequence.
DEKVKRVEEEVRRSVEESKKENKKVIDDARRSVKRSEDRNREVIKEVKRLLDTVRERAK

SEQ ID NO: 11404 - protein, 60 aa, Artificial Sequence
  Synthetic sequence.
STVEDVRRRADELRRRHKKISEETERVLRRIEEAVRRILEDLRRILKEIEDRVRELLSRV

SEQ ID NO: 11405 - protein, 59 aa, Artificial Sequence
  Synthetic sequence.
DEKVKEAKRRVTESVRKSKDRNRRVIEEVDRLLKRVEEEVRRVKEEAKELLREVAERTK

SEQ ID NO: 11406 - protein, 57 aa, Artificial Sequence
  Synthetic sequence.
SSVEKVIEDLRRISEKVKKRTEDVLREAEKILRRVEKDNKKVNDDARRIVEELERRG

SEQ ID NO: 11407 - protein, 59 aa, Artificial Sequence
  Synthetic sequence.
KRLVDRVREAAKDIEDENREVLRRVEEILRRIEEELKRSSDETEKAVREIKRRLDERAR

SEQ ID NO: 11408 - protein, 57 aa, Artificial Sequence
  Synthetic sequence.
EEVERVLEEIKRISTDVARRSKEVLKRARESSERVKRRTEEVLEEIRKTNEDVARRA

SEQ ID NO: 11409 - protein, 59 aa, Artificial Sequence
  Synthetic sequence.
KKVVDRLRKEVKRNEDENREMVREVEEEVRRLEKENEEAVRRAADIVRRSEEHLRERTR

SEQ ID NO: 11410 - protein, 60 aa, Artificial Sequence
  Synthetic sequence.
KEVEDLLREVEKSSEKVRELIERSIRELERILEKVAEEIRRSIEELEKILERVAEVAKRR

SEQ ID NO: 11411 - protein, 59 aa, Artificial Sequence
  Synthetic sequence.
EKIVKRVEDEIRRLMKKSDELLERSTKVVEDIKRELEKLLETSSRMAEDIKRKLEELRR

SEQ ID NO: 11412 - protein, 60 aa, Artificial Sequence
  Synthetic sequence.
SEVEKLIEELERILEEVARRLKKSNEDLRKILKEVAKRIKDSIRDLRRILEEVADELRRR

SEQ ID NO: 11413 - protein, 59 aa, Artificial Sequence
  Synthetic sequence.
ERIVEEVERAAEEIKRRLEELVRRSEKSVEEIERELRKLLKDSSDVVREIKKRLEDERR

SEQ ID NO: 11414 - protein, 60 aa, Artificial Sequence
  Synthetic sequence.
SEVEKLLKEVEDSSRKVEEDLRDSNRELKKILDEVADRIRKSIKRLEDILKKVAEDAKRR

SEQ ID NO: 11415 - protein, 59 aa, Artificial Sequence
  Synthetic sequence.
EKIVRDVERRVRELKERSRRIVEESERSAREIKRELKRLEDDSSRVVEDIRKKLEELAK

SEQ ID NO: 11416 - protein, 60 aa, Artificial Sequence
  Synthetic sequence.
REVEELIKRVEESSRDVERRLRESNEEVERSTRRVAEEIKKSIDRVREIVERVERKKERV

SEQ ID NO: 11417 - protein, 59 aa, Artificial Sequence
  Synthetic sequence.
EKIVERVRRVIEELKRRSDEIVKESERSVRRVEKETTELLEESSRAVERVERRLRELVR

SEQ ID NO: 11418 - protein, 60 aa, Artificial Sequence
  Synthetic sequence.
SEVEKLIEEVRRSSKKVEEDLDRSNRELEDILRRVAEELEKSNRELEKILKEVAERVKRR

SEQ ID NO: 11419 - protein, 59 aa, Artificial Sequence
  Synthetic sequence.
EEIVKRVEEEARRLKERSREIVKRSEDSAREITKALRKLVRDSEDSVRKIKEKLKEETR

SEQ ID NO: 11420 - protein, 60 aa, Artificial Sequence
  Synthetic sequence.
REVEELDKRLKESSTEVEERLRRSNREVEDSTRRVEEEARKSNEELREILERVAEDVKRR

SEQ ID NO: 11421 - protein, 59 aa, Artificial Sequence
  Synthetic sequence.
ERIVERVERSARELMRRSRDIVRRSKESIERLKKRTRDLVKESRESVEKIKRDLEELRR

SEQ ID NO: 11422 - protein, 59 aa, Artificial Sequence
  Synthetic sequence.
SEVEKLLKELEDSSKKVEDDLRKSNEELRKIVEEVADLIRRLNKELEEILREVRERMRR

SEQ ID NO: 11423 - protein, 59 aa, Artificial Sequence
  Synthetic sequence.
EEIVRRVEKIVRDLKRRSDELVRRSRKSVEEIRKELEELVERDRRSVERIKEELDKERK

SEQ ID NO: 11424 - protein, 60 aa, Artificial Sequence
  Synthetic sequence.
SEVEKLTKEVRDSSKRVEDELRKSNERLKESTDRVADEIRRLNKELKEILDKVAREVERR

SEQ ID NO: 11425 - protein, 59 aa, Artificial Sequence
  Synthetic sequence.
EEIVERVERDARKVKEDSKRLVEESEESVRRLKTDTERLVEEDKKSVDTIKEELKKLTK

SEQ ID NO: 11426 - protein, 59 aa, Artificial Sequence
  Synthetic sequence.
DEVEELRKELEDSSREVEELIRRLNKEVEKSTREVAKRVKDSNKRLDEILKKVAEEVKK

SEQ ID NO: 11427 - protein, 59 aa, Artificial Sequence
  Synthetic sequence.
REIVERVREEVEKLKKRSEDLLERDKESIDKLDKETKELVEESRKSVRDIERELKKLSD

SEQ ID NO: 11428 - protein, 60 aa, Artificial Sequence
  Synthetic sequence.
DEVEKLIKDVEDSSREVEERIRDLNRKAKKIVREVAERIRELNERLKEILDKVAEEVKRR

SEQ ID NO: 11429 - protein, 59 aa, Artificial Sequence
  Synthetic sequence.
EEIVKRAEKRIRELKKKSDELLKRDRDSMDRIKKELEKLTREDEESVRRIERELKRLAD

SEQ ID NO: 11430 - protein, 60 aa, Artificial Sequence
  Synthetic sequence.
SEVEKLIEEVRRSSEEVERRIKKLNDDVRRSTEKVEEDIRRLNEELKKILDEVAKEMERR

SEQ ID NO: 11431 - protein, 59 aa, Artificial Sequence
  Synthetic sequence.
ERIVRRVEKIIRDLKKRSDELLKEDRRSAEEAKRETDRLVEEDKRSVDEIRERLKELSR

SEQ ID NO: 11432 - protein, 60 aa, Artificial Sequence
  Synthetic sequence.
DEVEELLRRVEEIVERVAKRIEELNRRLEEILEEVARRSTKSIKELEDILRKVAKEMERR

SEQ ID NO: 11433 - protein, 59 aa, Artificial Sequence
  Synthetic sequence.
EEIVERVERRIRELKKRLEKLVRDDEESVKEIRKKLEELVKRSSDVVERIKRELDKLRK

SEQ ID NO: 11434 - protein, 59 aa, Artificial Sequence
  Synthetic sequence.
SEVEKLLRELRESSREVEERIRKLNRELEKIVRDVDRESARSIEELKRIAEEVAERAKR

SEQ ID NO: 11435 - protein, 59 aa, Artificial Sequence
  Synthetic sequence.
ERIVKEVEEEVRRLKKRSTKLLEDDRKSVEDIKERLKELVRRSSEVVKEIEERLKRLEK

SEQ ID NO: 11436 - protein, 60 aa, Artificial Sequence
  Synthetic sequence.
SEVEDLLRRVRESSKEVEERIRKLNDELRKSTKEVEDRSRRSIERLDRIVEKVAREVERR

SEQ ID NO: 11437 - protein, 59 aa, Artificial Sequence
  Synthetic sequence.
EKIVRDVEREVRRVKERSDRLLEEDRKSVEELKTRTDRLLEESSKRAEDIKRKLKELEK

SEQ ID NO: 11438 - protein, 60 aa, Artificial Sequence
  Synthetic sequence.
SEVEKLLREAKESSREVKDRSKKSIDELRESTKTVERLIRDLNRKLKEILDRVADDMRRR

SEQ ID NO: 11439 - protein, 59 aa, Artificial Sequence
  Synthetic sequence.
EKIVRRVEEIVRRLKKESKDLVEESTRVADELRRRTDRLVEEDERSVRKIKEDLDRLRK

SEQ ID NO: 11440 - protein, 60 aa, Artificial Sequence
  Synthetic sequence.
SEKEEAKRRARELEKRTDELLEESTRVNEESKRHLKELLDESRRTAKRVKEEIDKLLKEK

SEQ ID NO: 11441 - protein, 56 aa, Artificial Sequence
  Synthetic sequence.
VDTLLERVDRSSKEVADRMRKSNEEVKDVNRRVAKALKDSNRDVERVLEDVARKIK

SEQ ID NO: 11442 - protein, 60 aa, Artificial Sequence
  Synthetic sequence.
SEKETARKVIEELRKETERLLRESTKTNEDSSRHAKELLKRSEDVAREIEERIDRLLEEK

SEQ ID NO: 11443 - protein, 56 aa, Artificial Sequence
  Synthetic sequence.
IEEVIKRLEDSSRDVERRLRKSNEDVKRVNKEVADRLKESNDRLREELKKVEDDIR

SEQ ID NO: 11444 - protein, 60 aa, Artificial Sequence
  Synthetic sequence.
DEKEDAERKIRRLEERTKKLLDDSTKTNKESRDHLRKLLADSEKTARDIKRAIKKLLDDK

SEQ ID NO: 11445 - protein, 56 aa, Artificial Sequence
  Synthetic sequence.
VDTLLTEVTDSSRRVEEELKRSNDEVRRVNREVAERLKKSNRELEEVLRKVAEDIK

SEQ ID NO: 11446 - protein, 60 aa, Artificial Sequence
  Synthetic sequence.
SERERAEEEAKKAKKEAKRLLDESTKANEDSKRHADKLLEDSKRAAEDIKRKAEDLLRKK

SEQ ID NO: 11447 - protein, 56 aa, Artificial Sequence
  Synthetic sequence.
ARRAIEEVRRALKEAADASRDLNRRAKEANERAAKASEELNKRAEDALRRASEEIR

SEQ ID NO: 11448 - protein, 60 aa, Artificial Sequence
  Synthetic sequence.
SEKEEVKKRVDEIKERLKRLLDDSTRTNEESRKHIEDLLEESKKEIDKVRKDLERLLRKK

SEQ ID NO: 11449 - protein, 56 aa, Artificial Sequence
  Synthetic sequence.
VDTMTRKVEEVLRDVAEKIKELNRRVEEANKDMARESERLNREVRDVLRKVAKDIE

SEQ ID NO: 11450 - protein, 60 aa, Artificial Sequence
  Synthetic sequence.
SDEDRAREDLKRIKEELKRLLRESTEVNKESEKHIRKLLRESEETIRRLKKAIDDLLRKK

SEQ ID NO: 11451 - protein, 56 aa, Artificial Sequence
  Synthetic sequence.
IETILRRLERVLKEVEKKSRELNRRVKEVNEKVRRDIERLNKEVKDVLKTVAERIT

SEQ ID NO: 11452 - protein, 61 aa, Artificial Sequence
  Synthetic sequence.
DEKERAEERIRELKKRTEELLRESTRVNRESKEHAKELLKRSEDTIRELDERIRRLLERKK

SEQ ID NO: 11453 - protein, 56 aa, Artificial Sequence
  Synthetic sequence.
VDTVLARLEESSKEVEDRSKRLNEEVKKVNEEVAKRIKELNEEVERVLRRVAEEIE

SEQ ID NO: 11454 - protein, 59 aa, Artificial Sequence
  Synthetic sequence.
SLKEELREKVRKVKEDSERLLRDLERTVKKVREDSKRILDRNRETAKEIERRIRELERN

SEQ ID NO: 11455 - protein, 59 aa, Artificial Sequence
  Synthetic sequence.
EELVRKLRKELDDSLKRTKELVDRLKEDLERSLRDSEELARRLDRELEDVLRRIEDEAR

SEQ ID NO: 11456 - protein, 59 aa, Artificial Sequence
  Synthetic sequence.
SLLETLKEIVRRVERESARILEDNRRTVTRAKEESKKILDRNAKTVDDLRKEVERLKTE

SEQ ID NO: 11457 - protein, 59 aa, Artificial Sequence
  Synthetic sequence.
EELVRRLVEELEKSLRTTERLARELDRKIKESLDTSEELARRLDKRLEEVLKDVKRRAE

SEQ ID NO: 11458 - protein, 59 aa, Artificial Sequence
  Synthetic sequence.
RLEEELKKTVDRAREEVKRLLDRDRESVDDLRRAVEEILKTNRRTVEKLRKDLTDLRRN

SEQ ID NO: 11459 - protein, 59 aa, Artificial Sequence
  Synthetic sequence.
EKLVRELIEKIKKVLDEVRRLSEKLNEDLREILERVKRLADKLDEELKRMLEKVEETAR

SEQ ID NO: 11460 - protein, 61 aa, Artificial Sequence
  Synthetic sequence.
DDVERVKRDIDRLLEKVTRENEKVKEKMKELLDRAREVNRKVKEDIKRLLKEVEDVARREG

SEQ ID NO: 11461 - protein, 58 aa, Artificial Sequence
  Synthetic sequence.
EDVRDLERRLREVEEEARKLSEDVRRVLEEVRKELERLSRDTERVLKRVREEIRKIEK

SEQ ID NO: 11462 - protein, 61 aa, Artificial Sequence
  Synthetic sequence.
SEVEEVIRRVRKLLKDAKDLNEEVKRRLKELLDRVKRVSEKTKEDIKRLLEEVERVVRTKG

SEQ ID NO: 11463 - protein, 58 aa, Artificial Sequence
  Synthetic sequence.
DLAERVRDVLRRVAEAAKELSKDTKRVLDEVKKAIDELLKDNKRTVEEVEKEAKKTLK

SEQ ID NO: 11464 - protein, 61 aa, Artificial Sequence
  Synthetic sequence.
DEVEKVKKTLKKLLEDARRRNEEVRKEIEDLDRELERLNRESKKRIEDLLEEVKRVVDRDG

SEQ ID NO: 11465 - protein, 58 aa, Artificial Sequence
  Synthetic sequence.
ELVRELERVLDTVRREAERLSRKTREVVDESRRRNKKLLEEDERVVRKVVEDAERKLK

SEQ ID NO: 11466 - protein, 61 aa, Artificial Sequence
  Synthetic sequence.
DEVKKVIDDIKDLLRRVEEVSRRVNKELERLLREVREVNKDVKRKLEELLRRVKEVVRRDG

SEQ ID NO: 11467 - protein, 58 aa, Artificial Sequence
  Synthetic sequence.
DLAERVRKVLEDVTRAAKELIKRDKKSLEDVKREIEKLSRDVKRVLEKVAEDAKDTLR

SEQ ID NO: 11468 - protein, 60 aa, Artificial Sequence
  Synthetic sequence.
SEEEDLARVVERVERDLKRLDDDNKRVLDESRRRNEELVKRTAEIVERVRRELERLRREG

SEQ ID NO: 11469 - protein, 56 aa, Artificial Sequence
  Synthetic sequence.
VEEVKRTMEKLLDDVRKANEDSKREIEKSDDEVRKRNEEVVRDIERLLKEVEERAR

SEQ ID NO: 11470 - protein, 60 aa, Artificial Sequence
  Synthetic sequence.
SEEEDLRRRAEEVHRRNEELLRDNERTVKKVHDRNRELLEDLRRVVERIERELRRLEEEG

SEQ ID NO: 11471 - protein, 56 aa, Artificial Sequence
  Synthetic sequence.
VEEVKERIDRLHEELEKLSRTTKEKLKELHKRLEDVVREVKRRAEELLREIKERAD

SEQ ID NO: 11472 - protein, 60 aa, Artificial Sequence
  Synthetic sequence.
SEVEEVRKVVEEVKRELRRLSEDSRRVVEEIVEADKRLSEKNETSVREVKKALKKLKDDG

SEQ ID NO: 11473 - protein, 62 aa, Artificial Sequence
  Synthetic sequence.
KDAEELVRDVIRRAREVLKRVEDVHRKVKKDLKKVHDDNKKISEDIDRRLEEVLRKVEEDDR

SEQ ID NO: 11474 - protein, 60 aa, Artificial Sequence
  Synthetic sequence.
SEVEDVKRKVREIEKADEELSKRNEDSARESKKRLKEWSDDTKEVVERVRKRLKDLEDEG

SEQ ID NO: 11475 - protein, 62 aa, Artificial Sequence
  Synthetic sequence.
EEAERLVREVTKEMKDVHDKNKKLSEDIDKRVEDTNRRLKEVHERVKEEAKKVVRDLEETAK

SEQ ID NO: 11476 - protein, 60 aa, Artificial Sequence
  Synthetic sequence.
SLVETVEDVLREVEERLRKLLRDNEESVERIKKRDEDLSKENEESVKRVEDTLDELRERG

SEQ ID NO: 11477 - protein, 60 aa, Artificial Sequence
  Synthetic sequence.
VEELVRKVIEDARRLLDDVRRKSERLDREAERVHRENKKLSEDLDRRVKTVVDDVRERAR

SEQ ID NO: 11478 - protein, 60 aa, Artificial Sequence
  Synthetic sequence.
SLVEEVEKEARDIERRDDELSKRNEKVARDIEERDRRLSDEVREVVKRVKRELERLVESG

SEQ ID NO: 11479 - protein, 60 aa, Artificial Sequence
  Synthetic sequence.
AEKLVRRVIKDLRKLHKENEDLSREIDKRLEDAHKRNRDLVEEVKKRMERVREEVERAAR

SEQ ID NO: 11480 - protein, 60 aa, Artificial Sequence
  Synthetic sequence.
KEKEDVKKVVEDIERADKKLSEDNRRVVKRIEEADRKLSKENKESVERAKKRLDDLERRG

SEQ ID NO: 11481 - protein, 62 aa, Artificial Sequence
  Synthetic sequence.
EEAEELVRRVIKEMEEVHKRNRDLSKRLDDELKRIHKENEDRLRRLDEEIEKVVKKVEDDAR

SEQ ID NO: 11482 - protein, 60 aa, Artificial Sequence
  Synthetic sequence.
SLVEELRKDVEEIKKRLKRLVEENEKVVREVTEADKKLSKELEDEARDVKRALEELRRRG

SEQ ID NO: 11483 - protein, 62 aa, Artificial Sequence
  Synthetic sequence.
EEVEELVRRVREDMERVVREVEKVSRDLDREIRRVHRENRELIEDVKRKARKVLRDAEEEAR

SEQ ID NO: 11484 - protein, 60 aa, Artificial Sequence
  Synthetic sequence.
KIVEDVEKVVKEVDDRLKKLVDDNERKVREIIRRDEELSEKNEKSVRDVKEELKRLAEEG

SEQ ID NO: 11485 - protein, 62 aa, Artificial Sequence
  Synthetic sequence.
EEVEKLVREVIDRMRRVVREVEEMSKRLDEELEEVHRRNRETLTRIDEEAKKVVDDVDRRAR

SEQ ID NO: 11486 - protein, 60 aa, Artificial Sequence
  Synthetic sequence.
SVRETLEEVLRRIAEAIDELIKTLEKVLEESRREIERWKKENEDSLREIKKKLEDLEKKI

SEQ ID NO: 11487 - protein, 59 aa, Artificial Sequence
  Synthetic sequence.
EEKAKRALEEIKRLLERVKKRVEEALEEIKKSNKEAADIVRDIDRRLEELLRTVADKTR

SEQ ID NO: 11488 - protein, 57 aa, Artificial Sequence
  Synthetic sequence.
DEVEEVIKTSREINDRVRRELERVLRRSEEIIEEVAKSIEEVIKESEDIIRKVEKDG

SEQ ID NO: 11489 - protein, 59 aa, Artificial Sequence
  Synthetic sequence.
EELKRKIRDVLRDDERAARKWVRDLEEVNKRTEDKIRELLRKLEEVNEKTERDIRRREK

SEQ ID NO: 11490 - protein, 57 aa, Artificial Sequence
  Synthetic sequence.
EEVERVIEEIKKLLKDVAELVERVIKEIRKILDDVAKENKRLLDESRKIIKEVAERG

SEQ ID NO: 11491 - protein, 59 aa, Artificial Sequence
  Synthetic sequence.
EEVKRKIRKVLKEIKEEIEKLLKKLRDALRDVEEKIRDLTRRAREVNEKSREDLERRKD

SEQ ID NO: 11492 - protein, 57 aa, Artificial Sequence
  Synthetic sequence.
DEVEDVIRRLEEIIREVEDRLRKILETSKKIIKEVEDENRRVVTEIERILREVEKRA

SEQ ID NO: 11493 - protein, 59 aa, Artificial Sequence
  Synthetic sequence.
EELKRRIEEVLERLRRKIERLAKELKDVNDESEREARRLTEEVKRVLEEVARRIKEAAE

SEQ ID NO: 11494 - protein, 56 aa, Artificial Sequence
  Synthetic sequence.
REVEEVRKKIEEDIDRVDKELKEVLETSRDILRRVAKENEDVLRDLERLVDEVRRD

SEQ ID NO: 11495 - protein, 59 aa, Artificial Sequence
  Synthetic sequence.
EELKKKLEKVVRDLSKRLEELLKELEKVNEEVKRRLERLTEEVRKVLEEITKKLKERAR

SEQ ID NO: 11496 - protein, 57 aa, Artificial Sequence
  Synthetic sequence.
SKVEEVMRRLKEILKRVAEELEKVLTESEKILRDVADENRRVMEESRKILKDVAERG

SEQ ID NO: 11497 - protein, 59 aa, Artificial Sequence
  Synthetic sequence.
EEVKKKIDKVLEDVRKELDDLRRKLEEVNKRIEEEIRRLTEDVRRVNDEIRKRAEDRKR

SEQ ID NO: 11498 - protein, 60 aa, Artificial Sequence
  Synthetic sequence.
SLREKADEVVKRIKERLDRLEDKSREVVKDSRRKLREWYEKSKRAVEDIETKLDELRKDL

SEQ ID NO: 11499 - protein, 59 aa, Artificial Sequence
  Synthetic sequence.
KDMVEELIRELEKIVTDVAKKVEDTIEESRKINEEVAKRVEDTIKRLEDILRDVARRVK

SEQ ID NO: 11500 - protein, 60 aa, Artificial Sequence
  Synthetic sequence.
SLREKVDKVVEEIKRKLDKLLEDSERVVEKSERDLRRWLKEAEEVVREIEKTLKELEKRA

SEQ ID NO: 11501 - protein, 59 aa, Artificial Sequence
  Synthetic sequence.
KDVVEDLIRELEEIVRRVAEEVRTTIEDLRKINDEVREKVKRLIEELKKILDDVAEEVR

SEQ ID NO: 11502 - protein, 60 aa, Artificial Sequence
  Synthetic sequence.
SLEEKAREVVKEIRRRLDELLRKSHDVVREIEERLDKLEKESEDAVREIEKRLDELAKRI

SEQ ID NO: 11503 - protein, 59 aa, Artificial Sequence
  Synthetic sequence.
AKVVEKLIKELRDILREVAERVERTIRRLREIVKRVERKVERSIEEMERIVREAEEETR

SEQ ID NO: 11504 - protein, 60 aa, Artificial Sequence
  Synthetic sequence.
SLREKVDEVVKRIEKRLEELIRKSRKANEDIRKKLEELIKKSEDVVRKIKRELEELKRRV

SEQ ID NO: 11505 - protein, 59 aa, Artificial Sequence
  Synthetic sequence.
REVVEDLIRELEEILRKVAEEVEDTIRRLEKILKEVAERVERTIKDLEDIVRDVAEKVK

SEQ ID NO: 11506 - protein, 60 aa, Artificial Sequence
  Synthetic sequence.
SLREKVKRMVEEVKRELDELEKESNRAVERVERELEKLIRKSERVNERIRERLKELAARS

SEQ ID NO: 11507 - protein, 59 aa, Artificial Sequence
  Synthetic sequence.
DKVVEKLIKEVRDIVKKVAEEVKKTIEDVERKVKEVAERVEDTIRRLDEAVKEVEERVR

SEQ ID NO: 11508 - protein, 60 aa, Artificial Sequence
  Synthetic sequence.
SLREEAERVIREVREDLDRLRRESKKVNDRIRRTLDELRKRSDDAVRDIKEKLKELAKRT

SEQ ID NO: 11509 - protein, 59 aa, Artificial Sequence
  Synthetic sequence.
KDVVRELAERLKRLLEEVEKRVKDTIRELEKIVEEVRKRVEDTIRRLEEVLDKVAKEVT

SEQ ID NO: 11510 - protein, 61 aa, Artificial Sequence
  Synthetic sequence.
SIEEELKKVLKEIEDRVRKSDKENKEASERIKRTVEELERRLREVLRRIEEAVRKLVREKG

SEQ ID NO: 11511 - protein, 59 aa, Artificial Sequence
  Synthetic sequence.
EKKVKEVVDELRKLLRELEKLSEESNRKLKKLTDDIEKLVRDVEKELRKLLKELAEKIK

SEQ ID NO: 11512 - protein, 60 aa, Artificial Sequence
  Synthetic sequence.
SVEERLKRVLERAREEIKRLLDELERVLEESRKEIKKLSEDLTRANEDTRREIEKLAREI

SEQ ID NO: 11513 - protein, 59 aa, Artificial Sequence
  Synthetic sequence.
ERIVKKVEEEIEELVRRVEKRVREVKKRMEDSNREVRKANEEVKKRSEDLLRKVRRDAE

SEQ ID NO: 11514 - protein, 60 aa, Artificial Sequence
  Synthetic sequence.
RVRDELREVLRKAREDIKRLSDKMREVLRESEEKIKRLSDDLRRVNEETKKEIDRLRKEI

SEQ ID NO: 11515 - protein, 59 aa, Artificial Sequence
  Synthetic sequence.
KEIFRKVEKEIEDLLEEVRDVNRKIEEEARRSNEDVERVNREIKKRSEELLRDVEKKTE

SEQ ID NO: 11516 - protein, 60 aa, Artificial Sequence
  Synthetic sequence.
SVREELKKALDRVRESIRRLSEELREVLERSEDTIRRLVEDLERVNEETRREIEDLARKI

SEQ ID NO: 11517 - protein, 59 aa, Artificial Sequence
  Synthetic sequence.
ERIMKEIEKRIEDLEREVKEVNREVIERAEESNRRVEELVREAKKRSRELLKRVREEAK

SEQ ID NO: 11518 - protein, 60 aa, Artificial Sequence
  Synthetic sequence.
SVREDLERALRRAAEEIEKLSRDLKRVLEESRKNIERLRRDIERMNEETEKEIRRLAREI

SEQ ID NO: 11519 - protein, 59 aa, Artificial Sequence
  Synthetic sequence.
EEDAEEIKTRIKELIDRVRRVNEEVKERMKKSNEEVEEVVRRVKEESKRLLERVEEDVR

SEQ ID NO: 11520 - protein, 60 aa, Artificial Sequence
  Synthetic sequence.
SLREDLRRVLERARDELRKLSKELKEVLKRSRDNIRKLSEDVKRANERTEEEIRRLTKEI

SEQ ID NO: 11521 - protein, 59 aa, Artificial Sequence
  Synthetic sequence.
DEIFKRVKKEIKELVDRVREVNKDVIRRMKKSNDEVKRENEKVIRESEKLLKDVEDARR

SEQ ID NO: 11522 - protein, 60 aa, Artificial Sequence
  Synthetic sequence.
SVRERLEKVLKEVEDSIKELSDDLRRVNKRTEEEIRRLAEDLERVLERIEREIRKLAKEI

SEQ ID NO: 11523 - protein, 59 aa, Artificial Sequence
  Synthetic sequence.
EEIAERVERTIRKLEDDVRKVNEDVKRRSRELLERVARLVERVKEEAEKLLEDVKRKAD

SEQ ID NO: 11524 - protein, 60 aa, Artificial Sequence
  Synthetic sequence.
SLREDLERVLEEIERELKELSDDLRRMNEETEREIRKLSDDLRRALEKIRDEIRKLAEEI

SEQ ID NO: 11525 - protein, 59 aa, Artificial Sequence
  Synthetic sequence.
EEIFRKVKEEARRLVREVEEVNKEVKKRSRDLLREVRKVNEDVKREIERLLRKVAKDAE

SEQ ID NO: 11526 - protein, 60 aa, Artificial Sequence
  Synthetic sequence.
SMREDLRRVLEEAEKKIRKLSKEAKDANRETEKEIRKLSEDVKRVNKESKDEIDRLAEEI

SEQ ID NO: 11527 - protein, 59 aa, Artificial Sequence
  Synthetic sequence.
KEIAEKVKREIEKLVRDVERVNREIIERSEKLLREVREENERVKRESRRLLKEVEKAAE

SEQ ID NO: 11528 - protein, 60 aa, Artificial Sequence
  Synthetic sequence.
SVRETLKKVLEDVRRELKKLSDKLRKVLEDSRRNVKRASDKLREVLKRVKEEIERLRREI

SEQ ID NO: 11529 - protein, 59 aa, Artificial Sequence
  Synthetic sequence.
EEIAKRIIEEIKKLLDRVREVNEDVIRRMKKSNEDLDRRNEEVRKRIEDLLEKVARDAK

SEQ ID NO: 11530 - protein, 60 aa, Artificial Sequence
  Synthetic sequence.
SLEETAKEVIERSEDHLRRLEETNRKVVEDSERHLDDLTRRIKKVVEDIKKRLDEIEKRG

SEQ ID NO: 11531 - protein, 60 aa, Artificial Sequence
  Synthetic sequence.
AEELLRTVVKEIEDANRRVEEVSRKNTEDIKEWNKRLEEELRRVVERARRELKKVEDAAR

SEQ ID NO: 11532 - protein, 59 aa, Artificial Sequence
  Synthetic sequence.
SLEETAKRVIEESRKHLDRLRRENERVVKEIRDALRELEKKVEDVVRRIAEELERIRKE

SEQ ID NO: 11533 - protein, 62 aa, Artificial Sequence
  Synthetic sequence.
EEAEDLLRKVIEDIKELNRELERVSRKNIEDLRRWLEEVREMVKRVEEKAKRVLEELREAAK

SEQ ID NO: 11534 - protein, 60 aa, Artificial Sequence
  Synthetic sequence.
SLEETIEKVVERSKRNLEKLRREIRKVVKESDENLKDVERRAREVVEEIKKALEDIRRKG

SEQ ID NO: 11535 - protein, 62 aa, Artificial Sequence
  Synthetic sequence.
EEAEELLRKVIKESEDLNRRLREEVKKVVREIEEANKRVNDTVRKMEEALKKLLDDLREKAR

SEQ ID NO: 11536 - protein, 60 aa, Artificial Sequence
  Synthetic sequence.
SLEEDMKRVVDESRRNLERVEKENRDVVKESRDNLKKVEDDIRKVVKDIRDELEKIRKRG

SEQ ID NO: 11537 - protein, 62 aa, Artificial Sequence
  Synthetic sequence.
EEAEELVRRVKETSKRVNEELDKTAKKNVDDIKDWNRRVNEKVKKVKEDAERVLRELEETAR

SEQ ID NO: 11538 - protein, 59 aa, Artificial Sequence
  Synthetic sequence.
SLEETITKVVEESKKNIDRLLEEVRKVVEDSRRDLDRVIDEARKVVEKIDRELKRIEKR

SEQ ID NO: 11539 - protein, 62 aa, Artificial Sequence
  Synthetic sequence.
EEAEELVRRVKKRSEDVNKKLDEDVEEMKRRSEKLNKDINKDVDRVRKRLEEVLKRLREAAK

SEQ ID NO: 11540 - protein, 60 aa, Artificial Sequence
  Synthetic sequence.
SLKDEIKKVVDDSRRNLEEVKKEITRVVKESRERLEELERDIERLVEKVTRELDRIEEEG

SEQ ID NO: 11541 - protein, 62 aa, Artificial Sequence
  Synthetic sequence.
EEAKELVEEVIRRSREVNRDLNRRVREVEKESRDANERVKRRVEEVKRRAREVLERLKKAAE

SEQ ID NO: 11542 - protein, 60 aa, Artificial Sequence
  Synthetic sequence.
SLEEDAKRMVDTNEDRVREWERKIDKVVKDSEKRLRELREDAERMVREIKKELEKIRTEG

SEQ ID NO: 11543 - protein, 60 aa, Artificial Sequence
  Synthetic sequence.
AEELVRRLKKASEDSNEKVARLIEEVIKRSKDVNDDLERDLREVKKRLKDVLKRLKEKAK

SEQ ID NO: 11544 - protein, 60 aa, Artificial Sequence
  Synthetic sequence.
SLEEDAKRAVEESKRTLRELEEENKKVVEDIRRALRRLEEDIKRVVEEIRRELDRIRREG

SEQ ID NO: 11545 - protein, 60 aa, Artificial Sequence
  Synthetic sequence.
AEELVRRVKKTIEDVNRKVAKVVKENIKRLREWLKRVEERLKEVKDRLRKVLEDVERAAK

SEQ ID NO: 11546 - protein, 59 aa, Artificial Sequence
  Synthetic sequence.
DVEEDVKRVADDNRRELERWRRDVKKVADEVKDRSRKLERDVERRIREIEKTLEDLRRE

SEQ ID NO: 11547 - protein, 59 aa, Artificial Sequence
  Synthetic sequence.
KEVVKRLKEESKKSNEDVARRVEKLKEELERSTREVERAVRELKKELDEVVREVKERAK

SEQ ID NO: 11548 - protein, 60 aa, Artificial Sequence
  Synthetic sequence.
SIEERLDKLLRDVKRALEELEERIRRSNKRLREAVEKLKKEVEDSNRELDKAVKEVLRRK

SEQ ID NO: 11549 - protein, 59 aa, Artificial Sequence
  Synthetic sequence.
EEAVRTAADLLRRVLERVKRLAEELHRHNKEVLDEARKIARDLHRLNEEVLRRVEEATK

SEQ ID NO: 11550 - protein, 60 aa, Artificial Sequence
  Synthetic sequence.
SIEEDLKRLLDEVRKRSKDLKEEVKRSNDRVREDLKRLKEEIDRLLEEARRRLEEIIRRK

SEQ ID NO: 11551 - protein, 59 aa, Artificial Sequence
  Synthetic sequence.
KELVDRARDKIRESLRRSEKIIEELHEHNKDALRRVREEIKRLKDKLKKVVEEVERATR

SEQ ID NO: 11552 - protein, 57 aa, Artificial Sequence
  Synthetic sequence.
DSVERVKEESERTNREIAKLSKKVEDETRKVLKDLEDISRDTERRSREVLERARRDK

SEQ ID NO: 11553 - protein, 58 aa, Artificial Sequence
  Synthetic sequence.
ELVRELEEVVRENEERVRRLIERNKKLVDDARKRVEELVRRNDKIVKEIEKVVRDIKT

SEQ ID NO: 11554 - protein, 57 aa, Artificial Sequence
  Synthetic sequence.
KSDEEVEKLIREVLKRIEELSREAEKLTDEVRKLLKEISDRVEERSRDVLDKIRRTN

SEQ ID NO: 11555 - protein, 58 aa, Artificial Sequence
  Synthetic sequence.
ELVRKLEKLLEDAERRVRELVKRNKEVVERVKRTVDELKARNKKIVEEIKKVMEEITR

SEQ ID NO: 11556 - protein, 57 aa, Artificial Sequence
  Synthetic sequence.
RELEEVEKKVRTVLEEVRRISEKAEELSRRVLEEARKISEDNEREVRRVVEDVRREN

SEQ ID NO: 11557 - protein, 58 aa, Artificial Sequence
  Synthetic sequence.
DLVERLKELVKKVEDEVRRLVKRNKDIVDDIRRRVEELVRRNKRITDEVRKEADKLRR

SEQ ID NO: 11558 - protein, 60 aa, Artificial Sequence
  Synthetic sequence.
SELEKVKKEIRELLEEVRKISKESEDRSRKSNDELHKSSEEVEKRIRDLLRELEKIVREL

SEQ ID NO: 11559 - protein, 59 aa, Artificial Sequence
  Synthetic sequence.
KDVVKELREVLERAEREARKLIKRNDEILKESEKNARDLIRRTEELLRRAKKRVDELKK

SEQ ID NO: 11560 - protein, 60 aa, Artificial Sequence
  Synthetic sequence.
SDVEEVKKEIARLLEELKRTTDKVKEDSDRSNEEVHRSSEKVKKDIEKLLDELRKVVEEL

SEQ ID NO: 11561 - protein, 59 aa, Artificial Sequence
  Synthetic sequence.
REVVKELEDVLKRAEEVVERLEEKTRRILEESRKNIERLKRETEEMLKRAEDEVKKLKD

SEQ ID NO: 11562 - protein, 60 aa, Artificial Sequence
  Synthetic sequence.
SLVDRVRELIERLLRRLEEIVREVEERLRRSNERLHESSADVERLIRELLERLRDIVRKL

SEQ ID NO: 11563 - protein, 59 aa, Artificial Sequence
  Synthetic sequence.
EDVVRELEELLRRAKERVDELKKRLEELLKESREDVERLKKKTDEALKRAEEEVEKLRK

SEQ ID NO: 11564 - protein, 61 aa, Artificial Sequence
  Synthetic sequence.
RDLEEVKKRIDELLKRVRETTKRVEDELRRSNKELHESSRRVEEEIKKLLEELEDVFRKVK

SEQ ID NO: 11565 - protein, 59 aa, Artificial Sequence
  Synthetic sequence.
EELVRTLEDMLRRAREEIEKLKEKTRKLLEDSERDVKRLIERTTEVLKRARERVEELKK

SEQ ID NO: 11566 - protein, 61 aa, Artificial Sequence
  Synthetic sequence.
SELEEVKKRIDDLLKRLRDIVDTVRKELRKSDKELHDSSKRVEEEIKKLLEELRRIVETLK

SEQ ID NO: 11567 - protein, 59 aa, Artificial Sequence
  Synthetic sequence.
REVVETLRRVLKRAEDDVRRLLEELRELLERSKRNVERLIERTKELLKRAEDEVKKLED

SEQ ID NO: 11568 - protein, 61 aa, Artificial Sequence
  Synthetic sequence.
SLLEKVEEEVRRLLKRLRDIVEEVRRLLEESNERAHRSSKKVKEDIDELLKELEDVVRRVK

SEQ ID NO: 11569 - protein, 59 aa, Artificial Sequence
  Synthetic sequence.
KDLVKTLEDILERAEREVKKLEDRLRKLLEDSKRNAEELIKRTEDVLEEALRRVEELKK

SEQ ID NO: 11570 - protein, 59 aa, Artificial Sequence
  Synthetic sequence.
SEAERVREILKDAEKKIRDILRRLREINRESARRIEDIKRKLDEILKRNEDDVRRLEKD

SEQ ID NO: 11571 - protein, 56 aa, Artificial Sequence
  Synthetic sequence.
VEDAERTVRELIKRVEEALERAERASRELIKTVEKVLEEVERRNRKSNEELKEATR

SEQ ID NO: 11572 - protein, 60 aa, Artificial Sequence
  Synthetic sequence.
SLEEEAKELVKRVRDELRKIERTIEKIVEDSRRRLEENRKRNKELIERVEKELRELKKRV

SEQ ID NO: 11573 - protein, 60 aa, Artificial Sequence
  Synthetic sequence.
ARDILREAKKMLEKVLRDLRRVLEELRKENEKVLRELEEISKETEDRLREVLRELRERTR

SEQ ID NO: 11574 - protein, 57 aa, Artificial Sequence
  Synthetic sequence.
SVEDEVREVAKKIRRILEKLKRELDRHSKKIEDILEEIRDKNEKAKEEIEEVLRRRL

SEQ ID NO: 11575 - protein, 59 aa, Artificial Sequence
  Synthetic sequence.
KEDVERVKRELEKVLRELAEEVRESLERVSEVAERLKRENDEVNDRLKKMLEDLLRKAT

SEQ ID NO: 11576 - protein, 56 aa, Artificial Sequence
  Synthetic sequence.
DEVEEVIRRVEESNKRVNEENDRVVRESKEIVRKVEEDNRRAIKESEEMLDRVAKD

SEQ ID NO: 11577 - protein, 56 aa, Artificial Sequence
  Synthetic sequence.
EEDLRRVVDKSRKNVEEVERKNRDVLRRIDKRAKELEDRNREVLKKIEKTIRDLEK

SEQ ID NO: 11578 - protein, 56 aa, Artificial Sequence
  Synthetic sequence.
SEVDEVIRRVEKSNKDVNDENKRVIDRSKELNREVNERNKEAIKRSRDLADEVRRD

SEQ ID NO: 11579 - protein, 56 aa, Artificial Sequence
  Synthetic sequence.
EERLREVVKRSEDNVRKVEEDNRRVLEESTRNVKEVKERNEKVLEEIRKTLEDLER

SEQ ID NO: 11580 - protein, 56 aa, Artificial Sequence
  Synthetic sequence.
SEVDKVRKELEDMAREIEKRAEDVIREIKRSNEEVNRTNEKVIRDSERMLEKAERD

SEQ ID NO: 11581 - protein, 56 aa, Artificial Sequence
  Synthetic sequence.
EERLDRVREKLERIVREIEDRLRKVLEDSRRNVEEVRRRNEEAVKKIRRILEELER

SEQ ID NO: 11582 - protein, 56 aa, Artificial Sequence
  Synthetic sequence.
DEVDDVIRDVDRTNEEVERENRRVIEEVRKSNEEVNKKNADAEKRSREMAERAAED

SEQ ID NO: 11583 - protein, 56 aa, Artificial Sequence
  Synthetic sequence.
KEKLDRVLERSKKTVEELEKRNREALDRSRRNVEEVEKRNREVVKEIAERVRRLKK

SEQ ID NO: 11584 - protein, 56 aa, Artificial Sequence
  Synthetic sequence.
SEVDKVVEDVKRMLKEVEDRNEKVIRDVEKMLREVEEKNKRVIEDSERVAKEAADD

SEQ ID NO: 11585 - protein, 56 aa, Artificial Sequence
  Synthetic sequence.
KEKLDKVLEEIREIVKRLEDRNREALRRIKEIVDRLEKRNRKVVEDVERIVREIER

SEQ ID NO: 11586 - protein, 56 aa, Artificial Sequence
  Synthetic sequence.
SEVDEVIKRIEETNRRVEEMNKDAIRRVKESNKRVEERNKEVIERSKKLIDDVRRD

SEQ ID NO: 11587 - protein, 56 aa, Artificial Sequence
  Synthetic sequence.
EERLRKVLKDSERTVKELEKRNRRVLEESDKEVKRLEKENRDVVDEIRERAKEIER

SEQ ID NO: 11588 - protein, 56 aa, Artificial Sequence
  Synthetic sequence.
SEVDKVITELEKMLRRVKEENKRVIDESRRALEEVEKRNREVIERSDEMARRAAED

SEQ ID NO: 11589 - protein, 56 aa, Artificial Sequence
  Synthetic sequence.
EERLREVLERIARRVRELEERNKKVVKEIEERVRELERRNREVVKKIEEKVKRLET

SEQ ID NO: 11590 - protein, 56 aa, Artificial Sequence
  Synthetic sequence.
DEVRKVIKELRDELRRVEELNKEVIDRSRKLVEDIARESKEVIERSRKLLDDVRKD

SEQ ID NO: 11591 - protein, 56 aa, Artificial Sequence
  Synthetic sequence.
REDLERALKEIEETIRRLEKRNRDVLKEIEDEARRLEEENRKVLKEARKIVEDIKT

SEQ ID NO: 11592 - protein, 56 aa, Artificial Sequence
  Synthetic sequence.
SEVDDVTRKLERILEELTETSERVVRTSRRVAEELEKRSKEAVERSRKLAEEVARD

SEQ ID NO: 11593 - protein, 56 aa, Artificial Sequence
  Synthetic sequence.
REKLERVLEEIRRRIEELSEKNRKVVKDIREIVRKLTERDEKVVREIKKIVDDIET

SEQ ID NO: 11594 - protein, 56 aa, Artificial Sequence
  Synthetic sequence.
SEVDEVTREVEELIREVEKLSEDVIRTSKELAKRAEKLSREVIKRSEELIDEVRRD

SEQ ID NO: 11595 - protein, 56 aa, Artificial Sequence
  Synthetic sequence.
KKKLEDVLREIAKKVREIEERDRKVVEEIREILKRLEDENREVLKKIRRIAEEIRR

SEQ ID NO: 11596 - protein, 56 aa, Artificial Sequence
  Synthetic sequence.
DEVRKVIKELEDRLREVEKKSKDAIDTSREMLKRVDDENKDVKRRAEEILKRVDED

SEQ ID NO: 11597 - protein, 56 aa, Artificial Sequence
  Synthetic sequence.
EEELRKLLEDIREKVERIVKRDEDVVREIEEEARRLADENRKVLEEIERIIRELER

SEQ ID NO: 11598 - protein, 56 aa, Artificial Sequence
  Synthetic sequence.
REVDEVTRRIKELNDELERRVRRAKERIEELNKRVNREDEEIVDRVRKLNDELAKD

SEQ ID NO: 11599 - protein, 59 aa, Artificial Sequence
  Synthetic sequence.
EDVKRKLKEVVDESRRTVDEIRRELERVVEKSRKNIEEVKKHTREVLKRSEETARELKK

SEQ ID NO: 11600 - protein, 56 aa, Artificial Sequence
  Synthetic sequence.
SEVDRVLEEIRKLNEDLNRRVDDATRKIRDLNRKLNEDVKKVTEDIKKLNEDLRKD

SEQ ID NO: 11601 - protein, 59 aa, Artificial Sequence
  Synthetic sequence.
EEVKRKLEKLVRESERNVREVKKKLDEVRKESKTNADKVREELKRVVEESERTVRELEK

SEQ ID NO: 11602 - protein, 56 aa, Artificial Sequence
  Synthetic sequence.
SEVDEVEKDIERLLEELRERVKRVTDEIRKLNKELNETDTDIVRKIRELLERLERD

SEQ ID NO: 11603 - protein, 59 aa, Artificial Sequence
  Synthetic sequence.
EEVKRRLEEVLRKVKRELDRIRDELRRVVEESETNVRDVRRHTEEVVKEVEDEVRRLEK

SEQ ID NO: 11604 - protein, 56 aa, Artificial Sequence
  Synthetic sequence.
SEVEELERRIRELLRRVKRIDEEIVRRIRELNKELNRRDERIVETVRELVERVARD

SEQ ID NO: 11605 - protein, 59 aa, Artificial Sequence
  Synthetic sequence.
EEVKKRLEDVLRRVREEIERLKKHTDDVLRESEKNAEDVKKHTDDVVREIEERIRELKK

SEQ ID NO: 11606 - protein, 56 aa, Artificial Sequence
  Synthetic sequence.
SEVEEVIKEIEKLNEDVNRIDKEIVKRIRDLNREVNERDKEIVKEIKRLVEEVRKD

SEQ ID NO: 11607 - protein, 59 aa, Artificial Sequence
  Synthetic sequence.
EEVKDRLRKVLESSSDNVRRVTEHTDKVLEESRKNIEDVKKHTDEVVKEIEKEVRELKK

SEQ ID NO: 11608 - protein, 56 aa, Artificial Sequence
  Synthetic sequence.
DEVKEVIRRAEKLNEKINDILRRVEEEIRRTLDEVRRRDEKIVKEIRDLMRELSED

SEQ ID NO: 11609 - protein, 59 aa, Artificial Sequence
  Synthetic sequence.
EEVKRELEEVVKESEKNIREVTDRLRKVLEESTKIVEELEEHTKRVVDEIRKRADELRR

SEQ ID NO: 11610 - protein, 60 aa, Artificial Sequence
  Synthetic sequence.
SLEEEIDRVLDEIRRIIEEIKKHTTEVLEESKRNIEEVKKHTDEVNEKSRRDIEKIKREV

SEQ ID NO: 11611 - protein, 59 aa, Artificial Sequence
  Synthetic sequence.
KEKVRKVIEEIKKIAEDVARRDKEMVDRSREINKKVNEEDKKIVEDSKRIIEDVKRKTD

SEQ ID NO: 11612 - protein, 60 aa, Artificial Sequence
  Synthetic sequence.
SLEKEIKDALDRIKKDIEDSARRTKEVNDKSKEIIDRLKKHTDDVNDESRRRIKEIKDEV

SEQ ID NO: 11613 - protein, 59 aa, Artificial Sequence
  Synthetic sequence.
KRLVKEVIDRLDEIVEDVKRRDEEIIRTSEKLLRDVARLDEEIAKRSRDLLRDVERKVK

SEQ ID NO: 11614 - protein, 60 aa, Artificial Sequence
  Synthetic sequence.
SLEERLKKVLKEVDERIREIKKHTDKVNEESRDKIRKLKEELDRVNRESEEEARKIKSEV

SEQ ID NO: 11615 - protein, 59 aa, Artificial Sequence
  Synthetic sequence.
DKDVRDVEEEIRKLLDEVRKLDEEMVERSKKLARTVERLVKEVIRESKEIIRKVKEETD

SEQ ID NO: 11616 - protein, 60 aa, Artificial Sequence
  Synthetic sequence.
SLEEEIERVLRKVEKEIRKIKERLDEMLKEIRERIERSKRRTDKVNEDSRRRIEEIKRRV

SEQ ID NO: 11617 - protein, 59 aa, Artificial Sequence
  Synthetic sequence.
KEDVKKVKKDIDKLLKEVREEVKEAEDRIRRIAEEVDKEDKRMIETSRRIIRKVDEDVR

SEQ ID NO: 11618 - protein, 60 aa, Artificial Sequence
  Synthetic sequence.
RIEDKLRKVLEEVERIIREIRKRLEDANDDSRREIEESKEDTDRVLEEIRRRIEEIKREV

SEQ ID NO: 11619 - protein, 59 aa, Artificial Sequence
  Synthetic sequence.
DEDVERVLRKIKELLRRVEEEVERVIRESKKLLDEVRKEDEEIKKTLRDIVREVARKVK

SEQ ID NO: 11620 - protein, 60 aa, Artificial Sequence
  Synthetic sequence.
SLEETVEKALKDSKDNIKRLKERVDRVLEESRRTIEELRDRARRVREEVKKRLDELRRRG

SEQ ID NO: 11621 - protein, 59 aa, Artificial Sequence
  Synthetic sequence.
KDAVKKLIDDVRKINKELNDTVEKLARDVEEINKEVARRVEKLVRELEKIDEDVTRREK

SEQ ID NO: 11622 - protein, 59 aa, Artificial Sequence
  Synthetic sequence.
SLEEKVREVLKRSEDNIRKLEDESRKVLEDSERNLRKLKKEVDDAADRVRRKIKELRER

SEQ ID NO: 11623 - protein, 59 aa, Artificial Sequence
  Synthetic sequence.
ARIVDKLIREVEKINRDVNEKVRTSIEDLKRINEELNERVERLIREVERILKEVEDRAR

SEQ ID NO: 11624 - protein, 60 aa, Artificial Sequence
  Synthetic sequence.
SLDERVERALEKSEENLRRLKKRSEEVLEEVKEAIKELKRRSREALEDVRRVLDELRKDG

SEQ ID NO: 11625 - protein, 59 aa, Artificial Sequence
  Synthetic sequence.
AKVVEELIKRVEEINTRLNEKVKKSIDDVRRIIEEVRRRVEKTIRDVERIKEEVERRRR

SEQ ID NO: 11626 - protein, 60 aa, Artificial Sequence
  Synthetic sequence.
RLEDEVRKMEKEVREEVKRLEDESRKVLEESRRNLDKLREESKRVLDTVRERIKDLRRRG

SEQ ID NO: 11627 - protein, 59 aa, Artificial Sequence
  Synthetic sequence.
AKVVKELIDRVRKILEDVEREVKKSIEEVKEINRRLNEEVKKTIEEVKEIVKEVTERAK

SEQ ID NO: 11628 - protein, 60 aa, Artificial Sequence
  Synthetic sequence.
SLEDEVRDMDRKVDEALKRLRDESKKVHDDNKREIDKLRKESEDVHRENKETLDRLRERG

SEQ ID NO: 11629 - protein, 59 aa, Artificial Sequence
  Synthetic sequence.
KDAVRELKRDVERIIKEVDELVKRSIEESRRITEEVARRVKETIDRSRKITKELRDRAD

SEQ ID NO: 11630 - protein, 60 aa, Artificial Sequence
  Synthetic sequence.
SEIEELEERLERSTRDVEKKVRDTIRESERSTEEVARRVDESIKRLERVVEEVEERVRRI

SEQ ID NO: 11631 - protein, 59 aa, Artificial Sequence
  Synthetic sequence.
EEIRKRVEDVAKKVKEDTDKLRDDSRKVHERNEEESRRLEEKSERVLRRVEEILKEIER

SEQ ID NO: 11632 - protein, 60 aa, Artificial Sequence
  Synthetic sequence.
SEVDRLITELRRSTKRVEEEVRRLIEDSKRSTREVAERVKESIRRVEKVVEEVKRRVDRI

SEQ ID NO: 11633 - protein, 59 aa, Artificial Sequence
  Synthetic sequence.
EDIRRKIEEVVKEVKEETDRLREEAEKVVRENRKASEKLRRESEEVVERVKKKVDDTET

SEQ ID NO: 11634 - protein, 60 aa, Artificial Sequence
  Synthetic sequence.
REVEEIIKELRKSTTDVAETVERLIKRSRESTKEVADRVKRLIDEVRRVVEDVERKVRRI

SEQ ID NO: 11635 - protein, 59 aa, Artificial Sequence
  Synthetic sequence.
ERIEKEIEDVVREMEERTKRLEKRAEEVNEENKRRSDELRKRIKKAVDEVEKRLDEIRN

SEQ ID NO: 11636 - protein, 60 aa, Artificial Sequence
  Synthetic sequence.
SEVEDLIKKLEESTEEVDRRVKKLIEDSRRSTEDVDRKVKELIKDVRRVIREVEERVARI

SEQ ID NO: 11637 - protein, 59 aa, Artificial Sequence
  Synthetic sequence.
DRIRETVERVFRKVERKTRELREEIREVDERNRRDSKRLRDEVERVARELEKKLKEIDE

SEQ ID NO: 11638 - protein, 60 aa, Artificial Sequence
  Synthetic sequence.
EEVERLIRELEESTDRVAREVERLIRESRKSTEDVRRKVDKLLREVREAIKEVEERVRRT

SEQ ID NO: 11639 - protein, 59 aa, Artificial Sequence
  Synthetic sequence.
EEIKRKIDKVVEEVRRRTEELRERIERVNEENKEASERLERKLREMAKELDKKLKDIRR

SEQ ID NO: 11640 - protein, 60 aa, Artificial Sequence
  Synthetic sequence.
KDVDELITRLEESTKRVAEEVKRLIEESRRSTERVAREVRRSIEEVKRVIREVEEKVRRI

SEQ ID NO: 11641 - protein, 59 aa, Artificial Sequence
  Synthetic sequence.
KDIERKIREVVEKVERDTRRLEEEAKKVNEENEKASRDLEKESKDAADTLEKKLRDIER

SEQ ID NO: 11642 - protein, 60 aa, Artificial Sequence
  Synthetic sequence.
DEVEDLIRRLEESTKDVAKKVDDTIDESRKSTKDVAEAVKRSIDEVRRVVREVEERVRRI

SEQ ID NO: 11643 - protein, 59 aa, Artificial Sequence
  Synthetic sequence.
DRIRDEIRKVVERAKERTKELEDKSKEVNDRNRETSERLKKESEDVVREVKKELDRIRK

SEQ ID NO: 11644 - protein, 60 aa, Artificial Sequence
  Synthetic sequence.
SEIDKVETEVKKLDKELEELVKRSSEKTEKLDRELEKLLRDVVREVEKLLKEIEDLVRRR

SEQ ID NO: 11645 - protein, 59 aa, Artificial Sequence
  Synthetic sequence.
KELAERIKKVARESEETVRRLEERLERDSERSRETLRRLAEAVRRVIEKVKEILERLRT

SEQ ID NO: 11646 - protein, 60 aa, Artificial Sequence
  Synthetic sequence.
DKMEEVRRTVEKLLEDLNRLSEEVIRTSEKLLEELRRLSEEVERDTERLLKELEKMKRDG

SEQ ID NO: 11647 - protein, 56 aa, Artificial Sequence
  Synthetic sequence.
DEDIKRVLDEVKKILDDNREKNKRALDRVREEVKRLEDRNREVVRKVRKIVEDLRR

SEQ ID NO: 11648 - protein, 60 aa, Artificial Sequence
  Synthetic sequence.
RVDERLDTVLKRVEETVRENKKKNDELLERSKENIDRLKKRLDDLLDKVRREAEKLKREV

SEQ ID NO: 11649 - protein, 59 aa, Artificial Sequence
  Synthetic sequence.
EEVVKEVEERIKKLLKEVNDTSKDAERRLRETNERLNEIVKEVEKRIRELSEEVRKRVK

SEQ ID NO: 11650 - protein, 60 aa, Artificial Sequence
  Synthetic sequence.
SVDERLDEVLERVKEDMDRNRRKNDESLREDEENVRRNKKETDESVKRVEERVRELKKRV

SEQ ID NO: 11651 - protein, 59 aa, Artificial Sequence
  Synthetic sequence.
EEVVKTVEEDIKRLLKEVNKVSDEAHKRNKELNERVNRVNKEAHKRNEDLLREAERKVR

SEQ ID NO: 11652 - protein, 60 aa, Artificial Sequence
  Synthetic sequence.
DVKERLDKVLEEVKRDIERNKRRNDKLLKESKRIVEENKKKNEKSLEEVKRKADDLRTKV

SEQ ID NO: 11653 - protein, 59 aa, Artificial Sequence
  Synthetic sequence.
KEVVEKVEREIERLREEVNRVSKKAEEDVERTNRELNRVSDEAHKTNERLLEKVERDVK

SEQ ID NO: 11654 - protein, 56 aa, Artificial Sequence
  Synthetic sequence.
SSEDKARELVRTLEEALRELEREMRKVVEDSKKTLKELEERNRRLEEELEKVLERV

SEQ ID NO: 11655 - protein, 55 aa, Artificial Sequence
  Synthetic sequence.
DRVIEELKELLERLRERVERVIKKVKDLNEELRRRNDKVAKDLKRLLKELEDRTR

SEQ ID NO: 11656 - protein, 58 aa, Artificial Sequence
  Synthetic sequence.
SIEDEIRKVLTRLRRVLEEIKRSSKEVADELKRVLEEIKRSSEENNKEVEEVLKEIEK

SEQ ID NO: 11657 - protein, 58 aa, Artificial Sequence
  Synthetic sequence.
REVREVIERLERMLEELERHNRDVERDLRRVLEEAKRHNEESLRRSKELLKKVRDEIE

SEQ ID NO: 11658 - protein, 59 aa, Artificial Sequence
  Synthetic sequence.
SIEDEIRKLKEDIKRVLDKVRRDNERLKERLDKVLEDIRRSSEDNNRKLEEVLKRIRDK

SEQ ID NO: 11659 - protein, 59 aa, Artificial Sequence
  Synthetic sequence.
EERVREVIEKLKETLERLKREDKEVADRAEKLLREAEEHNKRSLDESRRVLEELDEEIR

SEQ ID NO: 11660 - protein, 59 aa, Artificial Sequence
  Synthetic sequence.
SIEDRVRRVLEELEEVLERIKDSSRRVVEEAEDVLRKLEEENRKLERDLERVLKEIEEE

SEQ ID NO: 11661 - protein, 59 aa, Artificial Sequence
  Synthetic sequence.
ERELEEVEKRLREVLRRLEKHNEDVIRDLRRLLEEAADEDRRVIKTLRDVLRELKKRIK

SEQ ID NO: 11662 - protein, 59 aa, Artificial Sequence
  Synthetic sequence.
KIEEKIRRLEEDLDRVLDEIRRNSERVTKEAEEVLERLKRENEKLKKRLEEVLEEIRRR

SEQ ID NO: 11663 - protein, 59 aa, Artificial Sequence
  Synthetic sequence.
ERRVDKVIEDLKRVLDEARRHNEDVVRKLKEALDKLREDDDRVRRDLEKKLRDLERRIE

SEQ ID NO: 11664 - protein, 59 aa, Artificial Sequence
  Synthetic sequence.
SIREKIRELEERLEEVLRRIEENSERVLREAERVLKEIKDNSKRNNEKLERALEEIRKL

SEQ ID NO: 11665 - protein, 59 aa, Artificial Sequence
  Synthetic sequence.
EREVDRVIRKLEDVLRKLEEHNRRVVERLKRLLEELKKHNEDSLRKSEEVLRKLEEDAR

SEQ ID NO: 11666 - protein, 59 aa, Artificial Sequence
  Synthetic sequence.
SIEERVRELMRDLERVLKEIREHSKRVIEEAKRVLEEIERNSERNNKELEEVLDEIRKR

SEQ ID NO: 11667 - protein, 59 aa, Artificial Sequence
  Synthetic sequence.
EKELEEVERRLRKVLEDLRRNNKEVVDRLKEVLERLKEHNRRSLDESRKVLRELKERIR

SEQ ID NO: 11668 - protein, 59 aa, Artificial Sequence
  Synthetic sequence.
SIEDRIRELEKRLEKVLREIEEHSKKVVREAEKVLREIEENSRRNNKRLEEVLDEIRKR

SEQ ID NO: 11669 - protein, 59 aa, Artificial Sequence
  Synthetic sequence.
EEDVRKVIRDLEDALRRLKEDNEDVVRRLKEVLKELRKHNKRSLDESEKVLRELRERIR

SEQ ID NO: 11670 - protein, 58 aa, Artificial Sequence
  Synthetic sequence.
SIEDEVRKLAKDLDDVLREIEENSKRVLEKLDEMLERIREHSERVVERAKRVLDEIRK

SEQ ID NO: 11671 - protein, 59 aa, Artificial Sequence
  Synthetic sequence.
ERELRTVIRKLKEVLDRLREHNKRVVEELEEALKELEKDNRKVVEDLERMLEELKREVN

SEQ ID NO: 11672 - protein, 58 aa, Artificial Sequence
  Synthetic sequence.
SIEEEIEKVKKRLEDVLREIKKHSEEVKKKAEDVLRKIEKHSRDNNRKAEEVLKDIAR

SEQ ID NO: 11673 - protein, 59 aa, Artificial Sequence
  Synthetic sequence.
EEEVRKVIEELEELLERLRRNNEEVVRDLERVLEELKRDNEKSVEDSERLLTELKREIE

SEQ ID NO: 11674 - protein, 61 aa, Artificial Sequence
  Synthetic sequence.
SVKEELDDLERKVDEDVRRIRRELDEVLKESRENVKRSKDHLDEVLRRVEEAVKRLIRERG

SEQ ID NO: 11675 - protein, 59 aa, Artificial Sequence
  Synthetic sequence.
KEKVDRAKKEIEDLLREVRKRVEDVAREIKRLNEDVNRINDKVTREIEKLLEDVDRKVK

SEQ ID NO: 11676 - protein, 61 aa, Artificial Sequence
  Synthetic sequence.
SVEDKLRELEKRVRDVHRKNEEDLDRLLRKSHEMHKRNEDELRKVLEEVRDAVRKLLKEKG

SEQ ID NO: 11677 - protein, 59 aa, Artificial Sequence
  Synthetic sequence.
DEEVERVIKRIDDLLKEVHKILREVIRRIEKSLEEVHKRVRDLVREIKELLKEVDRKAK

SEQ ID NO: 11678 - protein, 60 aa, Artificial Sequence
  Synthetic sequence.
SLEDKVRELERKSRENIKRNEEELRRAKRESEENIKRNEEELKRNKERSDRMIEKIRRET

SEQ ID NO: 11679 - protein, 59 aa, Artificial Sequence
  Synthetic sequence.
KDVVERLREALEDANRRVNERNRELIKRLKEANKKVNEENEDLLRESEEILRRVEEEVR

SEQ ID NO: 11680 - protein, 60 aa, Artificial Sequence
  Synthetic sequence.
SIEELVKDAKRRSKENADRNREKLRKVEDDSRRNIEENERRLEENEKRSREVIKELADRT

SEQ ID NO: 11681 - protein, 59 aa, Artificial Sequence
  Synthetic sequence.
EDVVEKLIRELEEINREVNKRNDDLIRELREINKKVNEENKRLMKESDDILKEVRERVR

SEQ ID NO: 11682 - protein, 60 aa, Artificial Sequence
  Synthetic sequence.
SIEDLVRELKKKVDEVAEDLRRKVREALERSRENIDRLKKHSEENLRRSEEVVDKLRKET

SEQ ID NO: 11683 - protein, 59 aa, Artificial Sequence
  Synthetic sequence.
DKVVKKLIKEVDDILREVTKLVEKLIRELEDINRKVNERNRRLAEESRKILDEVEKRVR

SEQ ID NO: 11684 - protein, 60 aa, Artificial Sequence
  Synthetic sequence.
SLDEKVEELRREVDEAIKDIKEKVKRANEESERNIRELEERVKRNLEKSKKAIEELARRV

SEQ ID NO: 11685 - protein, 59 aa, Artificial Sequence
  Synthetic sequence.
EKVVEKLRKEVKEVLKEVEDRVRKLIREVERINEEVNRRVKELLEESEKILDDVDKRVK

SEQ ID NO: 11686 - protein, 59 aa, Artificial Sequence
  Synthetic sequence.
EVEERVKELEKEVEEVLKESEDHVRKSEEDLRRALEESRKHIEDLERKLKKVLEELERK

SEQ ID NO: 11687 - protein, 59 aa, Artificial Sequence
  Synthetic sequence.
KDLLKKLEEEIRKIITENRKLNRDLHRENERIIRDVRRENKRLADELEEIIKEVRERLK

SEQ ID NO: 11688 - protein, 59 aa, Artificial Sequence
  Synthetic sequence.
SVEEKVEELEKEVRKALEDSKRHVDESEKRARDLARRSRELVRRWEEEVEKIVRELETR

SEQ ID NO: 11689 - protein, 59 aa, Artificial Sequence
  Synthetic sequence.
EDLLRKLADEIRRILEDNRDLNRRLNEKNKEVLDRLEELNKTLADELRDIIRKLEKELE

SEQ ID NO: 11690 - protein, 61 aa, Artificial Sequence
  Synthetic sequence.
KELEDVVRKIEEDLRRLEESNEKVHRENEEIIRRVDETNKKVMKEIKEMEKKVRDLVRERK

SEQ ID NO: 11691 - protein, 54 aa, Artificial Sequence
  Synthetic sequence.
EVERVIERLEKVVRDSAANVERSIRELERVVEESSKHVEDVKRELKKVVDEIRT

SEQ ID NO: 11692 - protein, 60 aa, Artificial Sequence
  Synthetic sequence.
SDLDRVREEAERVVETVRRSNKEVKKKLDRELKRLRDSNKDVVDKIKRVLEKLRELIKRR

SEQ ID NO: 11693 - protein, 54 aa, Artificial Sequence
  Synthetic sequence.
EIEEVRDKLRKVVEESSKHAEEVKRDLERVVEESTRNVDRVREDLKRVLDEIET

SEQ ID NO: 11694 - protein, 60 aa, Artificial Sequence
  Synthetic sequence.
SLRERIEELKEELRRVLEELERRHRETEKKLEEVLKELKRRHEELVRRLRKALKEIKDKL

SEQ ID NO: 11695 - protein, 59 aa, Artificial Sequence
  Synthetic sequence.
EEAIKDVERKVKKLLKELRDLSEKVRKESDDLLRRLRRESERVERETRKLEKELRDEVR

SEQ ID NO: 11696 - protein, 60 aa, Artificial Sequence
  Synthetic sequence.
SKADEVRKKVDDINKRLRETTDRVAEETKKLIEELKKSAEEVKREVDKINKDLRKLAEDG

SEQ ID NO: 11697 - protein, 56 aa, Artificial Sequence
  Synthetic sequence.
EKDVERLTRKSEKVVREIEKKNEELKRELTEVLKDDERRNKELVEDSRRVLEEIRT

SEQ ID NO: 11698 - protein, 60 aa, Artificial Sequence
  Synthetic sequence.
DKARDVARKVEELLERLRELSERVSRTSEDLNRKLKKISEDVSRTSKKLLDELRRAKEKG

SEQ ID NO: 11699 - protein, 56 aa, Artificial Sequence
  Synthetic sequence.
EEDVRRLKERVKKVMEELERRHERDKEKSRRVVEKLERDHREDLKRVKKVLEEITK

SEQ ID NO: 11700 - protein, 59 aa, Artificial Sequence
  Synthetic sequence.
SKADKVEEEVKELLKRAKALSDRVSEESRRLLKELRDSARRVEEEVKRLEEELRKLKED

SEQ ID NO: 11701 - protein, 56 aa, Artificial Sequence
  Synthetic sequence.
EEKVRRVLREVREMLKDLEKKHRDDIKRVTEVLKEDEEKNRDLMRKVDKFLEDIRK

SEQ ID NO: 11702 - protein, 59 aa, Artificial Sequence
  Synthetic sequence.
SKAEEVEELVKKLLAEVKKSLDDVRRTVEKLLREVRKSLREVEETVKRLLKRLKDLKDD

SEQ ID NO: 11703 - protein, 56 aa, Artificial Sequence
  Synthetic sequence.
EEKVEKLERDVRRALERDTRENKKLEDRVETALREDKKRNDDLREDVKRVLEEIRT

SEQ ID NO: 11704 - protein, 61 aa, Artificial Sequence
  Synthetic sequence.
DELEELIRRIEKLIRDSRKITDDVRKEIEKTIRESREINKEVHERNRKLLEEITEVVKRDG

SEQ ID NO: 11705 - protein, 56 aa, Artificial Sequence
  Synthetic sequence.
EEDLRRVDDRVRRVVEESEERLRRVYEESRKVVEESRKHLKEDLDRVKRTVEEIER

SEQ ID NO: 11706 - protein, 61 aa, Artificial Sequence
  Synthetic sequence.
SELERVEEEIKKLIRTSREINKEVAKRIEETIKESRDINKEVVDRIRELIERLREVVKRDG

SEQ ID NO: 11707 - protein, 56 aa, Artificial Sequence
  Synthetic sequence.
EKELKRVEDEVRKVVEESKDHLRKVYEKSKKVVEESKEHLDRVLREVEKEIEEIRR

SEQ ID NO: 11708 - protein, 61 aa, Artificial Sequence
  Synthetic sequence.
SELERVEEEIKRLIDESERINRKVVKEIEDTIRTSEEINREAHRRNRELIKRVEDVVRTKG

SEQ ID NO: 11709 - protein, 56 aa, Artificial Sequence
  Synthetic sequence.
EKELRRVEEEVRKVVRDSERHLDEVYKRSKEAVDRSKKHLDKDVEEIDRVVKEIER

SEQ ID NO: 11710 - protein, 61 aa, Artificial Sequence
  Synthetic sequence.
RELEEVKKEIDRLIREVEEVNKDVVRKIKETIRRSREINKRVVDEIRRLIKELDDVVKTKG

SEQ ID NO: 11711 - protein, 56 aa, Artificial Sequence
  Synthetic sequence.
ERELRKVLEKVERVVKKSRDHLDRVYEDSERVVRESEKHLDEVLERVREEIERIRK

SEQ ID NO: 11712 - protein, 61 aa, Artificial Sequence
  Synthetic sequence.
RELEEAEKTIEKLIKESRDINEKVARDIDKTIREIREEMKRVEEEIRDLIRRIREVVKRDG

SEQ ID NO: 11713 - protein, 56 aa, Artificial Sequence
  Synthetic sequence.
ERKLREVTKRVDKVLEESRRHLEEVYRKSKEVVDEIRKRLREVLKRVREDVERIER

SEQ ID NO: 11714 - protein, 61 aa, Artificial Sequence
  Synthetic sequence.
SELDEVAKRIKELIKESRRINEEVERRIKKTIDEVRKINKEAAKTVDDLIKTIRDVVRRKG

SEQ ID NO: 11715 - protein, 56 aa, Artificial Sequence
  Synthetic sequence.
EKKLRDLEEEVRRVVEESKDHLRKVYERSRKVVEESRKHLDEVLTRVDKVVKDIRT

SEQ ID NO: 11716 - protein, 60 aa, Artificial Sequence
  Synthetic sequence.
SELEEAEKKIERLIEEVRKMNKTVHEENERLIEDLRRVVKEAHERNKRLIEELEDVVRKI

SEQ ID NO: 11717 - protein, 59 aa, Artificial Sequence
  Synthetic sequence.
KDVEKKLKDVLDKVRKVVEESRRHLEESLDKVRRVAEEIRKRLKESKDRVDEAAKEIRR

SEQ ID NO: 11718 - protein, 60 aa, Artificial Sequence
  Synthetic sequence.
DELEEAEKRIKELIDRLEEFNEEVHRRNEKLIRELREVLKRVEEEIRRLIKELRDEVRKI

SEQ ID NO: 11719 - protein, 59 aa, Artificial Sequence
  Synthetic sequence.
KRVEERLERVLREVEEVVKRSRKHLEDSLREVEKAVKEIRDRLDEVLRRVEKAVEEIRT

SEQ ID NO: 11720 - protein, 60 aa, Artificial Sequence
  Synthetic sequence.
SELEDAERKVKELIDRLREVNRKVHEDNKRLIDELRDVNRKVAEEVRRLIEELKEVARRV

SEQ ID NO: 11721 - protein, 59 aa, Artificial Sequence
  Synthetic sequence.
KRVRDRLKEVEDRVRKVVEDSRRHLEKSLREVEEVIRESREHLEEVLRRVKEEADKIRK

SEQ ID NO: 11722 - protein, 60 aa, Artificial Sequence
  Synthetic sequence.
SELEKVREDIKRLIEDLRRANDRVRRESERLNRELREVNKRVHDDNRRLIEELRRLVKDI

SEQ ID NO: 11723 - protein, 59 aa, Artificial Sequence
  Synthetic sequence.
ERVRDELRKLLRTVEKVVEESKKHLKEVLDRSREVVEESKTHLEKSLTDVEKVVREIRT

SEQ ID NO: 11724 - protein, 60 aa, Artificial Sequence
  Synthetic sequence.
STLDEAVKRIDELIKRLREVNEEVARRSKRLNDELKKVNEDVARKIEELIRRLRDVVRKI

SEQ ID NO: 11725 - protein, 59 aa, Artificial Sequence
  Synthetic sequence.
KRVEEELERVLRKVEKVVKESRDHLEEVLRRSEDMARRSREHLEELLKRVEKVVREIRT

SEQ ID NO: 11726 - protein, 60 aa, Artificial Sequence
  Synthetic sequence.
SELEEAIRRIEKLIRELREVNKRVAEEVKKSNEESKEVNKRVKDDVKELIERLRDIVKKV

SEQ ID NO: 11727 - protein, 59 aa, Artificial Sequence
  Synthetic sequence.
KDVEDKLREVLRRVEKVAEESRRHLEKVARESEEVVKRSRKHLEEVEREVKKVIDEIRK

SEQ ID NO: 11728 - protein, 60 aa, Artificial Sequence
  Synthetic sequence.
RTLEEVEKEVEKLIEDLRRVNREVAERIKKSNEDSKRVVERVEDEIRRLIEELKDMVRKV

SEQ ID NO: 11729 - protein, 59 aa, Artificial Sequence
  Synthetic sequence.
ERVDKRLRDVLRKVKKVAEESRKHLEELAERSKEVVERIRRRLEEVLKRVREEAEKIRK

SEQ ID NO: 11730 - protein, 60 aa, Artificial Sequence
  Synthetic sequence.
SELEDAERRIERLIRELRKANEEVARRIEKSNEDSRRVNKKVAEEIERLIKELRDVTKDV

SEQ ID NO: 11731 - protein, 59 aa, Artificial Sequence
  Synthetic sequence.
KRVEEELKRVLDEVKRVIEESKERLKKWLRDSERVVEESRRHLEELRKRVEKAVREIRT

SEQ ID NO: 11732 - protein, 59 aa, Artificial Sequence
  Synthetic sequence.
RVEDEVRKMREKSEKVDREIREAVRRSLTRIKEVVDEIRDEVRRSEDKVKKEIDRLRKE

SEQ ID NO: 11733 - protein, 62 aa, Artificial Sequence
  Synthetic sequence.
EEVDKLLDEVRREADESNTRLRERVKEVNKRNEEVIEELRKRVEEVHRTNEDLIRELRKKTT

SEQ ID NO: 11734 - protein, 59 aa, Artificial Sequence
  Synthetic sequence.
REEEELERVKRRSEKVDEEIKKRLREVAEEVKRSNEEVKKRLEEVLRDSKRKLDELREE

SEQ ID NO: 11735 - protein, 56 aa, Artificial Sequence
  Synthetic sequence.
VRELIRELEESNKRVKDVLRKLIEEVKKSDDELREIVKRLVEEVERSNKELEDRVR

SEQ ID NO: 11736 - protein, 59 aa, Artificial Sequence
  Synthetic sequence.
REEERLKKLKEDSDRVDREIERKAEKVLEESEEVDRDIERKLREVERKSREVLEELKKR

SEQ ID NO: 11737 - protein, 56 aa, Artificial Sequence
  Synthetic sequence.
LEELRKEVEKSNTDLEKIIEDLIRRLKKSNEDVRRTVTELVKEVDRSNKKLEDEVR

SEQ ID NO: 11738 - protein, 59 aa, Artificial Sequence
  Synthetic sequence.
REEEELEKLRERSERVDDEIRKRLREALERSREVDEELRRRAEESKKESDEVIKDLARR

SEQ ID NO: 11739 - protein, 56 aa, Artificial Sequence
  Synthetic sequence.
LDELRREVEKSNEDVRRFLEKLVRDLEESNRRVRERIKRLHEENKKSNDELRKRTK

SEQ ID NO: 11740 - protein, 60 aa, Artificial Sequence
  Synthetic sequence.
SELEELKKKSKKLNDDIERVVEEVLKRSEDINERVKKEVKDVIDRNTDVLRRVKRDVERE

SEQ ID NO: 11741 - protein, 56 aa, Artificial Sequence
  Synthetic sequence.
EEAVRKVEKENRESVEKLKKAVKEVRDRNRKVIEELKDLVRRSRDKSKKVVDELRK

SEQ ID NO: 11742 - protein, 60 aa, Artificial Sequence
  Synthetic sequence.
REVDKARKDVDDILKRVTEAVDRMDRDNERVLREVEETIRKLEEDSRRINKDIEDAVRKE

SEQ ID NO: 11743 - protein, 56 aa, Artificial Sequence
  Synthetic sequence.
RKDVEDVRRKVEEVVRRMEKRLRESEKKSRDVVRKLRKVIEDVERDNDRVVKELEK

SEQ ID NO: 11744 - protein, 60 aa, Artificial Sequence
  Synthetic sequence.
SELEEMRRRIERLAEEVRTTVEEVVRRSEELNKEVEKAVRKVVDENRRVLEEVKEEVRKE

SEQ ID NO: 11745 - protein, 56 aa, Artificial Sequence
  Synthetic sequence.
KEEVKRVEERVERVVEELRRLVEEVRKRNEDSIEKLKDLVRRSKEESERVVKELED

SEQ ID NO: 11746 - protein, 60 aa, Artificial Sequence
  Synthetic sequence.
SDLERVRKESEDLNRRIKTEVRRVLEELKELLKRIKEEVEELVRRNEEVLKRVREEVTKR

SEQ ID NO: 11747 - protein, 56 aa, Artificial Sequence
  Synthetic sequence.
EEAVRKVKEDNDRSVEELKELVKDVERKLREAIKELEDLIRRSEEKSREVVERLRR

SEQ ID NO: 11748 - protein, 61 aa, Artificial Sequence
  Synthetic sequence.
SLEEEVRRVKKELRRVLEKSTKLIEEVTRELETVLRESRDRVRRAKEELKEAVREVRRDVG

SEQ ID NO: 11749 - protein, 59 aa, Artificial Sequence
  Synthetic sequence.
EEEVRKVVEDVERVLRELEKHDRDVAEEVRRVLDELRKHDEDVRRKLRKVLEELKEKIK

SEQ ID NO: 11750 - protein, 61 aa, Artificial Sequence
  Synthetic sequence.
SIEDRVRRVEKELREVERKSTETVKRVEEELEEVVRRSRELVERVKERLKKMVEEVKRDTG

SEQ ID NO: 11751 - protein, 59 aa, Artificial Sequence
  Synthetic sequence.
EKELEDVERDVRRVLKEAEDNDRRVVERVRRVLKEAEKHDRDVVRRVDEVLKRLKEEIR

SEQ ID NO: 11752 - protein, 61 aa, Artificial Sequence
  Synthetic sequence.
SIEEAVERVAKRLEEALRRSTEEVKRVKEETRESVERSRREVEKVEKELREVVERVRRERG

SEQ ID NO: 11753 - protein, 59 aa, Artificial Sequence
  Synthetic sequence.
DDRLRKVVEELETVLDELRKNDRRVIEEVRRINDELRRRDEEVIKRVRDMLKKLTEEIK

SEQ ID NO: 11754 - protein, 59 aa, Artificial Sequence
  Synthetic sequence.
SLEDKLRENKRRSEAVVEEAERRLRKNEEDSRKVVRELEDKLRRLREESKEMADRLRRK

SEQ ID NO: 11755 - protein, 59 aa, Artificial Sequence
  Synthetic sequence.
DKVVEKLLKESKEILDRARETVKRILDDSERILRELRRRVEKLIKESRDILRKVDEDER

SEQ ID NO: 11756 - protein, 59 aa, Artificial Sequence
  Synthetic sequence.
KAEEILEDIKRAVEEALRKLEESVRRNKERIREAVERLRETVKEAKERVDEVKRELEEK

SEQ ID NO: 11757 - protein, 59 aa, Artificial Sequence
  Synthetic sequence.
EEVLRKVREDLERIIRRVEEESKKSHKDSEDVLRRVEERSKKSLEELEDIIKKVKEEAD

SEQ ID NO: 11758 - protein, 60 aa, Artificial Sequence
  Synthetic sequence.
DMEKIVRDVEDRVREVEDRLRRIAERNKREIERVVEELKKTVKEIEDKVREVVKRLEEKG

SEQ ID NO: 11759 - protein, 59 aa, Artificial Sequence
  Synthetic sequence.
EEVLRKVVTDLERILRRVLEDAKRVHEESKRRLDDVRRRSEDSVRRLEEELKRVEEEVD

SEQ ID NO: 11760 - protein, 59 aa, Artificial Sequence
  Synthetic sequence.
DAEKILEDIKREVDEVLKRLRDIIRRNEEEIRRAVEDLKRIADEDREAIKRVIDELRKK

SEQ ID NO: 11761 - protein, 59 aa, Artificial Sequence
  Synthetic sequence.
EEALRKVVEELRKILRDVTEVAKKVHRDSEEVLKKVREDVRKVHEDSKRVLDKVDKDAN

SEQ ID NO: 11762 - protein, 56 aa, Artificial Sequence
  Synthetic sequence.
SRLEEVLRRHEELNERVERTVKKVHDDSKELIDRIRKDVEKVVRELEKVIDEVEKN

SEQ ID NO: 11763 - protein, 55 aa, Artificial Sequence
  Synthetic sequence.
EKVEEIERHARKVERRLEEIVDRNRKSVDKAKKELEKIVRDVRRRVEEVVDRLRK

SEQ ID NO: 11764 - protein, 56 aa, Artificial Sequence
  Synthetic sequence.
DEVRRVLEELRRLLDEVRERVRRVVEEHKRLNDRIRREVERAHEENKRVDDDLRRK

SEQ ID NO: 11765 - protein, 55 aa, Artificial Sequence
  Synthetic sequence.
KDVKEVKKEVERVKEELRRLVEELRKHAEKVKEELKRIVDRDRETNERTVEELKK

SEQ ID NO: 11766 - protein, 57 aa, Artificial Sequence
  Synthetic sequence.
SEAEDVLRKLERLLEEVRERVADAHRRSKELLDRVDKEVKRVNEENRKLDDDIRKKV

SEQ ID NO: 11767 - protein, 55 aa, Artificial Sequence
  Synthetic sequence.
DEARKVREKVKKVEEELRRIVEEDRKEVEKVKRKLEKDVREDEKENRKTVRELEQ

SEQ ID NO: 11768 - protein, 60 aa, Artificial Sequence
  Synthetic sequence.
TLEELLEEIRRKVEEVLKKLEDLLRRDHEEVKKVEEELEEINKRSEDRVRKAVRRLERDA

SEQ ID NO: 11769 - protein, 59 aa, Artificial Sequence
  Synthetic sequence.
EEAIRKVLRKLEEEAKRLEKRIEEVLKESKDRIDELRKRIEESHKDLERIIEELERRIK

SEQ ID NO: 11770 - protein, 60 aa, Artificial Sequence
  Synthetic sequence.
RLEELLERIRKRVEEVKRESERLLKEDHDRVEEAKKRSEDINRRSKEEVDRMLRELETKA

SEQ ID NO: 11771 - protein, 59 aa, Artificial Sequence
  Synthetic sequence.
EEAIRRVLKKLEEIAKRLLDENRRVLEESKKIIDKLEEDNRRSHRELKRILDELRKRIK

SEQ ID NO: 11772 - protein, 60 aa, Artificial Sequence
  Synthetic sequence.
KEAEDLEKKVEDILRRVRELLEELHRRSEKILKDVKDRSRDLLRRVREILKRVEEKKERV

SEQ ID NO: 11773 - protein, 56 aa, Artificial Sequence
  Synthetic sequence.
ERLVREVEKKLRTVEEEVRRIVKENKERLDEAREDVKRSNKTIRDELERARERIET

SEQ ID NO: 11774 - protein, 60 aa, Artificial Sequence
  Synthetic sequence.
SEAEDLTRRVREILKRVEDLSKKLNDDTKKILDELRELSKRLMEEVKKILRRVEEKKERV

SEQ ID NO: 11775 - protein, 56 aa, Artificial Sequence
  Synthetic sequence.
KRLVDTVREELERVRKKVEDSDRRNEEELRKVKEEARRSNERIRELLKTVEDRIRT

SEQ ID NO: 11776 - protein, 60 aa, Artificial Sequence
  Synthetic sequence.
DEVRKLVREVEDILRRVREKSERLVRLVEEILRRVLEESRRLLEETREILERVEEKKERV

SEQ ID NO: 11777 - protein, 56 aa, Artificial Sequence
  Synthetic sequence.
ERLVREVKELLDRVADEVRKSDEDIRRLLEDAARKVEESNKRNRDLLETVRRRIEK

SEQ ID NO: 11778 - protein, 60 aa, Artificial Sequence
  Synthetic sequence.
SEVEKLKKEVKESSKEVIKEVEKLHRESEKSSEDVKREVEKLHRRSKEVADEVRERVRRR

SEQ ID NO: 11779 - protein, 56 aa, Artificial Sequence
  Synthetic sequence.
ERVVEEIERDVRESLRRIEEIIRRNEKRVRESLEDLKRILRENKETVRKVVDELRK

SEQ ID NO: 11780 - protein, 60 aa, Artificial Sequence
  Synthetic sequence.
SEVDDLTRRVRDVLRRVEEKVRDLHRRSEKVARDVEREVEELHERSKDVARKVEEKVRRI

SEQ ID NO: 11781 - protein, 56 aa, Artificial Sequence
  Synthetic sequence.
KDVVDRIRREVEEMLRRLEDILRRNEDTVRRVKEKLKRIVKRDEEEVRKVLDRLRK

SEQ ID NO: 11782 - protein, 60 aa, Artificial Sequence
  Synthetic sequence.
SEVEELKKRVEDVAEEVKDRVRKLHEKSERSSREVEKEVRKLHEESRRVAREVTERVRRI

SEQ ID NO: 11783 - protein, 56 aa, Artificial Sequence
  Synthetic sequence.
EEVVKEIRDTVEKVLEEARKIIEDNRKRVAESVETLKDIIRRDEKTMRDVVDELRT

SEQ ID NO: 11784 - protein, 60 aa, Artificial Sequence
  Synthetic sequence.
DEVEELRREVEESSRRVEKEARRLHKRSEESSREVEERLKRLHDDSRRVAREVEEIVARS

SEQ ID NO: 11785 - protein, 56 aa, Artificial Sequence
  Synthetic sequence.
EDKVRDIKRRIDESKRKIEEIIKRDKEEAEKSEEKIKEIIERDRETVERVVRKLRE

SEQ ID NO: 11786 - protein, 60 aa, Artificial Sequence
  Synthetic sequence.
EIEEIEEELKDRVRRSEEKLRRIEKELRELVEKSRKELEDLLDKDRRDMKRVADELRRDD

SEQ ID NO: 11787 - protein, 59 aa, Artificial Sequence
  Synthetic sequence.
RRVVEELTRKLEESIKKSEDEVKKVKERLEESIRRSKERLEDARRESERVLTEIRERLR

SEQ ID NO: 11788 - protein, 60 aa, Artificial Sequence
  Synthetic sequence.
EVERILDELRRRVEEVVKENEKALDTLRKESERTEEENKRLLDEAREKVDRVVKELKRDD

SEQ ID NO: 11789 - protein, 59 aa, Artificial Sequence
  Synthetic sequence.
EKVLRDLAKKLEDVIRKSEELTKELAKRLRESSKRSIDLTRELLKRLEEVLKKVRDALR

SEQ ID NO: 11790 - protein, 60 aa, Artificial Sequence
  Synthetic sequence.
SVEEIVEEIRRRSKETEDRNRRVVEELEERVRRVLEELKKIVEDARRKVEKVARELKRDD

SEQ ID NO: 11791 - protein, 59 aa, Artificial Sequence
  Synthetic sequence.
EKVVEELLRRLKETSDDSLRRTDELRKELERVLKEVRERLKELDRELKRVLDDVREKIR

SEQ ID NO: 11792 - protein, 59 aa, Artificial Sequence
  Synthetic sequence.
KLEDILRKIEKELKEVKEKSERIVREIEKRHEDDKRRVEDIVRRIKEEVERVVKEIKEA

SEQ ID NO: 11793 - protein, 59 aa, Artificial Sequence
  Synthetic sequence.
DEVMKKVEKEVRDVIKELEDTAREVEKKSEKVLKETNDLAKEVMDKVRKVAEDLRKKLE

SEQ ID NO: 11794 - protein, 59 aa, Artificial Sequence
  Synthetic sequence.
ELEEIVRRIEEEVRRADKEVKEILTEIEKEHRRDVERSDRSLEKIKRDVDRALEEVERV

SEQ ID NO: 11795 - protein, 59 aa, Artificial Sequence
  Synthetic sequence.
REVMKKVTEEVREVLDRLRELLKEVAKRSEEVIKRTNELNETVMRDVERVLRELREELR

SEQ ID NO: 11796 - protein, 59 aa, Artificial Sequence
  Synthetic sequence.
SEVEKLEEDFREMIERSERTLEKLKKENEDASKKSKEKLEKLLREMKEIIDRIRDLIRK

SEQ ID NO: 11797 - protein, 55 aa, Artificial Sequence
  Synthetic sequence.
EEVIKKLRELLERLEREHRKVIEELKKSNKKNEEDIRRVLEELRRLVKKLADDAR

SEQ ID NO: 11798 - protein, 59 aa, Artificial Sequence
  Synthetic sequence.
REAEELLKEMKRASEKSEKIIEDLRRENEKLSKESEDIIRKLKEDNERMIRTIEELIRA

SEQ ID NO: 11799 - protein, 55 aa, Artificial Sequence
  Synthetic sequence.
EEVIKELRELLERNEREIKKVLDELRRSNEKNERDIERALEELKRTNDELAKRAK

SEQ ID NO: 11800 - protein, 59 aa, Artificial Sequence
  Synthetic sequence.
DEVEKLRREIEEIIKEWEKRTRDLKREMKKISDDSRRRIEELLRDFKRIIDELRKAIED

SEQ ID NO: 11801 - protein, 55 aa, Artificial Sequence
  Synthetic sequence.
KEVIERLRELVKRVTDKVRKVNEELRKLLEDNADEIRRAIERLRELLRRLEEEAR

SEQ ID NO: 11802 - protein, 59 aa, Artificial Sequence
  Synthetic sequence.
SEVEKLVREAEKIIEDIRRVIEELLRRARKINKEWDDVSRKLKEDAKRIIDTVLKLIRE

SEQ ID NO: 11803 - protein, 55 aa, Artificial Sequence
  Synthetic sequence.
KDVIERLRDLVRRVKEDIERVLDEWRKSSEEAEERSRRVIEELRRLLEELKERVR

SEQ ID NO: 11804 - protein, 59 aa, Artificial Sequence
  Synthetic sequence.
SELEELKKTMDEVNKETKKENDRLLDEARKVNEESRRRLEKLRKELDDVVREVEDARRR

SEQ ID NO: 11805 - protein, 59 aa, Artificial Sequence
  Synthetic sequence.
SDKVERVLRELRKSSRKVHEDSKKVVEDLERSSRTVEKELRDALKELEDKVREVEKKLK

SEQ ID NO: 11806 - protein, 60 aa, Artificial Sequence
  Synthetic sequence.
DELEKLLEEARKVNEETKEANERLLREMEKVNKESEDANRKLLEELKEVVDRVDDLARRN

SEQ ID NO: 11807 - protein, 59 aa, Artificial Sequence
  Synthetic sequence.
SEDVKRVVDELRESSREVHRRSREVVERLRRSSEEVHKKSRDVLRELTRLVREVKERLR

SEQ ID NO: 11808 - protein, 60 aa, Artificial Sequence
  Synthetic sequence.
DELETLLRELERVNKETERELERLKREAEEVNKATRKDLDELRKEIDKVVKEVEEARRRN

SEQ ID NO: 11809 - protein, 59 aa, Artificial Sequence
  Synthetic sequence.
SERVKKVVDELRDSSRRVKEKLEDVVRRLRDLSRRTKEEVEKVEEDLRRKVREVEERLR

SEQ ID NO: 11810 - protein, 60 aa, Artificial Sequence
  Synthetic sequence.
DELETLLDEAKKVNEETRRANRELRERVREVNKRTEEELKKLRDRLEKVVDDVDKLRKRN

SEQ ID NO: 11811 - protein, 59 aa, Artificial Sequence
  Synthetic sequence.
SRRVREVEERLKKLSEDTHRDSRRLVEEMRRLSKETEKKVEDVVRDLRRLVKEVEERVK

SEQ ID NO: 11812 - protein, 60 aa, Artificial Sequence
  Synthetic sequence.
DELEKLRRELEEANRRTKKANEEILREAERVDERSEEELRKILETLKKVVKDVDDMARRN

SEQ ID NO: 11813 - protein, 59 aa, Artificial Sequence
  Synthetic sequence.
DRRVRTVVEELKKLSRETHEDSKRVVEELERLSRESERKLREVVKEMRKLVKDVEDKVK

SEQ ID NO: 11814 - protein, 60 aa, Artificial Sequence
  Synthetic sequence.
DELEELLRRVEEVDKESKRRLDEIKRRMKEVNDRTREALRDLLRRLAEVVKRVLDLIRRG

SEQ ID NO: 11815 - protein, 59 aa, Artificial Sequence
  Synthetic sequence.
SERVKKVVDDARDSSRKTVERLETVVRDLKRSSDDVEREVRELLKELERLVKKVEDDAK

SEQ ID NO: 11816 - protein, 60 aa, Artificial Sequence
  Synthetic sequence.
RELEELLRKVRKLVEEIERELKKLLEEDRRLSEESREELRKLLEDARRMIREIEELLKRR

SEQ ID NO: 11817 - protein, 58 aa, Artificial Sequence
  Synthetic sequence.
EDAKRVLKEIRRLAEELKKSVKRVIEEVEDSNRRNEEEVRRVLEEIRRLLEDLDRKVK

SEQ ID NO: 11818 - protein, 60 aa, Artificial Sequence
  Synthetic sequence.
SELEELLKDAKRVIDTSRRLITELEKRDEEIIRRIKDLLRRVTEEAKRMLDEIREELKRR

SEQ ID NO: 11819 - protein, 58 aa, Artificial Sequence
  Synthetic sequence.
EKAKRVLEEIRKLLEDSKKESEDVARKLKKSNDELRRDVERVLREIEKRLEDLKREVE

SEQ ID NO: 11820 - protein, 60 aa, Artificial Sequence
  Synthetic sequence.
SELEKLLREVEKIIRDSDDLLRRLEKRNRDLIRTSEKLLKEVKDDVDRVIRELERLLEEE

SEQ ID NO: 11821 - protein, 58 aa, Artificial Sequence
  Synthetic sequence.
EKAEDVLRRIEKLLDDSRRRSEKVAKELEESNERSKRKTEKVLKEIKEALDRVREKVK

SEQ ID NO: 11822 - protein, 60 aa, Artificial Sequence
  Synthetic sequence.
SEIEKVARDVEELLKKVEKKNRDMVERVRRLLEKVKRENEELVRRVEESNERLKERVDRS

SEQ ID NO: 11823 - protein, 56 aa, Artificial Sequence
  Synthetic sequence.
VEELEKTVRKLARDAEKISEDVERRVRELARRLRKISEEVLRRNKELVRRVDEEIR

SEQ ID NO: 11824 - protein, 60 aa, Artificial Sequence
  Synthetic sequence.
SEVEEAVERVKKLLEKVRKDNEEFRERVRKSNEEAEERNRRVVEEVRRSNEELKEKVERS

SEQ ID NO: 11825 - protein, 56 aa, Artificial Sequence
  Synthetic sequence.
VEDLKRRVKELADEARRISEKVLRDNKRLLTELDKISERVLRENEKLVREVEETIR

SEQ ID NO: 11826 - protein, 60 aa, Artificial Sequence
  Synthetic sequence.
SEIEKVAREIEELLRKVAEDNRRMVERVRRLLEEVKTRNKKMVDEVKESNERLKDKVRRR

SEQ ID NO: 11827 - protein, 56 aa, Artificial Sequence
  Synthetic sequence.
VEELKRRAERLIEELRKISEEVERRVKRLVEELEEITRRIKEENDKLVREVEKELK

SEQ ID NO: 11828 - protein, 60 aa, Artificial Sequence
  Synthetic sequence.
SEVEKVVEELKDLVRKSSEKNRKVAEEVKKSNDDLRRKVEEAVREVRESNERLKREVDES

SEQ ID NO: 11829 - protein, 56 aa, Artificial Sequence
  Synthetic sequence.
VEELKDRVRKLIEESERISREILKTNRKLLKELEELLKRLLKRNRELVREVKEEIK

SEQ ID NO: 11830 - protein, 61 aa, Artificial Sequence
  Synthetic sequence.
SDIERVVKEVKDLLEEVRKDNERVMDEVRKLLEELKRKLRKVVEEVRRSNEELKKEVDRRN

SEQ ID NO: 11831 - protein, 56 aa, Artificial Sequence
  Synthetic sequence.
VETLRKEVEELADDLRRISEEVRDRVRKLVTKAEEILRRVLETNKKLLKEVKETLK

SEQ ID NO: 11832 - protein, 60 aa, Artificial Sequence
  Synthetic sequence.
SEIEKVAEEIKKLLRKVEEDNKTVVEEVRRSNEKLKRDNDKVVRDVERSNRELKEELDRS

SEQ ID NO: 11833 - protein, 56 aa, Artificial Sequence
  Synthetic sequence.
VEELKKRVEELARRAKEISDKVRDDNEKLLRELREITKRVKEENDRLLKEAKDAIK

SEQ ID NO: 11834 - protein, 60 aa, Artificial Sequence
  Synthetic sequence.
KEIEDVAKRVEELLRESSREVEEVLREVEELVRRSTRRNEEAVRRVRKSNKELEDEVRRS

SEQ ID NO: 11835 - protein, 56 aa, Artificial Sequence
  Synthetic sequence.
VKTLLDEAKRLVDRSRELLERLLRDVRRLIKESDKITRELERKNEKLLKEVKEEID

SEQ ID NO: 11836 - protein, 60 aa, Artificial Sequence
  Synthetic sequence.
SEIEDAEREVRRLLRESSERVKTVIEEVRELLRRVKRENDEAVKEVEKSNRDLEDKVRRG

SEQ ID NO: 11837 - protein, 56 aa, Artificial Sequence
  Synthetic sequence.
VEELKERVKRLVADSERLLKELRDRVKELADEARRTTEEVLRRNRELVRRIEEDIR

SEQ ID NO: 11838 - protein, 60 aa, Artificial Sequence
  Synthetic sequence.
SELDEVLKTVRKIIEENEKIVKEVLDTSRRSVEEVRKHTKEVLDRVRELAKELEDATRKT

SEQ ID NO: 11839 - protein, 58 aa, Artificial Sequence
  Synthetic sequence.
EEVDKVAEEIEKLVRESNRKVREVVKEIEKLNRDMRKESEDAVKEIEELLRTLEEKVR

SEQ ID NO: 11840 - protein, 60 aa, Artificial Sequence
  Synthetic sequence.
SELDEVLKTVEKIIRDNEEIVKEVLRRSERSIKELKKHTDDILRKARKLAEELKRVVERT

SEQ ID NO: 11841 - protein, 58 aa, Artificial Sequence
  Synthetic sequence.
KRVKDVAERIRELVEESNRKVREVVERIKDLNRKVNKTSEDAAREIEKLLEELREEVR

SEQ ID NO: 11842 - protein, 60 aa, Artificial Sequence
  Synthetic sequence.
DELEEVLKRVREIIKRNEDHSDRVREKSRESVKELEEHTERVLRDVERLARELEEMIDKT

SEQ ID NO: 11843 - protein, 58 aa, Artificial Sequence
  Synthetic sequence.
KKVDDVAREIEKLLKESNDKSRELVKEIKDLNKRLNEKSEEAVKRIEDLLRRIEERVR

SEQ ID NO: 11844 - protein, 60 aa, Artificial Sequence
  Synthetic sequence.
KELEDVLERVKEIIKRNEEILDKVRREVEESVRRAEEILKEVLERVRDLVRKLDDIKDKM

SEQ ID NO: 11845 - protein, 58 aa, Artificial Sequence
  Synthetic sequence.
EEVKRVADEIKRLADESNEKVRRVVRRIDELNKEVDRKLKEVMKEIKKELEDAERRVR

SEQ ID NO: 11846 - protein, 60 aa, Artificial Sequence
  Synthetic sequence.
DELEEVLRRVRKIIEENKEIVRRVLEDVKRSVEELERHTERVLREAKRLADELEDARRKI

SEQ ID NO: 11847 - protein, 58 aa, Artificial Sequence
  Synthetic sequence.
EEVKRVAKELRELLERSNREVRRVVEEIKKLNDEVRKKSEEMRRRIEKLLEELERKVK

SEQ ID NO: 11848 - protein, 60 aa, Artificial Sequence
  Synthetic sequence.
SDLEEVLRRAEKLIEDLERIVRKVLEDSDRSIDEVRRHTEKVLRDVRKLAEELKDIARKT

SEQ ID NO: 11849 - protein, 58 aa, Artificial Sequence
  Synthetic sequence.
EEVKRVIDEIRDRLRKAEERVRKVIEDIKRKNKKLREDSEKAEREIDELLRKVEEDVK

SEQ ID NO: 11850 - protein, 60 aa, Artificial Sequence
  Synthetic sequence.
SELEEVLERVKDLLKKLKEHSDRVLEESKESIDRVRKHTEEVLRTARELIERLDEMRKRT

SEQ ID NO: 11851 - protein, 58 aa, Artificial Sequence
  Synthetic sequence.
EEVKDVAREIRRRLDELRKDSERVAEEIRRLNKKLRDESRKAIKEIEELLRRVTKKVE

SEQ ID NO: 11852 - protein, 60 aa, Artificial Sequence
  Synthetic sequence.
DELEEVLERVRKLIDELRKHSKEVLDTVRDLLRRHKKKNEDSLRTVRKLLTDLEDAVRKI

SEQ ID NO: 11853 - protein, 58 aa, Artificial Sequence
  Synthetic sequence.
ERVKRVAEEIKKLLEDLRKESEDVVKELEDLLDELRRRTEKVVREIEELLKRLEERVK

SEQ ID NO: 11854 - protein, 59 aa, Artificial Sequence
  Synthetic sequence.
SEVERVERRLEKVIEEDKERTKRVEREVEDSNKKDDDLTREVLDRVRKSARDVERKLEE

SEQ ID NO: 11855 - protein, 55 aa, Artificial Sequence
  Synthetic sequence.
REALRRLRELVKKLEDDNRRVLRRLDKLLDDVRKKNEEAMRESRDLSRKVAEKIR

SEQ ID NO: 11856 - protein, 59 aa, Artificial Sequence
  Synthetic sequence.
DEVREVEKRVRESNERDKKLLREVLEEVRRSDKDDDDRTRKVLKRVEKAAEEVKRLLEK

SEQ ID NO: 11857 - protein, 55 aa, Artificial Sequence
  Synthetic sequence.
EDVIRKLRKSLKEVKDDSRRVLKELDDSLRETHKRNRDAMRRLDELLEEVARRIK

SEQ ID NO: 11858 - protein, 59 aa, Artificial Sequence
  Synthetic sequence.
DEIEEIKRRIEKSSEDDKRVLRELEARAREIRKELDERVKRLEKRIKELLERLRKLKED

SEQ ID NO: 11859 - protein, 58 aa, Artificial Sequence
  Synthetic sequence.
RDVRRVLEEWKRLSRKNEEENKAVIEKLRALLEDLKRRLKEVLKRIAELVKKIADELK

SEQ ID NO: 11860 - protein, 60 aa, Artificial Sequence
  Synthetic sequence.
RESEELRREIEKISRENKELVRRLEEAIKRLSDEDKELVERLRRETKKIADKVEDLLEKL

SEQ ID NO: 11861 - protein, 55 aa, Artificial Sequence
  Synthetic sequence.
EEVLREIKKIIDDNRRENREALERIKDIVRRNEEENEKALRESRKRTRELEERLR

SEQ ID NO: 11862 - protein, 60 aa, Artificial Sequence
  Synthetic sequence.
SRVETIRKRVEDLIRRSEDLIRRLEEDVKRVVDEIRKLLEKLKEDDERVIRRIEDLLRKE

SEQ ID NO: 11863 - protein, 55 aa, Artificial Sequence
  Synthetic sequence.
ERVVEEIKERLDRSRRRTEEALERIRKRLEEVKKEVEDVLREVEKTNREIKKEVR

SEQ ID NO: 11864 - protein, 60 aa, Artificial Sequence
  Synthetic sequence.
SRVDELRRRVEELLKRSKELLEEIKRRDEEVLRRIKELLDRLRERVDDALRKISELLTRE

SEQ ID NO: 11865 - protein, 55 aa, Artificial Sequence
  Synthetic sequence.
EEVVREIKKKLTESREDTKRLLEELKKTNDDIRKDVERLRREVEKKVRDIERRVK

SEQ ID NO: 11866 - protein, 59 aa, Artificial Sequence
  Synthetic sequence.
SEVEKLLEEVRELTKRHKEELRRLNKEMEKATRDHLRKSKKLNDEAREMVRRVEELVKN

SEQ ID NO: 11867 - protein, 58 aa, Artificial Sequence
  Synthetic sequence.
ERAARVKEELDKLHKDLEREVRESKRTLKELHDRLRKAVEESKEHLKRLLDELRKKVK

SEQ ID NO: 11868 - protein, 59 aa, Artificial Sequence
  Synthetic sequence.
DEVERLLEEVRRVVKEIEDRSRKLNEDARRVTEDHLRKSEELNRRVEDAVRRIRELTKN

SEQ ID NO: 11869 - protein, 58 aa, Artificial Sequence
  Synthetic sequence.
EEARKIRETLKRLLDELRKKLEESKKHLDELHDRLRRELEKSKRHLEELLKRLEDELR

SEQ ID NO: 11870 - protein, 59 aa, Artificial Sequence
  Synthetic sequence.
SELERLLEKARRDTERHLRESERLNRELKKATDDHLRKSRELNKRLEEVVRRVEEESRN

SEQ ID NO: 11871 - protein, 58 aa, Artificial Sequence
  Synthetic sequence.
REAKKVEDDLRDLHRRLKEAVDRSKKHLEDLHKELEDELKRSIDHLRKLLEEVKRKLD

SEQ ID NO: 11872 - protein, 59 aa, Artificial Sequence
  Synthetic sequence.
SRVEDLLRRVREVVKRVKKDLTKLLEEVKRMTDEHLKRSKELNDRAEEIVRRLKELLDR

SEQ ID NO: 11873 - protein, 58 aa, Artificial Sequence
  Synthetic sequence.
ERAREVVERLDELLKEVADRVEEVKDRLRKLHRKLEESVKKSLEHIKRLIDDLRRKAK

SEQ ID NO: 11874 - protein, 59 aa, Artificial Sequence
  Synthetic sequence.
RELEKLLEDARRVVTTLTRASEKLNEDVKKVTEEHKDRIRRLLDTVRRIVEEVDKRTKG

SEQ ID NO: 11875 - protein, 58 aa, Artificial Sequence
  Synthetic sequence.
EEARKVKEELDRLLEDLRKKLEDSKRHLDELHRELEETVREVSERLKELLDAVRRRAK

SEQ ID NO: 11876 - protein, 59 aa, Artificial Sequence
  Synthetic sequence.
SELEKLLKDVADMVREITERSKKLNDELKKLTEDHDRKIKRLNERLEEIIREVEKLVDD

SEQ ID NO: 11877 - protein, 58 aa, Artificial Sequence
  Synthetic sequence.
DEARKVAERLKELLDRLRRKLEESKRHADELHERLRKSVEDSKKHIKDLVDELKRRVD

SEQ ID NO: 11878 - protein, 60 aa, Artificial Sequence
  Synthetic sequence.
SRVEELLKRLEDATRRHLEVSKRLNDDLRRATKDHLDKLRELNERVKKVVDDVVEKIKSN

SEQ ID NO: 11879 - protein, 58 aa, Artificial Sequence
  Synthetic sequence.
EEAREVRERLDRLHEELEKEVRRSEKTLKELHDRLRKEVERSKRHLDELLKDLEDKVR

SEQ ID NO: 11880 - protein, 59 aa, Artificial Sequence
  Synthetic sequence.
SRVEKLVREVEKVVEEVERTIRKLLEDVKEMTDRHLKMIEDLNRELEEIVRRVTELIKN

SEQ ID NO: 11881 - protein, 58 aa, Artificial Sequence
  Synthetic sequence.
DEARKVKKRITELVERVEREVDRVKKELEKLHERLKREVEKSSEHIKRLLDELRKRAE

SEQ ID NO: 11882 - protein, 59 aa, Artificial Sequence
  Synthetic sequence.
RELEEILRRVKEVTKDHLDKIDELNKRLDKATKEHLERLRDLNRRLKEVVERIEEEIRN

SEQ ID NO: 11883 - protein, 58 aa, Artificial Sequence
  Synthetic sequence.
READKVRKDIRRLHEELAREVKKSEDHLRKLHEELRDEVRRSEEHLDALLEDLKRKVD

SEQ ID NO: 11884 - protein, 59 aa, Artificial Sequence
  Synthetic sequence.
SELEKLLRDMEEATKRHDEMLKKLNDEIRKVVERILKELEDLNRRLEEIVRRLKEESKN

SEQ ID NO: 11885 - protein, 58 aa, Artificial Sequence
  Synthetic sequence.
EEADDVRRRLERLHRELRKSVETSKKHLKELLDRLAKSIEDSKKHARELLKRLEEDIK

SEQ ID NO: 11886 - protein, 59 aa, Artificial Sequence
  Synthetic sequence.
SEVEELLDRVRKVVEDLMRESKRLNDELKKIVDDILRRLRELNKEIKDVVDEIKKLLDN

SEQ ID NO: 11887 - protein, 58 aa, Artificial Sequence
  Synthetic sequence.
EEADKARKDLKRLLDRLRREVERSKEEMDKLLEDLERAVRESEKHLEKLLRDLERRAR

SEQ ID NO: 11888 - protein, 59 aa, Artificial Sequence
  Synthetic sequence.
SRLEELLKRLDDIVKRVLTKIRELNERLKKIVEELLRRSEELNREVRRVAEEIRRLEEG

SEQ ID NO: 11889 - protein, 58 aa, Artificial Sequence
  Synthetic sequence.
DKARDVRRTIRKLVRDVAEAVRRSTEHIDKLLEDLEREVRRSERDIERILRELEEEAR

SEQ ID NO: 11890 - protein, 59 aa, Artificial Sequence
  Synthetic sequence.
SDVEKLLEDVRRMTEEHKELIKELNERVERIVRKVVEDSKKLNDELREIVKRVEDESRN

SEQ ID NO: 11891 - protein, 58 aa, Artificial Sequence
  Synthetic sequence.
EEAARVREDLDRLHEELERFVRESKKHLDEMLKELRRRLERSKEEIDRLVKEAEEKLR

SEQ ID NO: 11892 - protein, 60 aa, Artificial Sequence
  Synthetic sequence.
REVEEVLKEVKKIVDRNREELKRVLDEIRELVKRIEDDLRRVNEESEKLVRTLLELMRRG

SEQ ID NO: 11893 - protein, 55 aa, Artificial Sequence
  Synthetic sequence.
EEVRERIERLIEKSERDVREVKKKVEELARRLREEVEKLKKHVKRLLEELKKAAD

SEQ ID NO: 11894 - protein, 60 aa, Artificial Sequence
  Synthetic sequence.
SEAEDALRKIKKLVDEVVERIKKVDDDSRKLVEEVERTIEKLDKESEDLVKKVKDMKRRG

SEQ ID NO: 11895 - protein, 55 aa, Artificial Sequence
  Synthetic sequence.
EEVKKEVKRLLEELKRRLDESNKRNKRLIDELRKKLEDSRRRNEELLRDLKETAT

SEQ ID NO: 11896 - protein, 60 aa, Artificial Sequence
  Synthetic sequence.
DEAEEVERRSRELVERAKTEIEKLDRESKRLVDTVARKIEEVDKRSEELVRTVEELRRRG

SEQ ID NO: 11897 - protein, 55 aa, Artificial Sequence
  Synthetic sequence.
EEVEKENRELNRRLKEALDESNKRNRTLLEDLRRKLRESEERNRRLLRKLEEDAR

SEQ ID NO: 11898 - protein, 60 aa, Artificial Sequence
  Synthetic sequence.
SEAEEALKKVEELVRRVEEEIKRVDERSKDLVRRVERKLEELVERSKELVKRLLDMRRRG

SEQ ID NO: 11899 - protein, 55 aa, Artificial Sequence
  Synthetic sequence.
EDVERRVRELIERLKRKLEESNRRNKKLIDELRKRLEEVKRENEKLNEDLERETK

SEQ ID NO: 11900 - protein, 60 aa, Artificial Sequence
  Synthetic sequence.
DELERVLKRVKELIDKSRREDEELDERSKELVKKVLDELKDALRKIEKLVRDLKEMTDRG

SEQ ID NO: 11901 - protein, 55 aa, Artificial Sequence
  Synthetic sequence.
EEVRKDAERLIRENEEDNRRSNERNKKILKELKDALDRVKEEVRKLIRRLEEEAR

SEQ ID NO: 11902 - protein, 60 aa, Artificial Sequence
  Synthetic sequence.
SEAETVLEEVKKLVERSREEDKEVDDESRELVERVEEKLRRVLKKSKEDVDRVMRLIEEG

SEQ ID NO: 11903 - protein, 55 aa, Artificial Sequence
  Synthetic sequence.
EEVEDTIRRLIEENKKRNEESNRRNRELIKKLERKLEEVKRRNEDLNRKLEETAR

SEQ ID NO: 11904 - protein, 57 aa, Artificial Sequence
  Synthetic sequence.
STLEEAEEEVRRLIKRTEDETRRVADEVKKLLDKHRRATEDVEKKVRELLDRLKKDE

SEQ ID NO: 11905 - protein, 59 aa, Artificial Sequence
  Synthetic sequence.
DREIEKIVRRAKETNEENREIIERILKEIKELIDDANRKLKEILDRIRELVETVKRKAK

SEQ ID NO: 11906 - protein, 57 aa, Artificial Sequence
  Synthetic sequence.
STLEEVERRIRELLDRHRRATEEVEKEVDRLNKETRDELDRVRKEIEKLLKDLDRKE

SEQ ID NO: 11907 - protein, 59 aa, Artificial Sequence
  Synthetic sequence.
DEELRRILKRVEKLVKDLNDKLRKILDDARRSNEEIKRRLEEILKEVKRLVDTVTERAR

SEQ ID NO: 11908 - protein, 58 aa, Artificial Sequence
  Synthetic sequence.
SRIERAEEELKRSLKELREDLERVVRTIRKILREHEEKSKDVKRRIEELLREVKKRMV

SEQ ID NO: 11909 - protein, 56 aa, Artificial Sequence
  Synthetic sequence.
VDKVLRDVEDLNRTTLKLLEDLLRTVEEVVRRADKLLEDLLREIKRLVDEVMERDR

SEQ ID NO: 11910 - protein, 58 aa, Artificial Sequence
  Synthetic sequence.
SEIEEIEKEIRKSVEEVKKTLDKVVTEIRKSTREHEKKSEEVRKRSKELNKDLRDRLV

SEQ ID NO: 11911 - protein, 56 aa, Artificial Sequence
  Synthetic sequence.
VKTVLDDVRRVNEETKKRIRDLLEESKRSDEEADRRAEELLERNERLVRKVAEEAR

SEQ ID NO: 11912 - protein, 58 aa, Artificial Sequence
  Synthetic sequence.
SRIEEVIRRAREILEDHRRKSTEVRERLKKLLKEHEDKSRRVKEESEKINRDVKRELV

SEQ ID NO: 11913 - protein, 56 aa, Artificial Sequence
  Synthetic sequence.
VDKVLKEIEDLVRKADELLRELLKRVEDLVRRADEVLEELLRRNRKLAEDVMRKDK

SEQ ID NO: 11914 - protein, 58 aa, Artificial Sequence
  Synthetic sequence.
REIEEVEKEIKKLLDEHRKKSDDVVRKLEKILRDHERRTEDVKRESEKINREVEKRKV

SEQ ID NO: 11915 - protein, 56 aa, Artificial Sequence
  Synthetic sequence.
VDEVLERVRELLERADRKLEELLERVRKLVEDANRVIEEVLERNKRLADEAMKKDK

SEQ ID NO: 11916 - protein, 58 aa, Artificial Sequence
  Synthetic sequence.
SRIEEIVKRIRDILKEHEDKSRRVVEDIKRSTEELKRALREVVERIKTILDDVRRRLV

SEQ ID NO: 11917 - protein, 56 aa, Artificial Sequence
  Synthetic sequence.
VDKVLEDVRRVAKEADDRLEELLERSKKLNKETLDELERLLREVEELVKEVAERDR

SEQ ID NO: 11918 - protein, 58 aa, Artificial Sequence
  Synthetic sequence.
SRIEEVSERVREILRRHEEKSREVVERIKKSTKELRDEVRKVRATSKEINDDVRRRLV

SEQ ID NO: 11919 - protein, 56 aa, Artificial Sequence
  Synthetic sequence.
VDRVLERVEKMVRDADKRIDEVRKESERLNEETRRRIERLLRENKKLADEVAERAR

SEQ ID NO: 11920 - protein, 58 aa, Artificial Sequence
  Synthetic sequence.
SRIERVEERMRELLDRHRETSKRVVEEIRKSTEEHKEKSERVVRESERLNREVERELV

SEQ ID NO: 11921 - protein, 56 aa, Artificial Sequence
  Synthetic sequence.
VDRVLEEVERLVTEVNREIKELLERSKRSDKEADRRLEEVVKTNRELAERVARRAT

SEQ ID NO: 11922 - protein, 58 aa, Artificial Sequence
  Synthetic sequence.
SEIEEVVRRLEELVKRVAEELKRVVDRIEDLLREHKDKSRRVEERSKEINEDVARRLV

SEQ ID NO: 11923 - protein, 56 aa, Artificial Sequence
  Synthetic sequence.
VKEVLERVKKLVDDLIRRLKKLLEDLKKLVDDADEEIKRVLEENEELARRAAERDT

SEQ ID NO: 11924 - protein, 58 aa, Artificial Sequence
  Synthetic sequence.
SEIEDVVRRARELLERLRKRVREVVEDIRRSTEEHKEKSERVVKTSEELNKRLEDELV

SEQ ID NO: 11925 - protein, 56 aa, Artificial Sequence
  Synthetic sequence.
VDKVLEDVRRLVKEAVDRIDKILRDSRESDRRADEEIKKVLDRNRELVKKVADEDT

SEQ ID NO: 11926 - protein, 58 aa, Artificial Sequence
  Synthetic sequence.
DEIERVEEEIRRLLEEHKKRSDEVVRRLEKLLKDHKEVTRKVVEESERINRDVERRLV

SEQ ID NO: 11927 - protein, 56 aa, Artificial Sequence
  Synthetic sequence.
VKEVLERIRKLVKDVNKRLEEILEEVERLVRRANRRIEELLERNRRLVEEVARRDE

SEQ ID NO: 11928 - protein, 58 aa, Artificial Sequence
  Synthetic sequence.
SEIEKVEEEIRRILEEHKRISDEVKRRVRKSTEEHEKRTEDVERRSREINEEVEARLV

SEQ ID NO: 11929 - protein, 56 aa, Artificial Sequence
  Synthetic sequence.
VEEVLRRIRKLAEEVNKELKRLLDESKESDDRLNKRLTEILRENEELARDVARRVK

SEQ ID NO: 11930 - protein, 58 aa, Artificial Sequence
  Synthetic sequence.
SKEERIEEALRDLVRRHKEVSRRVVETIKDLAKKLEEKLRRVETDSKRINDEVRDKLV

SEQ ID NO: 11931 - protein, 56 aa, Artificial Sequence
  Synthetic sequence.
VERVLEEIKKLVEEVNRELRELLKRIEELLKRAEEMLERLLRENRRLVEEVARRDK

SEQ ID NO: 11932 - protein, 60 aa, Artificial Sequence
  Synthetic sequence.
SESEELDKEIDDIVREDEELNKELRKRNDDAVRRVEKVIEDLLRRNEDAAEKVKKLLEEL

SEQ ID NO: 11933 - protein, 55 aa, Artificial Sequence
  Synthetic sequence.
RELLRKLREILEDLRRKNERTEEESEEILRRLTKLAEEVLRRSRKILEDLREALR

SEQ ID NO: 11934 - protein, 60 aa, Artificial Sequence
  Synthetic sequence.
SEKDELRKRMRDISKENKELLEKLEREIRELSKENEKLNEKLRRELEELRKTIKDLLDRL

SEQ ID NO: 11935 - protein, 55 aa, Artificial Sequence
  Synthetic sequence.
RELLKEAKELLEENRKRNEEILRRAEKVLRDNAEKDKRTLEKVEEILDRLRRELT

SEQ ID NO: 11936 - protein, 60 aa, Artificial Sequence
  Synthetic sequence.
KEAEDLEREMREISDRNRKLNKKLRRDIKEISDDNRRLLEELRRRLKKMEEDVRRLLEEL

SEQ ID NO: 11937 - protein, 55 aa, Artificial Sequence
  Synthetic sequence.
RELLTEARKLLERNREEDKKSLDDARKALKENKEENDKIKEEIDKILRELEEELR

SEQ ID NO: 11938 - protein, 60 aa, Artificial Sequence
  Synthetic sequence.
EESERLAKRVDDLSRENEELNKRLRDEMEKISRENKELLKDLRRKADKIVKDVERLLEEL

SEQ ID NO: 11939 - protein, 55 aa, Artificial Sequence
  Synthetic sequence.
RELTRRIEKLLKDNTDRDKKSEDDLRELLKENKKRNDEILEEIRRILEELRKKLT

SEQ ID NO: 11940 - protein, 60 aa, Artificial Sequence
  Synthetic sequence.
SLDKEIERKVEEIERRLKESNDRLREKVDEIRRRSERLNTELNERVDRIAERIRRMKRDG

SEQ ID NO: 11941 - protein, 55 aa, Artificial Sequence
  Synthetic sequence.
ERLEEKIDRIIRELERRNDKSREELEKIIRELRERTKESEKRLEDIIRELEERTR

SEQ ID NO: 11942 - protein, 60 aa, Artificial Sequence
  Synthetic sequence.
DADKRLRTDVRRIVEDLKRSNEELRRRSEEIAKRSDKLNKELNKKSKEIEERVKRMRDEG

SEQ ID NO: 11943 - protein, 55 aa, Artificial Sequence
  Synthetic sequence.
KDLEKELRDIIRELRERNRESEEEDERIIRELEKRTKDSEKRDDEILRELEREIR

SEQ ID NO: 11944 - protein, 60 aa, Artificial Sequence
  Synthetic sequence.
SLVEKIAREVRKIKEDSKRLNDELNEKVRKAVEDLERSNRELEKRVREIEERVRRAETEG

SEQ ID NO: 11945 - protein, 55 aa, Artificial Sequence
  Synthetic sequence.
KELEDDIERIIKELEELTRRSEEKLRETIERLEERNKETAERLERIIKELEERSK

SEQ ID NO: 11946 - protein, 60 aa, Artificial Sequence
  Synthetic sequence.
KEAEELEERVKRIEEESRRLNRELNEKVKDIAKKLEDSNDKLRKDSEEIAERVKRARTEG

SEQ ID NO: 11947 - protein, 55 aa, Artificial Sequence
  Synthetic sequence.
DEVVKKLEDIIREIEKTTRESEKRLEDIIRKLKKKNDDTEREDREIVKRLREETK

SEQ ID NO: 11948 - protein, 60 aa, Artificial Sequence
  Synthetic sequence.
SLLEKLERDVERLSEEDEKLNEDVRRVDREIVERDKKLNREVNERVKRLAEEVKDIRRRV

SEQ ID NO: 11949 - protein, 55 aa, Artificial Sequence
  Synthetic sequence.
ERAEERLRRIIKRNKEENERTAKESRDSIEELKERNERSKRRLEKILEDLERETR

SEQ ID NO: 11950 - protein, 60 aa, Artificial Sequence
  Synthetic sequence.
REAEELEKRVRKIEREDDKLNEELNRRAKDVSREDKELNDRVREVVRRLVEEVDRIRRDV

SEQ ID NO: 11951 - protein, 55 aa, Artificial Sequence
  Synthetic sequence.
EELEKKLEDIIRELKKRNDESAERIRRLIKTNEDENRRTAEEIKKILDDIRRKVK

SEQ ID NO: 11952 - protein, 59 aa, Artificial Sequence
  Synthetic sequence.
SELEEIRKKIDDLRRRVEEINERITREDKRLVDELKEINKRITDRVRKIARDVEELLRK

SEQ ID NO: 11953 - protein, 60 aa, Artificial Sequence
  Synthetic sequence.
DEERLRTVDEEVKKILDELREKLDRNRRRSEETNRRLDELLKENARRVEEIIRRLREEVK

SEQ ID NO: 11954 - protein, 59 aa, Artificial Sequence
  Synthetic sequence.
SELEEIKKRVEEIARTLEKLNRDITKLDEDLAREVEDINRRITETVEEIAKRVERLREK

SEQ ID NO: 11955 - protein, 60 aa, Artificial Sequence
  Synthetic sequence.
DKERLDKLRTEVKKIMDDLRRILEKNAKDSKRSLDRLRKILEDNKEKVKRIADRLREAVR

SEQ ID NO: 11956 - protein, 59 aa, Artificial Sequence
  Synthetic sequence.
KDEKRIKDVLKKLEDDNKKLNDEIKKLNEEIARKNEELNKRIEDMIRKAEREVDELKRN

SEQ ID NO: 11957 - protein, 55 aa, Artificial Sequence
  Synthetic sequence.
KEVDDEARRILEKLRRENERTKEESKEINEELEKRNRESVERIKEILRRLEEKLR

SEQ ID NO: 11958 - protein, 59 aa, Artificial Sequence
  Synthetic sequence.
SEVERLLREVEKVLRRVVKRSRDLNEELKKRSKEHKETSERLNREMKRVLREVEKKIDE

SEQ ID NO: 11959 - protein, 55 aa, Artificial Sequence
  Synthetic sequence.
REVKKRLDELLKRLEREVRESEKRMDRSHEDVRREAERSKKELEELLKKLEDKVR

SEQ ID NO: 11960 - protein, 60 aa, Artificial Sequence
  Synthetic sequence.
SEVEKILRDVEDATRRHKRTSEELNRRLEEVVRRVKEESKELNERLREVVKRVKEEIRKT

SEQ ID NO: 11961 - protein, 55 aa, Artificial Sequence
  Synthetic sequence.
REVKKRIDELHDDLRRVMEASKERIDRILEDLRRVVERSKEELRKLLEDLKRTVD

SEQ ID NO: 11962 - protein, 59 aa, Artificial Sequence
  Synthetic sequence.
SEVEELLKRVEEATERHKREIERLEDEIRKVLEDVDKRSKELNDHNRDVIEKIRERIER

SEQ ID NO: 11963 - protein, 55 aa, Artificial Sequence
  Synthetic sequence.
REVKTELDKLHEDLKRTAEEVKKRLDDLLKELEKKVEESKTEIDRSLEELEKTAR

SEQ ID NO: 11964 - protein, 57 aa, Artificial Sequence
  Synthetic sequence.
DEERRVKEELEKLLEDLRRTIKKVEEDSDRINKDLERVIRRSEREADKILEDLERAG

SEQ ID NO: 11965 - protein, 59 aa, Artificial Sequence
  Synthetic sequence.
EEKLRELLERAKKLVEDIKRRLKELLDRHRDLVRRIKERSKELNKRLKDLIDEIKERAR

SEQ ID NO: 11966 - protein, 56 aa, Artificial Sequence
  Synthetic sequence.
SSKDDLRRKIEKLLRDLERVIRESEKRSEEINRDLERTLKRIKEEADKILDKVRRG

SEQ ID NO: 11967 - protein, 59 aa, Artificial Sequence
  Synthetic sequence.
DRLLEKLLRELEKLIRRIEEESRKLNEEHEKLLKRIKDELKKLLDDLRRLAREIEERRR

SEQ ID NO: 11968 - protein, 57 aa, Artificial Sequence
  Synthetic sequence.
KSTEDAKREIDKLLEELEETIRRAEDRSRRLNEDLARTLKRIEEELKRINEEVEKRG

SEQ ID NO: 11969 - protein, 59 aa, Artificial Sequence
  Synthetic sequence.
DELLKKLLDELRELIDRIRRDLERLLREHEELIERIKRTLEELLRRHRELVKRIEETAR

SEQ ID NO: 11970 - protein, 57 aa, Artificial Sequence
  Synthetic sequence.
SEEDRLEEEIKRILDDVARVVKRIKEELKRINDELKKVIDESRDHARRVNDDVRRRG

SEQ ID NO: 11971 - protein, 59 aa, Artificial Sequence
  Synthetic sequence.
EELLKELLKRLEELARRIKKKLEELLREHEKLLEEIEKALRRSNEEHRKLVEKIKRDAT

SEQ ID NO: 11972 - protein, 57 aa, Artificial Sequence
  Synthetic sequence.
DEEERVKEAVERLLRDLERAIKESEDHLRRLNEDLDRVIRESKEHLKKVNDDVRRAG

SEQ ID NO: 11973 - protein, 59 aa, Artificial Sequence
  Synthetic sequence.
EELLKKLLEELKRLIERIKRDLKRTNDEHEKLIREIKKRLEDSNRDHERLVKDIKETAR

SEQ ID NO: 11974 - protein, 57 aa, Artificial Sequence
  Synthetic sequence.
SKEDRLREELKKLLKRLREEIERLKRALEESNKDLKRTIDRSEKHLRDVNEDVKRAG

SEQ ID NO: 11975 - protein, 59 aa, Artificial Sequence
  Synthetic sequence.
EEELDKLLKEARDLIREIEKRLEELLKRVEKLTEDAKRDLERSNREHKELADRIKETAR

SEQ ID NO: 11976 - protein, 56 aa, Artificial Sequence
  Synthetic sequence.
SEAERIEEEARRLLEELRRAIERVKEEADRLLEELRDAIRKSKEHLKRLNEDVERA

SEQ ID NO: 11977 - protein, 59 aa, Artificial Sequence
  Synthetic sequence.
EEALKRLLEKLKRLIEEIKRELKRLLDDLKRLIDEIAEALKRSNDRHEELVRRIKEKAR

SEQ ID NO: 11978 - protein, 57 aa, Artificial Sequence
  Synthetic sequence.
DSKEEIRRKIDELLKRLEETIRRSEEHFRRSLDDARKELKRSRDHVRKVNKELRDRG

SEQ ID NO: 11979 - protein, 59 aa, Artificial Sequence
  Synthetic sequence.
DEELERLLRDLERLIREIEKTLEDTNRSNEELVRRLKRRLEESNKRHEDLADEIRRRTD

SEQ ID NO: 11980 - protein, 57 aa, Artificial Sequence
  Synthetic sequence.
SEEDRIREEMEEILRRVERTVEEIKKELKKINDDVDRTARESEKHVREVLERVEREG

SEQ ID NO: 11981 - protein, 59 aa, Artificial Sequence
  Synthetic sequence.
EELLEKLLEDLKRVVEKIRRDAEDLLERHKDLVRRIKEELRRSNRKLEDLVKKISERAT

SEQ ID NO: 11982 - protein, 56 aa, Artificial Sequence
  Synthetic sequence.
DEDREVRRTLEELLDDLRRVIEESERHLEKLNEDVREAIRRSEEHVRRVLDRVRRG

SEQ ID NO: 11983 - protein, 59 aa, Artificial Sequence
  Synthetic sequence.
EDLLRKLLEEAKRVLDEIRKTLKKTNEDHERLVERIKRELEKSNKDLERLAKEIIDRDK

SEQ ID NO: 11984 - protein, 57 aa, Artificial Sequence
  Synthetic sequence.
SSKEDITKKIEELLRELEEELKKSEKHLRELNEEAKRTAEESRRHLEESLRKVEKDG

SEQ ID NO: 11985 - protein, 59 aa, Artificial Sequence
  Synthetic sequence.
DEELKKLLKELEDLVKEIKERLRKTNEEHRKLVEEIKERLKRSNESNERLVRRIEEEAR

SEQ ID NO: 11986 - protein, 57 aa, Artificial Sequence
  Synthetic sequence.
SELERAEEEIEKLNRDLKRTLDEIRDRIRKINDDLRKTLRKSDEDSKRLLKELRDEV

SEQ ID NO: 11987 - protein, 58 aa, Artificial Sequence
  Synthetic sequence.
EKLKDMLDKHRKLIDDLKRRLERRLREHKRLLDEIEKRLRDSLKRIEEIVREILERAR

SEQ ID NO: 11988 - protein, 57 aa, Artificial Sequence
  Synthetic sequence.
DELERIRRELERINTTLDELLKRSKEETDRILKKVEDSIREVEKKVKELLEELKRRV

SEQ ID NO: 11989 - protein, 58 aa, Artificial Sequence
  Synthetic sequence.
ELLKKILDEHRDLLRRIEEELRRSLEDIKRVAKEVEERIKKVLDELRRLIEELLRRAK

SEQ ID NO: 11990 - protein, 60 aa, Artificial Sequence
  Synthetic sequence.
SVLEEAEKELRKIVEDNRRTLREVKERNKKLNKENRDTIKKIEDDVRRIIRELKEDLKRS

SEQ ID NO: 11991 - protein, 59 aa, Artificial Sequence
  Synthetic sequence.
EEDLRRLEEEIRRRSEENKKRIRDLLRRSEELSRRDKKKLKEILERIKRLADEVREKIR

SEQ ID NO: 11992 - protein, 60 aa, Artificial Sequence
  Synthetic sequence.
SDLEDILRKIEDLSRKNEEELKRVLEENKKLSDDDKRRLEKILREVEKKIRKIKKDIKDE

SEQ ID NO: 11993 - protein, 58 aa, Artificial Sequence
  Synthetic sequence.
EEVRKLEEDVRRIIERNKKLTEDLARELKKLNDDNERTLRKVEEDIRRIIADLRRTLK

SEQ ID NO: 11994 - protein, 60 aa, Artificial Sequence
  Synthetic sequence.
SELDEILERLRRLSEENKRRIEEALRRNKKLSEDDERLSREIRRRVRELVEEAKEVLRRE

SEQ ID NO: 11995 - protein, 58 aa, Artificial Sequence
  Synthetic sequence.
EEVKRVAEELDKLVKENRRVTEKVARELKKLNDKNREVNERLERELDKIIKDLRRTDK

SEQ ID NO: 11996 - protein, 60 aa, Artificial Sequence
  Synthetic sequence.
SEIEKILEDVKKLADDLRRTLKRALEENKELSDRDKEELRRILEEIKKLAEEIDKLIKEE

SEQ ID NO: 11997 - protein, 58 aa, Artificial Sequence
  Synthetic sequence.
ERVREVARRIEKIIEDLRRDLERVRRELKKLNDDNRRVLEEVKRTVEEIIKRLRESAK

SEQ ID NO: 11998 - protein, 60 aa, Artificial Sequence
  Synthetic sequence.
DEVDELLKEAEEVIREVTREHKRLLDEARKISEENKKRSEESNREVRELVRRIKEEIKKG

SEQ ID NO: 11999 - protein, 59 aa, Artificial Sequence
  Synthetic sequence.
SEKAKRVEEELKKLLDKLSRITEEVERRLEELLKDNERVSRESDEELKRILEDVERDTR

SEQ ID NO: 12000 - protein, 60 aa, Artificial Sequence
  Synthetic sequence.
SEVEELLDRLRKLIEDVVREHKRLLDEVRRISRENEELIRRLLEKVEEVIRRIKERIKSG

SEQ ID NO: 12001 - protein, 59 aa, Artificial Sequence
  Synthetic sequence.
EKTAREAEEELRRLLERLSEVTRKVEKAIEDILRRNRETSERVAREIRRLLKELEDTAR

SEQ ID NO: 12002 - protein, 60 aa, Artificial Sequence
  Synthetic sequence.
SSVEELLERLRRISEENKRRIEKLLREVEKVLRELKDRHRKLLKRVEEIIRKVKEEIKSG

SEQ ID NO: 12003 - protein, 59 aa, Artificial Sequence
  Synthetic sequence.
RETAERARETLKRLLDENRDRSKKVKEEIRRILEDLTRTTERVKREIKKLLKELEDTAR

SEQ ID NO: 12004 - protein, 55 aa, Artificial Sequence
  Synthetic sequence.
DLLRKLLEEAKKILKEIKDAHEKLLRELEESNKELEKAHRKLLEDAKRMLDDLKR

SEQ ID NO: 12005 - protein, 59 aa, Artificial Sequence
  Synthetic sequence.
EDRVRDLRRALEELIKESDEVSRRLKEEIDRSLESSKKVSRDLEEELKKLIKDLEDTRR

SEQ ID NO: 12006 - protein, 55 aa, Artificial Sequence
  Synthetic sequence.
SELEKLLRDDRELLKELKKAHKKLLDELKESNDRVRKRHEELLRRIREIAKRLRD

SEQ ID NO: 12007 - protein, 59 aa, Artificial Sequence
  Synthetic sequence.
KDKVRRVERESKKTHDESREVSEKLRRDAEDSLRSSEKLSEDLERELRKLIKEVRDEAK

SEQ ID NO: 12008 - protein, 55 aa, Artificial Sequence
  Synthetic sequence.
KDIERLLEELKRILEDLKRKHKRLLERLEDSNRRIRRTLEELLKRLEKLVKDLSD

SEQ ID NO: 12009 - protein, 59 aa, Artificial Sequence
  Synthetic sequence.
KDKVDDAKRRLEELLKESREVSKKLRDDIERSIRSLREEVKKLDEDAKRLLDKVREEIR

SEQ ID NO: 12010 - protein, 55 aa, Artificial Sequence
  Synthetic sequence.
SVLEDLIRRDREMLKRAKEEHDRLRKEIERSNREIDEEVKRLLAEIKKIVEEVSK

SEQ ID NO: 12011 - protein, 59 aa, Artificial Sequence
  Synthetic sequence.
KKAVDEVRKESDDTHKESEAVSRDLKRELERSIKSLEKRIREAEEELKRILKELEDEKR

SEQ ID NO: 12012 - protein, 55 aa, Artificial Sequence
  Synthetic sequence.
EELERLLEEDKELVRRVERELERLLRELKRSNDEIKKTLEDLLRRIEEILKEIRR

SEQ ID NO: 12013 - protein, 59 aa, Artificial Sequence
  Synthetic sequence.
KEKVKRAEDRSRETHRRLEEVVKKLKEDAERSIKSLEELVDKLRKELRRLLEEVREEVR

SEQ ID NO: 12014 - protein, 55 aa, Artificial Sequence
  Synthetic sequence.
RELEELIKEDEDLLRRLAETLKKLLEDVRRSNEELRKFHEDLLRDLERLLEELRN

SEQ ID NO: 12015 - protein, 59 aa, Artificial Sequence
  Synthetic sequence.
KEKVRRVEERSRRTHKELEDLAREVDKELKKSIKSSRDVTRKVKEDADRLLKKVADDTK

SEQ ID NO: 12016 - protein, 55 aa, Artificial Sequence
  Synthetic sequence.
SILETLADRDRDMVRRVKEALKKLLERDKRALERLKRVHKELLDRLRKILEDLKR

SEQ ID NO: 12017 - protein, 59 aa, Artificial Sequence
  Synthetic sequence.
EEKVKRVEEESRRTHKELKDVADRVETESDKSHEESKKVTDEVRKELERLLRELEETVR

SEQ ID NO: 12018 - protein, 55 aa, Artificial Sequence
  Synthetic sequence.
SEAEKLLRELEDILKKLKDALKRLIEEDERLLKRLKREHEKLLKRLEEVLRELKK

SEQ ID NO: 12019 - protein, 59 aa, Artificial Sequence
  Synthetic sequence.
REKVKRVKDEADRLLKELEDVVREVKKRSDESHKRSRDVTREMKKELKRLLEELEKTVR

SEQ ID NO: 12020 - protein, 55 aa, Artificial Sequence
  Synthetic sequence.
SELERLLREDEEMVERVERVLKELEEEVRKALKRAKEMHRRLLERLKTILDELER

SEQ ID NO: 12021 - protein, 59 aa, Artificial Sequence
  Synthetic sequence.
KEKVKELERRSRKTHKELADKADTLRKRLEEVIKESEDVTEELERRLKKLIDDLRRSVT

SEQ ID NO: 12022 - protein, 55 aa, Artificial Sequence
  Synthetic sequence.
SELEKLLRELEELLKELKRVLEELIERDKRLLDRLKEVHERLLRRLEKLLKELKD

SEQ ID NO: 12023 - protein, 59 aa, Artificial Sequence
  Synthetic sequence.
EDKVREAKRELERLIEELRRAVRRVEDESRRSHEESKKVTDDLDKRARELLEELRETIR

SEQ ID NO: 12024 - protein, 60 aa, Artificial Sequence
  Synthetic sequence.
REVEELEKDVRRTLDELRKRHRDNNERIKKILRELEDLHRRNNERTKTLLARIRELRERG

SEQ ID NO: 12025 - protein, 55 aa, Artificial Sequence
  Synthetic sequence.
RELERKLKELVKDVEKVIEDDDRSADKLLTKVKRDADEDRKSNEKLVREVREELR

SEQ ID NO: 12026 - protein, 60 aa, Artificial Sequence
  Synthetic sequence.
SEAEEVLKRVEEVVERLKKLHDDNNKKLRDAVRRLKRLHTEHNKETKEIKKEIEDLIRKG

SEQ ID NO: 12027 - protein, 55 aa, Artificial Sequence
  Synthetic sequence.
REVEKRLKEVVKRIDEVAEEDERSIREILRELRKVIEDDERSNRKVAKEIRESAK

SEQ ID NO: 12028 - protein, 60 aa, Artificial Sequence
  Synthetic sequence.
DKVREVLERLKKLVEDLKRLHKRNNEEVRRVIEEIKDRSRRNNKRTEDILRDIEREIRRG

SEQ ID NO: 12029 - protein, 55 aa, Artificial Sequence
  Synthetic sequence.
ERIKEELKKLVEDVRRTAEDDRRTIEDLVRKVEEVLERDRKSNEEAARDVDRKLK

SEQ ID NO: 12030 - protein, 56 aa, Artificial Sequence
  Synthetic sequence.
RSVEEVKKELDDSDRRDREVVKEARRRLEESKDRLRKIIERAKEELDKSDERIKKN

SEQ ID NO: 12031 - protein, 59 aa, Artificial Sequence
  Synthetic sequence.
DEELKKLLKHNREVLEDSRRKIEELLRTNEKALEDVKRAIEELLKHNEEVLKEVDDRTR

SEQ ID NO: 12032 - protein, 56 aa, Artificial Sequence
  Synthetic sequence.
KEVEDAEKRLRDLLKEDRELIERLRRALEESLKEDRKVIKELREELDKSDRKVEED

SEQ ID NO: 12033 - protein, 59 aa, Artificial Sequence
  Synthetic sequence.
REDIKRLLEELEEVLRRSEKKLRELLDTNRKILEESKERLRRLLEHNKRVLRRVVEETR

SEQ ID NO: 12034 - protein, 56 aa, Artificial Sequence
  Synthetic sequence.
SDEERVEKELKKSDDEDKKLIDELTRRLRESLKRLEEEVRRAREELDKSDEEVRKA

SEQ ID NO: 12035 - protein, 59 aa, Artificial Sequence
  Synthetic sequence.
REDIERLLDHNRKVLEKSADDLRKLLKTNEEILRRVAKAIRDLLEHNRRVVEEVKERAR

SEQ ID NO: 12036 - protein, 56 aa, Artificial Sequence
  Synthetic sequence.
SEVEEAKRRLDESDKDDRRVIDKLRKELEKSREEAKRLIDRLREELKDSNREAEEA

SEQ ID NO: 12037 - protein, 59 aa, Artificial Sequence
  Synthetic sequence.
REDLRRLLEHNKEVLERSKKRLEELSETNKKFLEEVKDALRELLKTNREVLREVKERTK

SEQ ID NO: 12038 - protein, 56 aa, Artificial Sequence
  Synthetic sequence.
SSVERAKRELDKSLKEDRDTIRDLKRRLEESRKRDREVIEELKKILKKLLDEVKDS

SEQ ID NO: 12039 - protein, 59 aa, Artificial Sequence
  Synthetic sequence.
DDKIKKLLDHNRKVLEDSKEELRRLLETNKRILEESKKRLDRLAEEIEKVARTVKEEAR

SEQ ID NO: 12040 - protein, 56 aa, Artificial Sequence
  Synthetic sequence.
DEVERAEEELRKSDEEDRRVVKRATETLKKSKDELEREIKRLEDELERSNREVEER

SEQ ID NO: 12041 - protein, 59 aa, Artificial Sequence
  Synthetic sequence.
REEIKKLLDHNRRVLEESERRIRELLRTNREVLERVKKELDELLEHNRRVLEEVEKRVR

SEQ ID NO: 12042 - protein, 56 aa, Artificial Sequence
  Synthetic sequence.
SSVEKAKKRLDESDKTDRDVIKRLREELKKSEDTDRELVKKVKEEIEKVEEELRRR

SEQ ID NO: 12043 - protein, 59 aa, Artificial Sequence
  Synthetic sequence.
DDKIRRLLEHNEEVMKRSKERLDDLVRTNRKILEESKRKIEKLLKELREVVEEVDRRAR

SEQ ID NO: 12044 - protein, 56 aa, Artificial Sequence
  Synthetic sequence.
DKAERVREEIEKLERELRRVLKESREHTKKLEEDLERVLRRSREATKKLKEDLERN

SEQ ID NO: 12045 - protein, 58 aa, Artificial Sequence
  Synthetic sequence.
ELIKRMLEELKRLLEELEKRIRDSNAELEKLLRDLIRKLERSLREIKRVLEELKEEAR

SEQ ID NO: 12046 - protein, 60 aa, Artificial Sequence
  Synthetic sequence.
SEVETLMREIKKLIDDIKRKNEDSNREIREVSRKTEEDLRDLLRKAREVAEKLKDELRRR

SEQ ID NO: 12047 - protein, 59 aa, Artificial Sequence
  Synthetic sequence.
EEKVKRLEDSLERLKRDLRKIIKENEDELRKINRRNEELIKKAEEDLRRLSEDLKRAEK

SEQ ID NO: 12048 - protein, 57 aa, Artificial Sequence
  Synthetic sequence.
SELEEVLRRIEKLVRKAHKENEDVLREIERLVRTAHRLNKKVDDDSAKIAEDLKREK

SEQ ID NO: 12049 - protein, 58 aa, Artificial Sequence
  Synthetic sequence.
ERVRRLKEILERLKEEVRRSLEELRKEVERLKKEVEDSLRELKKSLEEWVKDLEEATR

SEQ ID NO: 12050 - protein, 57 aa, Artificial Sequence
  Synthetic sequence.
SDLEAVLDEIKKLAEEAHKRNEEVDKESAKLVKEAHKVNEDVDKESAEIVKRIDEEK

SEQ ID NO: 12051 - protein, 58 aa, Artificial Sequence
  Synthetic sequence.
ERVKRLKDELRRLLKEVKDSLEELDRMLEEWKERVRRSLEELRKRAKEWEDKLRESLR

SEQ ID NO: 12052 - protein, 57 aa, Artificial Sequence
  Synthetic sequence.
SELEDVLKKIRKLVRDAHEENKRVLEEIRKTVDEIRKELEDVDTKSAEIAERAKERK

SEQ ID NO: 12053 - protein, 58 aa, Artificial Sequence
  Synthetic sequence.
ERVERLRRELEKLVREVEESLKRLKEELDKIKEELRRILEELEEKLRRWSRELKETAR

SEQ ID NO: 12054 - protein, 58 aa, Artificial Sequence
  Synthetic sequence.
SELEKVVEDLRRIVEEIERRLREVIKEIRELVRRAHERNKDVDRKSAEIVKDIEEKKK

SEQ ID NO: 12055 - protein, 58 aa, Artificial Sequence
  Synthetic sequence.
ERVERLKRALDELERRLKELVRELEDSLKKLADEVKRSLEELDKSLKDWKKKLDDELK

SEQ ID NO: 12056 - protein, 57 aa, Artificial Sequence
  Synthetic sequence.
SEIERVLEEIKERVERADRKNEKVDRESAEKVKELHRRNEEVDRESAETVKRAERDK

SEQ ID NO: 12057 - protein, 58 aa, Artificial Sequence
  Synthetic sequence.
DKVREIRERVERLVKAVDESLERLERSLEEWARRLDKSLEDLKRSLKRWKEELDRKAQ

SEQ ID NO: 12058 - protein, 57 aa, Artificial Sequence
  Synthetic sequence.
SELETLIKEATDLAEEVKEDLRRVDEESAKLVEDADDENKRVDEESAKIVEDLKREK

SEQ ID NO: 12059 - protein, 58 aa, Artificial Sequence
  Synthetic sequence.
ERIRDLKEKVRRLMEDVKRLLEELERSLERWKEKVRDSLEKLKKSLEEWAKELKDTSK

SEQ ID NO: 12060 - protein, 57 aa, Artificial Sequence
  Synthetic sequence.
KDLETVLEEIKRIVDDLDRRNKEVDKESAKLVKEADEKNKRVDEESAKIVKRLEREK

SEQ ID NO: 12061 - protein, 58 aa, Artificial Sequence
  Synthetic sequence.
DRVRRLREEVTKLLDEVRRSLDRLRESLKEWKERVDDSLRRLRDSLRKWKRKLEEATR

SEQ ID NO: 12062 - protein, 57 aa, Artificial Sequence
  Synthetic sequence.
SELDDLLRRIRELVRRAEEDLKRVNEESARLVEEMDKDNKRVDEESAKIAEDLKREK

SEQ ID NO: 12063 - protein, 58 aa, Artificial Sequence
  Synthetic sequence.
KKIEELKREVKKIADELERILKELEDSLREWSERVRKSLEELKDSLRRWAEELKRDLK

SEQ ID NO: 12064 - protein, 57 aa, Artificial Sequence
  Synthetic sequence.
KDLERVVKEIERLVREAEKKIREVNDRSAKLARDLDRRNREVLKEIKKIAEDLEREK

SEQ ID NO: 12065 - protein, 58 aa, Artificial Sequence
  Synthetic sequence.
ERVERLKRELERLKRELEETLKRLDEELEKWEERVRESLKRLEDRVREILKRLEDDAR

SEQ ID NO: 12066 - protein, 57 aa, Artificial Sequence
  Synthetic sequence.
DELETVMKRIRELAKELNKKNKDVLDEIEDLVRKADKRNKEVLKRIEEILREARKRK

SEQ ID NO: 12067 - protein, 58 aa, Artificial Sequence
  Synthetic sequence.
ERVKRLKDELRRLIEEVRRNLKRLKEEVDKIRERVRRSLKKLKEDVKRLSDEVKETLK

SEQ ID NO: 12068 - protein, 60 aa, Artificial Sequence
  Synthetic sequence.
KEIEDLLRELRELVKEIDDLIKDATREIERLVKEVHDKNEKVTRRLEKLMRELREVARRG

SEQ ID NO: 12069 - protein, 58 aa, Artificial Sequence
  Synthetic sequence.
ERIETLERALRELVRELEEKVDEHRKRTDKVARDLKKSVDDHRRRTEELVRELRKTEE

SEQ ID NO: 12070 - protein, 60 aa, Artificial Sequence
  Synthetic sequence.
SELEDVLRRAKKLVEDVHRDNKRVTEELEKLARELHKKNEDVLRELKKLADDLREMLKRG

SEQ ID NO: 12071 - protein, 58 aa, Artificial Sequence
  Synthetic sequence.
EKVKRLEEEIRRLARELRESVRRHKERTEELVERLKESLKKLEEDIRRLEKELEDDRR

SEQ ID NO: 12072 - protein, 60 aa, Artificial Sequence
  Synthetic sequence.
SDLDDVLRRIRELAKRVHDENKRVTEELERLVEELEKKARELLRRIEELVRTLKEMRERG

SEQ ID NO: 12073 - protein, 58 aa, Artificial Sequence
  Synthetic sequence.
ERVERLRRELEKLVKELEESVRRHKKRTRELEERLKDVLRELEDAVRRLVEELEKTDE

SEQ ID NO: 12074 - protein, 60 aa, Artificial Sequence
  Synthetic sequence.
EEIERLLEEIKRLVETVHESNRRVLKELRDLAEELKRRNTKSNRDMERLVEELEEMRRRG

SEQ ID NO: 12075 - protein, 58 aa, Artificial Sequence
  Synthetic sequence.
EKVKTARDEVRRLVEELKESVERLARELKKLVDELRKVDEDNKRRLEELERRLRESTR

SEQ ID NO: 12076 - protein, 60 aa, Artificial Sequence
  Synthetic sequence.
SELEDVLRKLEKLAREVDKINKDLIKRVEELARELKKKNEKSNKEARDLVKKLKEMKDRG

SEQ ID NO: 12077 - protein, 58 aa, Artificial Sequence
  Synthetic sequence.
ERVRRLKKEVEELERRLRRSVDDLRRKIKELEDRLREIDERNKREIEKLVKELRDTDR

SEQ ID NO: 12078 - protein, 60 aa, Artificial Sequence
  Synthetic sequence.
DELETVAKLLEDLSRTNEDRLREVKETLKRLADTVDKINKEVLRRLRELAKRLKELKERG

SEQ ID NO: 12079 - protein, 58 aa, Artificial Sequence
  Synthetic sequence.
EDVRRLEEELRKLEERNRRLVRELEEVLKKLKDELKKSVDRLKEELDRLVKELDEIKK

SEQ ID NO: 12080 - protein, 60 aa, Artificial Sequence
  Synthetic sequence.
SEIEDALRKMEKLAEDVNRKNEEVIREVRRLSEENKKKLDDVLETLKKLVRELAEMTKRG

SEQ ID NO: 12081 - protein, 58 aa, Artificial Sequence
  Synthetic sequence.
ERIRTLEKAVRDLVRELEESVDRLRREADRLVEENERVVERLKRELKRLVEELERRAK

SEQ ID NO: 12082 - protein, 60 aa, Artificial Sequence
  Synthetic sequence.
DELREVLERVKRLVDTVNKINDDLTKRNEDLSRKNVDKIRRLTEEIERLVEEVDRARREG

SEQ ID NO: 12083 - protein, 58 aa, Artificial Sequence
  Synthetic sequence.
EDVRRLEEEVRKLVEELRRSVEDHKRRNKESVDRNRRAVEEHERRNREVVERLERKAK

SEQ ID NO: 12084 - protein, 60 aa, Artificial Sequence
  Synthetic sequence.
SDIEEALKTMEELSRRNEETLRRVLKRLKELADEVNRKNERVLEEAKELADRLRELRERG

SEQ ID NO: 12085 - protein, 58 aa, Artificial Sequence
  Synthetic sequence.
ERIKTLEEDLRRLVEENKKVVEELKRRLKKLVDELRESLKELEKAVRKLVKELRDDEK

SEQ ID NO: 12086 - protein, 57 aa, Artificial Sequence
  Synthetic sequence.
SSKETVAKRVEDVKRELEEVLKELARESKRLSDRDKKLNEEAAEEIERLKDELRKKV

SEQ ID NO: 12087 - protein, 59 aa, Artificial Sequence
  Synthetic sequence.
DEVLERIVKRVRDLVEEIKRRLEKLAEDNRRLSKRNEDVIRTLLEEARKLVEKVKEEVR

SEQ ID NO: 12088 - protein, 57 aa, Artificial Sequence
  Synthetic sequence.
RSKEEVAKEIKRLKEENKRLLDELAKRSEELERRDRRLNEEHHREIRRLTDELRKKV

SEQ ID NO: 12089 - protein, 59 aa, Artificial Sequence
  Synthetic sequence.
DRVLKEIVDEARRLSERNEEVLRRLLKENEDLSKRNEDFIRKTMKELRDLAEEVKERAK

SEQ ID NO: 12090 - protein, 57 aa, Artificial Sequence
  Synthetic sequence.
KSKEDVKREIERLKKENREVLDTARKRIEDLIREDERVNREAAEEIKRLVEELERRV

SEQ ID NO: 12091 - protein, 59 aa, Artificial Sequence
  Synthetic sequence.
DRVLKEIVEELRRLSEENKRRIERALEELEKLSKDNTDRIEEAREDLRRLVRELLEKEQ

SEQ ID NO: 12092 - protein, 57 aa, Artificial Sequence
  Synthetic sequence.
KDEEEVAKEIERLKEENDRVLKEAADKIEKLKKENREVNTRAAEEIERLKKELREKV

SEQ ID NO: 12093 - protein, 59 aa, Artificial Sequence
  Synthetic sequence.
SRVLEEVVRRLRKLSEENKKRIKEMLDDVERLSRRNEEKIRRVLEDARRLLEDLTRKAK

SEQ ID NO: 12094 - protein, 57 aa, Artificial Sequence
  Synthetic sequence.
SEKETVAEEIRRLIEKNKKMLEDHTRDIRRLEKENDDVNRKHHEDIRRLKDRLRKEV

SEQ ID NO: 12095 - protein, 59 aa, Artificial Sequence
  Synthetic sequence.
SRVLKEIVDEARELSKRNEDKIRKSLEELKRLSERNKKKIEDTLKELRKLAEEVKRRAT

SEQ ID NO: 12096 - protein, 57 aa, Artificial Sequence
  Synthetic sequence.
SEKERVADDIRKLEEENKEVLDRAAEEIKRLKKRDRELNKRHHKTIRDLVDELEKKV

SEQ ID NO: 12097 - protein, 59 aa, Artificial Sequence
  Synthetic sequence.
SRVLDEIVKEARDLSEENRKLIEEALERLRRLSRENEETIKKTMEELKRLVEEVKERAR

SEQ ID NO: 12098 - protein, 57 aa, Artificial Sequence
  Synthetic sequence.
KSKEEVADKIRKLKEENRKVLERHTREIEKLKRDDEEANKKHHEDVKEVMKRLEKEV

SEQ ID NO: 12099 - protein, 59 aa, Artificial Sequence
  Synthetic sequence.
DRVLEEIVREAEELSKRNKDRIDESLKELRKLSEDNKREIERTLEEIKRLAEEVRRRDT

SEQ ID NO: 12100 - protein, 57 aa, Artificial Sequence
  Synthetic sequence.
SSKERLKEMIDRLKERNKDLLRKAAEEIKRLEDEDREVNRRHHEEIERLKKELREKV

SEQ ID NO: 12101 - protein, 59 aa, Artificial Sequence
  Synthetic sequence.
DRALDEIIKEAKKLSDDNERLIRDVLRRARDLSRRNKETIRRTLEKLKREAEKVKEDAR

SEQ ID NO: 12102 - protein, 60 aa, Artificial Sequence
  Synthetic sequence.
SDADRIIEEARRLSEENKRRIEEVLKRNRKLSKENHDKNDELLKRVRELLRRVVERLRRE

SEQ ID NO: 12103 - protein, 59 aa, Artificial Sequence
  Synthetic sequence.
KDKLKRLEDEVRKLTDENRRVTEKAERDLRRSNRENDRSTERLEEEIRRIKKRLRDEAR

SEQ ID NO: 12104 - protein, 60 aa, Artificial Sequence
  Synthetic sequence.
REAEDLIRRLRELVRRHHELNRKLAEELRKLSEENKRKIEKVTREVEKLVKDVADTLKDD

SEQ ID NO: 12105 - protein, 59 aa, Artificial Sequence
  Synthetic sequence.
KDKLKRLEEELERLKEEVRKSNRDLEKEVRDLRKENEKVTEEVKKRIEDLKRKLDEDRR

SEQ ID NO: 12106 - protein, 60 aa, Artificial Sequence
  Synthetic sequence.
SEVDKIIKDARDLLKEHHEKNKRLIEENRRLSEENKDRIRRALEKLKKLVDDLRRLIEEV

SEQ ID NO: 12107 - protein, 59 aa, Artificial Sequence
  Synthetic sequence.
KKKLDELETEVRRIKETIDRSNERLERELEKSNRENKKVTDDAREVVKKLKEEIKRDED

SEQ ID NO: 12108 - protein, 60 aa, Artificial Sequence
  Synthetic sequence.
SEADEIIKEAKKLADDHHRLNKEIIERNKRLSEENHKLNEKIIEDVRRLVKDVAERLKRD

SEQ ID NO: 12109 - protein, 59 aa, Artificial Sequence
  Synthetic sequence.
KEKLDRLREKVEEIKRRVDKSNDELRRSMEESNKRNDESTDRLREELRRLDEELDRRRK

SEQ ID NO: 12110 - protein, 60 aa, Artificial Sequence
  Synthetic sequence.
SDLERVLKELRELVRRHHELNKDIIRRARRLSEENEKDIKKLLDDARKLLEEVKRTLDRM

SEQ ID NO: 12111 - protein, 59 aa, Artificial Sequence
  Synthetic sequence.
KKKLDEARTELRKLEEEVDKSNKELRDEVEKLERRNDELLERAREEVERLKEELRRKAT

SEQ ID NO: 12112 - protein, 60 aa, Artificial Sequence
  Synthetic sequence.
SKAERIIEEVRRLSEDNKRRIKKLLDEAKELLDRHHKRNKELLEEIERLLREVKERLKKD

SEQ ID NO: 12113 - protein, 59 aa, Artificial Sequence
  Synthetic sequence.
KDRLEELRRDLERLRKENKDVLDRVREDIKRLKEELDDSNRRLKDTIEDLKRELDEEAR

SEQ ID NO: 12114 - protein, 60 aa, Artificial Sequence
  Synthetic sequence.
SEVEELVKDLKRILDEIKRTNDELNKELKRLSDESRKLSKENIDRLRRILEEIEKTIRRR

SEQ ID NO: 12115 - protein, 59 aa, Artificial Sequence
  Synthetic sequence.
EEKVRKLEKLLEDIKRTVDKIIRESEKRAEEINRDNRRIIEENKKKLEEIARRVEELAR

SEQ ID NO: 12116 - protein, 60 aa, Artificial Sequence
  Synthetic sequence.
SSIEELAKRLEDLIRELRDRHRRLNEELKELTDRNRKEIEEANERIKRLIDDLERLRRRG

SEQ ID NO: 12117 - protein, 58 aa, Artificial Sequence
  Synthetic sequence.
EEIDKLRRELERLEEELKKVLDRTREELERLVRDNRRLNKEHKDHSDTLVRRLEESRK

SEQ ID NO: 12118 - protein, 60 aa, Artificial Sequence
  Synthetic sequence.
SEVEDLIRDLERLLKEHDELNKRSMEELEKLLKDLEKMVRDSLREAREIAERVKETIKRT

SEQ ID NO: 12119 - protein, 59 aa, Artificial Sequence
  Synthetic sequence.
EKKLDEARKVLEEIKKRLEDSLRRLREEAERIKRELKRILDEHRKEIERIKKEIDEAAR

SEQ ID NO: 12120 - protein, 60 aa, Artificial Sequence
  Synthetic sequence.
SEIEKVLRDVEKLVREHEDLNKKSAEEAERLTRDNKRRVDESKKRIREILKEVDEIIRRT

SEQ ID NO: 12121 - protein, 59 aa, Artificial Sequence
  Synthetic sequence.
DKDLRRLAEEAERIKKRLRDSLDELRKIIEELEERNRRINEDHRRDLEDVKRRIEEKSK

SEQ ID NO: 12122 - protein, 60 aa, Artificial Sequence
  Synthetic sequence.
SEIEEVARRAEKLTKENEELIRRSLRDIERLVKEMEDIVRKSLKEIKELVERLKDISRKT

SEQ ID NO: 12123 - protein, 59 aa, Artificial Sequence
  Synthetic sequence.
DEKLRRLAKRIEELKKRNEDLNREHRKRLEEAEKRLKDVLDEHRRRLEEVKKELDEEAK

SEQ ID NO: 12124 - protein, 60 aa, Artificial Sequence
  Synthetic sequence.
DEIERVLEEIKKLTDDNRKLVKESIDRAEELLKRHEEENKKSVERARKLVRDLDEIRRKT

SEQ ID NO: 12125 - protein, 59 aa, Artificial Sequence
  Synthetic sequence.
KKKLDELARRAEDMERDNKRINKEHRERIKEIKERIKESLDRLAEEIKKIEKELEDKAR

SEQ ID NO: 12126 - protein, 60 aa, Artificial Sequence
  Synthetic sequence.
SEIEKVLEDAKKLTKENEDLIRKSLEDNERLLRRHEEENKKSAEDMRDLLRRLEDIIRKT

SEQ ID NO: 12127 - protein, 59 aa, Artificial Sequence
  Synthetic sequence.
EELLERLAREIKKLIDKNRKLNEDHRRESEKSERRLRESLRKLAEEAERIEREMDKSRK

SEQ ID NO: 12128 - protein, 60 aa, Artificial Sequence
  Synthetic sequence.
SKIEKIVRDAERLLDELRKLAEDVLRRLEELNRRAEDVIRRLAEENTELLKRLEDLLETE

SEQ ID NO: 12129 - protein, 59 aa, Artificial Sequence
  Synthetic sequence.
KKKAEELKRKAEEIKRRIDKIVDEVRKAIRDSAEHLKRLLEEYRRRVEEVKKRVRDAAK

SEQ ID NO: 12130 - protein, 60 aa, Artificial Sequence
  Synthetic sequence.
DELERLREEVKRLSEENKELIKEMEKRNRELSKENEKVNRELKKRVDDIIRTLKELRKEG

SEQ ID NO: 12131 - protein, 62 aa, Artificial Sequence
  Synthetic sequence.
EKEEREIRRVLEDIKRIADENERENREALKRLEETNKRNTDHNRDVLREIDKLFREVAEELR

SEQ ID NO: 12132 - protein, 59 aa, Artificial Sequence
  Synthetic sequence.
SEKEEVIKRIREELKENEKENRDVIRKIRELLDELRRRVEEVLRRLKKSNEDIEREAEK

SEQ ID NO: 12133 - protein, 56 aa, Artificial Sequence
  Synthetic sequence.
EEELKERIKKLSKENKDRVRRMLERIKKLVDDLRRLLEELRRRNEKLLDRLRKAIK

SEQ ID NO: 12134 - protein, 59 aa, Artificial Sequence
  Synthetic sequence.
KDEEKVIEDIRRILEENHRENKEVIDKIRELLRRNEEENKEAIRRMRKSNKEITDRAEE

SEQ ID NO: 12135 - protein, 56 aa, Artificial Sequence
  Synthetic sequence.
REELERRVRELSKENKEMLKRVEDKIRELSERNKRTVKKVREDNERLIRRLEEEDK

SEQ ID NO: 12136 - protein, 59 aa, Artificial Sequence
  Synthetic sequence.
SELERIEEDVERLNRRNEETLKRIDEALKRLEKSNKELDEKLEETVKRIKDRVERVKRR

SEQ ID NO: 12137 - protein, 62 aa, Artificial Sequence
  Synthetic sequence.
DKAKREVDKVRTDAREILKENKRRNEDVIRKIEEKVRDLERRNRDLLRRVKTKIDRLREELK

SEQ ID NO: 12138 - protein, 56 aa, Artificial Sequence
  Synthetic sequence.
KELEDIARRVDELNKRNEELIKDAKRVLKEASDKNKEMNERVDDKLRRLAKKVKEL

SEQ ID NO: 12139 - protein, 62 aa, Artificial Sequence
  Synthetic sequence.
KEERDKIRDLLRRIREKIEKNRKDAEDVLREIKKLIDENKKRNEEVLKKIEELLRELEKRLE

SEQ ID NO: 12140 - protein, 61 aa, Artificial Sequence
  Synthetic sequence.
SRLEKVIKEIKKTHEELERRFKKNSDEAEESLKRLEDELRKVVTDIERKLRDLERRVREAG

SEQ ID NO: 12141 - protein, 59 aa, Artificial Sequence
  Synthetic sequence.
EELITRLKKHVDDTAREVEELIKRHTEHNEKLRRDIKKLLEELKRKVDELRKEIETRTR

SEQ ID NO: 12142 - protein, 62 aa, Artificial Sequence
  Synthetic sequence.
SELEELIKRAEDTIRRLEREIDELIERHRRSAERLRETLKELIDRHRKSIEDVMRELKRRRG

SEQ ID NO: 12143 - protein, 56 aa, Artificial Sequence
  Synthetic sequence.
KEEIERLIKELEKKIKEVVKRIRDIDEDLKRKAKKVVDDLRELNERLERKAKEATK

SEQ ID NO: 12144 - protein, 60 aa, Artificial Sequence
  Synthetic sequence.
SEEERLRDHSRRVEELARRAAEKLRRHSEDVKRLITELIKLIEDVMKKIEDEVRDAEKRG

SEQ ID NO: 12145 - protein, 61 aa, Artificial Sequence
  Synthetic sequence.
ELKKRIDELHKRNKDKLDEISERLKRLLEENRKLIKEVEERLRKLLEDLRKLIEDVKRRLR

SEQ ID NO: 12146 - protein, 60 aa, Artificial Sequence
  Synthetic sequence.
DFEEEIRRNLKRVRDLAKKLEDLIRKHSEEVKRLAEEVKREIEEVIKRAKKKMEDVRRDG

SEQ ID NO: 12147 - protein, 61 aa, Artificial Sequence
  Synthetic sequence.
ELKKRADRLLDEHREELKRIEDRLRELLERNNRLLEDIDRRLKELLEDLRRVLKEIEEELR

SEQ ID NO: 12148 - protein, 61 aa, Artificial Sequence
  Synthetic sequence.
SEVERLLEDLRRLAKESDESLKKSHRELRKRHEEVRRTIEELLKDLERTVKEIKEELERDV

SEQ ID NO: 12149 - protein, 60 aa, Artificial Sequence
  Synthetic sequence.
EEDVRREIKRVLDTIRKLNEDWKRRNEESKRRLDKLLDDAKKAIDKIVEDVKKLLEDARR

SEQ ID NO: 12150 - protein, 61 aa, Artificial Sequence
  Synthetic sequence.
SEVEKLLRDLERLARRVREELRKSHEKLDKLARDSKKSIEDLLEDLRRIIEEIEEELDRRV

SEQ ID NO: 12151 - protein, 60 aa, Artificial Sequence
  Synthetic sequence.
REDVEREVRRIKREIKELLDRWRRANEEIAREIRKLNEEVKRRVEKILRDLEELLRRLRK

SEQ ID NO: 12152 - protein, 61 aa, Artificial Sequence
  Synthetic sequence.
SELEKLEKELKDLLDKIRRDLEKSLKENDELVKKIEEDLKDLLKKLDDRLEKVARDLKREK

SEQ ID NO: 12153 - protein, 60 aa, Artificial Sequence
  Synthetic sequence.
RETATKRVKEVLDKLRKMLEDLRRHNEENKRRNKEVLDELRKKAEDVLRRIDEALKELKR

SEQ ID NO: 12154 - protein, 63 aa, Artificial Sequence
  Synthetic sequence.
SVEEMETRLKEVADDLKKKIDEVLTRLEKLNRELTKRSRDMNRELERLNKEAEDRARDVLKRV

SEQ ID NO: 12155 - protein, 59 aa, Artificial Sequence
  Synthetic sequence.
RDEARKLLRDLERLIEEIKKTLDELLKHHKEELDRIDREHEELLRHHKKTLERIEEKID

SEQ ID NO: 12156 - protein, 60 aa, Artificial Sequence
  Synthetic sequence.
DRVEKVLREIEKRLRDHRKRLKDALDEIRKRIEEHEEKSERLNRESKKLLKDLEDMKRRG

SEQ ID NO: 12157 - protein, 56 aa, Artificial Sequence
  Synthetic sequence.
EEVVRRARELVKRLEEDHRRMVEEIRRTIKRAEERHKKSVEDNEKLLRDLRDRLEK

SEQ ID NO: 12158 - protein, 60 aa, Artificial Sequence
  Synthetic sequence.
SEVEKVLEDLKRLLDEHEKRSRELNKRSKKLADEARRINEELLRELKKLLDELKELKDRG

SEQ ID NO: 12159 - protein, 56 aa, Artificial Sequence
  Synthetic sequence.
KKFLDDMRRLLEELKERHERSERENRKLLRKLEEDSKRTNDESKKLLDKLRDDLEK

SEQ ID NO: 12160 - protein, 60 aa, Artificial Sequence
  Synthetic sequence.
DRVEEVLKRVEELVKRHDERLKELEDDLRRLIEEHLEKSRRLNKESEKLLKEILEVKRRG

SEQ ID NO: 12161 - protein, 56 aa, Artificial Sequence
  Synthetic sequence.
EEVVKTIDEIVKELRKRHEEVRKRLKELLDEMRERHERSVRRNRERLEKLLDDLRK

SEQ ID NO: 12162 - protein, 60 aa, Artificial Sequence
  Synthetic sequence.
SEVERVLRDVERLLEEHRKKSKEANDTSRELARRHKEESDRLNKKSEDDARRLEDVKRRG

SEQ ID NO: 12163 - protein, 56 aa, Artificial Sequence
  Synthetic sequence.
EDMVRRIREIVKKLKRDHEKSVEDNRRLLRELEERHRESVERNEDLLRRLEERARK

SEQ ID NO: 12164 - protein, 60 aa, Artificial Sequence
  Synthetic sequence.
DEVETVLRDLKRLLDEHRRRSEELNKRSEELLREHEERSKRLNERSEKLARELREMKKRG

SEQ ID NO: 12165 - protein, 56 aa, Artificial Sequence
  Synthetic sequence.
EEFVKRMDELLRKLEEDHRRSVRENEKLLEELRRRHKKSVDDNRRLLEKLKRDADR

SEQ ID NO: 12166 - protein, 60 aa, Artificial Sequence
  Synthetic sequence.
DEVEEVLRRIEELLTRHRKKSDDLNRRSEELAERHERTNRTLLEELRDLAKKLEDLKREG

SEQ ID NO: 12167 - protein, 56 aa, Artificial Sequence
  Synthetic sequence.
EEVVKRMRDLVRRAKEEHKKSVDDNRRTLKELHDRSKKTNDDSRELLKRLEDRLRK

SEQ ID NO: 12168 - protein, 60 aa, Artificial Sequence
  Synthetic sequence.
REAEEVLERIRRRLEEHLEDNERILREIKKRLDEHREKSKRVNDRSRELVERLLAVKREG

SEQ ID NO: 12169 - protein, 56 aa, Artificial Sequence
  Synthetic sequence.
EDIVREIRRIVRELHERSKDSNREVERLVRKLEDDHRESVERNRELLKKLEDDLRR

SEQ ID NO: 12170 - protein, 56 aa, Artificial Sequence
  Synthetic sequence.
RLEDVLREVREDLRRLNEESRKVLEENDKLDKDLNRRLKRLEEEARTEIKKVKDRL

SEQ ID NO: 12171 - protein, 60 aa, Artificial Sequence
  Synthetic sequence.
EDELEKRLTEVRKELEDRYRELIERSKDIIRRLEEEVRKLEKELRKVLEDLDRRAREATR

SEQ ID NO: 12172 - protein, 59 aa, Artificial Sequence
  Synthetic sequence.
SEREDIKRLIEEIRKLVDEAAKEIERNIEEIRRLVKELEELSKKHIDEAREILERLKRR

SEQ ID NO: 12173 - protein, 55 aa, Artificial Sequence
  Synthetic sequence.
ELVEEMERDVREVERALRRLLDKHRRVLEDVERRLRRALEENRRVLEEIEEDSRR

SEQ ID NO: 12174 - protein, 58 aa, Artificial Sequence
  Synthetic sequence.
KDEEATKKLRKAHEDSERHIKKLSEDTKKVHEESDRHIRKVSKETEDEARRIEKELRK

SEQ ID NO: 12175 - protein, 56 aa, Artificial Sequence
  Synthetic sequence.
EDTLEKIIEENKRLNDELAKENKEVIKENRKLNRELEERNKEVIDRMERILEETKR

SEQ ID NO: 12176 - protein, 58 aa, Artificial Sequence
  Synthetic sequence.
REEELKREMEKAHEESERHLEELSRKTRDVHRRSEEHLKRLHERTKEVVDRIVEELRR

SEQ ID NO: 12177 - protein, 56 aa, Artificial Sequence
  Synthetic sequence.
EETLRRVIEKNRKLNEDIAKRNEEVIETNKKLNEEIARRNEEAIKTARKIVEDTKR

SEQ ID NO: 12178 - protein, 58 aa, Artificial Sequence
  Synthetic sequence.
REKEVVDRLREEVRRVEEEVDRLNKELEEIARKVERELDKINEDYKRRLDKVREDIKR

SEQ ID NO: 12179 - protein, 56 aa, Artificial Sequence
  Synthetic sequence.
EETVKRILETARELLDRWKKEVDEIVKTLEELLDRWRKEVERVKRENDKLLEELEK

SEQ ID NO: 12180 - protein, 59 aa, Artificial Sequence
  Synthetic sequence.
DEKKVLDDLRRIVEKVKRDLDELLKDNRRVLREVEEELKRLNEELRRIAEEVTRELRRL

SEQ ID NO: 12181 - protein, 56 aa, Artificial Sequence
  Synthetic sequence.
EKLAEEVARELRRLLREAEETSRDTKRKLREVLREWRELVKKIVDEMRRLLEEIKR

SEQ ID NO: 12182 - protein, 60 aa, Artificial Sequence
  Synthetic sequence.
DLERLVEEIKRRLRELLKELHKKSKEIEEEIRRILKRHHELLERIVRRLEELVEEVKRRN

SEQ ID NO: 12183 - protein, 56 aa, Artificial Sequence
  Synthetic sequence.
KKLLEDLEREIEKVKKAARDDLRRLEEIVRDVERRLRENVKRLKEEADRVKEELEK

SEQ ID NO: 12184 - protein, 60 aa, Artificial Sequence
  Synthetic sequence.
EELERIKDEIRRILEELKREMEELTKESDRILRELERENEESAKRIKEILDELEKRVRDK

SEQ ID NO: 12185 - protein, 59 aa, Artificial Sequence
  Synthetic sequence.
ETLLRRLRESLEKLAKEVEDLLRKYERDVRELAKEDRKLNEELLKRVDDLAKEVRERLR

SEQ ID NO: 12186 - protein, 61 aa, Artificial Sequence
  Synthetic sequence.
SKLEEIERELRELERSNEEEDRKWDDTTRKLEEDNREKNREWKKLTKDIRERVERLIRDLK

SEQ ID NO: 12187 - protein, 58 aa, Artificial Sequence
  Synthetic sequence.
EEARRLDEELEKVLRELKKRNEDTERRDREVNKKLEKENRDSEKENRDVLREIERALR

SEQ ID NO: 12188 - protein, 58 aa, Artificial Sequence
  Synthetic sequence.
KKLEDLEEEIKKLLEELKERNERSAREDREILERLRDENRRTAEELDKSVREILKKTG

SEQ ID NO: 12189 - protein, 59 aa, Artificial Sequence
  Synthetic sequence.
DRKLKEVRDTLEKLREENRKLNEEWRRKSEELRRRNEKVNKEVRDRNRETIERVDRKAK

SEQ ID NO: 12190 - protein, 61 aa, Artificial Sequence
  Synthetic sequence.
EELERADRRLDRLLEESERDLDTIIRKLKKVVEELERTLEEAKRKAERTLEEIRRELKEAG

SEQ ID NO: 12191 - protein, 60 aa, Artificial Sequence
  Synthetic sequence.
VEDLLREIKELLDDLRRHNEKLHRELEELIKTLRRHNEKLLEDIERLLRELRKEVEKLRR

SEQ ID NO: 12192 - protein, 60 aa, Artificial Sequence
  Synthetic sequence.
DELRELRRELRKLLEDIRRRLEELTRENRDVLRKSREELERLLRRLKELLDRIRDSLRKR

SEQ ID NO: 12193 - protein, 56 aa, Artificial Sequence
  Synthetic sequence.
KDKMKKLLRDLERKLKRAEEESKRHIRENEKLTEEAARKVEELLKEIKRKLEELEK

SEQ ID NO: 12194 - protein, 55 aa, Artificial Sequence
  Synthetic sequence.
SVEDTIRELEKRIRDLNREMERLNRESVEKIKRLNEKVRREIEDILREIKRLAEN

SEQ ID NO: 12195 - protein, 55 aa, Artificial Sequence
  Synthetic sequence.
ESLRRKLKKLADEHRETVDRMHEKNRKLADDHRDSVRKLEERIKRLTDRLREERK

SEQ ID NO: 12196 - protein, 56 aa, Artificial Sequence
  Synthetic sequence.
SEVEETLKRLEEVIREAEKTIDDSNREIEEAVRRIKTTIEKSNRDLKDLVEKLKRL

SEQ ID NO: 12197 - protein, 55 aa, Artificial Sequence
  Synthetic sequence.
EDVRRRVKEIIDKLERKIEESERNLKRIIEDLEREMRESEERVKEIIRDLERTEK

SEQ ID NO: 12198 - protein, 57 aa, Artificial Sequence
  Synthetic sequence.
SEIDEVLKRVEDSVREIERKLEEIERRLRRLNEEVKKRLDEIEEEIRRLVEELRRRN

SEQ ID NO: 12199 - protein, 59 aa, Artificial Sequence
  Synthetic sequence.
DDRLREIEKRIDDLNKKVRDEVERLKREADKSLETIKRLVEELKEKLDRLLEEVREEVR

SEQ ID NO: 12200 - protein, 59 aa, Artificial Sequence
  Synthetic sequence.
STRERLKKVLRDVERANKELSDRNKRVLEKLRRDVERLSRENEKLVRELEEAIKDLRRK

SEQ ID NO: 12201 - protein, 55 aa, Artificial Sequence
  Synthetic sequence.
EDLRREVEEVLKRIRDSNRDNRRKNEKVKKDIREILRRNEKRNREVNEKIRRDET

SEQ ID NO: 12202 - protein, 60 aa, Artificial Sequence
  Synthetic sequence.
KETEEVKDVLRRVRKRIEDLSKKNKDDLRRVEERNKELNERVKRLLEELKRRVDDLKRKG

SEQ ID NO: 12203 - protein, 58 aa, Artificial Sequence
  Synthetic sequence.
EDLERVEEDVRRVIKEIRDLARENHEENRDVIRRIRESNKRTEDEAREVLDRIRKTAT

SEQ ID NO: 12204 - protein, 56 aa, Artificial Sequence
  Synthetic sequence.
KEREEAEEMLKRLEEELRRLLEESEKIIERSERHLEKLLKDAEDEIRRVKEELDKI

SEQ ID NO: 12205 - protein, 59 aa, Artificial Sequence
  Synthetic sequence.
REEIRRLIERLRELLEEIARRIEKTNRELEELNKRLADDIKRLIDELERVLREVEERSR

SEQ ID NO: 12206 - protein, 56 aa, Artificial Sequence
  Synthetic sequence.
DEVETLLEEARKVLEELRKKIKELNEDSKRVLEELEKRIRDLDRRSTEVLRRLEES

SEQ ID NO: 12207 - protein, 55 aa, Artificial Sequence
  Synthetic sequence.
EELEDALRKIRKAVEELKKDVRRTLEEIKKEVKRLIEEARRSLDKIRRDVEKRDE

SEQ ID NO: 12208 - protein, 56 aa, Artificial Sequence
  Synthetic sequence.
EEVKRLVDDLREVTKENEKRARDLDRDSKRVSEENARKIETLNRDNERVNKELADS

SEQ ID NO: 12209 - protein, 55 aa, Artificial Sequence
  Synthetic sequence.
EKLDEDLERLERRNRKINEDAKTTLREIERENEELNKRLEETLRRSEKHLRDRRK

SEQ ID NO: 12210 - protein, 61 aa, Artificial Sequence
  Synthetic sequence.
REVEKLIKELEDLNRDHARKVKELIAELEKLLRDHAEKVRKLIEEARKTLEDLREIVERKG

SEQ ID NO: 12211 - protein, 55 aa, Artificial Sequence
  Synthetic sequence.
KDVREMIRRSEENLKRLNEEVKRAIRKVEEDLKELNKRARDVLEELRKRVEDTFR

SEQ ID NO: 12212 - protein, 57 aa, Artificial Sequence
  Synthetic sequence.
SEEEELEKRLRDSEREIEKWLRDLERVIEEVAREDKKIHEELEKILEDVKRELDKLG

SEQ ID NO: 12213 - protein, 59 aa, Artificial Sequence
  Synthetic sequence.
SKVVEKLVEDLRRINEEAKRRLERLKEELRKVLKDYKDEIDKLVEELKRTLDEVRKKAK

SEQ ID NO: 12214 - protein, 57 aa, Artificial Sequence
  Synthetic sequence.
DEEEDVRRTLEKVERDVERIDEDVERELRKVEEDDKRLHKELSEVVEKVERDIRRTG

SEQ ID NO: 12215 - protein, 59 aa, Artificial Sequence
  Synthetic sequence.
KKKLEELKERLKEALKRHEDKVRELKKELKKILDDYTEDVKRIKERLKRILEEIRRRKK

SEQ ID NO: 12216 - protein, 57 aa, Artificial Sequence
  Synthetic sequence.
SSEEDVKRELERVRREDERIHRDLERVLEESERRVETWDRDAKRTLEKVEEDLRRDG

SEQ ID NO: 12217 - protein, 59 aa, Artificial Sequence
  Synthetic sequence.
EELLEELKRRLKEILDRYRREAERLKRENEEMNKRHRERLEELKKRLKELLERMKEARK

SEQ ID NO: 12218 - protein, 57 aa, Artificial Sequence
  Synthetic sequence.
STEEDVRRVMKKVEDDVREINRDLERDLRRVEEAVERLDRDAKREIDRLREEIDREG

SEQ ID NO: 12219 - protein, 59 aa, Artificial Sequence
  Synthetic sequence.
EKFAEDLKRKLKKVLDEHRRRIEELKRELEEVLERHARELKRLKDELKKLVDDIRRRRK

SEQ ID NO: 12220 - protein, 57 aa, Artificial Sequence
  Synthetic sequence.
SDEEDVERELKRVKDEVDKINEDVRRELRKSEEDVERWDEDLERVVRRVEEEVRKTG

SEQ ID NO: 12221 - protein, 59 aa, Artificial Sequence
  Synthetic sequence.
KKVLEKLKKDLRDALKRHRDRVEKLKEENRKLNEDHKKTLEDIKEELKRLLDELKETRR

SEQ ID NO: 12222 - protein, 57 aa, Artificial Sequence
  Synthetic sequence.
SDEEDVERELERVKRDVERLDEDAKRVLDEVRKAVEEINRDVERDLRRVEEEIKKTG

SEQ ID NO: 12223 - protein, 59 aa, Artificial Sequence
  Synthetic sequence.
KEKLKELKERLKRLLDEHRRELKRLKDELKKALDDHKRKVDKLKKELKDILKKIRDDRR

SEQ ID NO: 12224 - protein, 57 aa, Artificial Sequence
  Synthetic sequence.
DDEDDVRRVLRRVAEEVRKLDEDLKRVLKESKERVKRWNDDAKRRLDKVREDLKRKG

SEQ ID NO: 12225 - protein, 59 aa, Artificial Sequence
  Synthetic sequence.
KKVLEELKKRLEDLLKRHEEEVRRLKEENKKLNDDHRRELERLKKELTDLLKRLDDERK

SEQ ID NO: 12226 - protein, 57 aa, Artificial Sequence
  Synthetic sequence.
SLEEDVKRVIDRVREAVKKINDEVEKELRKSEKAVEDWNRRLEEIHDRARRELEKAG

SEQ ID NO: 12227 - protein, 59 aa, Artificial Sequence
  Synthetic sequence.
KDKLEELKRRLKRLLDEHRKRVEELKEENKRLNKEHEKKVEDNVRRVRELLKRVEDRRR

SEQ ID NO: 12228 - protein, 60 aa, Artificial Sequence
  Synthetic sequence.
SEVEEIVKKLEELLRRWEKTVRDIVEELKRLLEEIEKLSRETKERLKKILEDVKRLAEEG

SEQ ID NO: 12229 - protein, 55 aa, Artificial Sequence
  Synthetic sequence.
DELEDIARRVKEELDRLNEELERIARKVKEDLKRLLEDNKRVLDEVKERLDRIRK

SEQ ID NO: 12230 - protein, 59 aa, Artificial Sequence
  Synthetic sequence.
SEIEDIVRRLEELLERWKRRVDKAKERNKRLLEKWAKEVEDIKRELEKLLEDVRRLKEE

SEQ ID NO: 12231 - protein, 55 aa, Artificial Sequence
  Synthetic sequence.
DELEKIVEDVERELDKINEDYNRVLKRVEEELDRLNEDLNRVAKRVKDALRKIEE

SEQ ID NO: 12232 - protein, 59 aa, Artificial Sequence
  Synthetic sequence.
SEIEKVVEEAKKLLKRWEDEVRKHDKELKEVLDRWKKEVDDIKRRLEELLREVRRLKEE

SEQ ID NO: 12233 - protein, 55 aa, Artificial Sequence
  Synthetic sequence.
DELRKIVEDVERELDRLNDENRDSLRRVVEALEEINKDLNRDVKRVKDELDKTRK

SEQ ID NO: 12234 - protein, 59 aa, Artificial Sequence
  Synthetic sequence.
SEVEEIKKELKKLDEENKRVIDRIVREIERLNEENERVARKVIKEIEELLRKLEKLRRD

SEQ ID NO: 12235 - protein, 55 aa, Artificial Sequence
  Synthetic sequence.
EDLRRVLKESEDRNRKLLEDLERKVRDVKRRDDELLKRAREALKRVKDEIEKIRK

SEQ ID NO: 12236 - protein, 59 aa, Artificial Sequence
  Synthetic sequence.
SEVEDIIRRIKELDDRNERKVRELVKTNEKLLRDLHEKSKRIVKEMRELLKEIEDLARR

SEQ ID NO: 12237 - protein, 55 aa, Artificial Sequence
  Synthetic sequence.
EELKRVIDESKKRNEKLMRDYEEISKKVHEDVERDAERLRRIAKEVEEELERVRK

SEQ ID NO: 12238 - protein, 59 aa, Artificial Sequence
  Synthetic sequence.
SEVEKIKEDLKRLLDEVRKKAEELKRENRELLRRLHELSKKIIRELEKLLEELADLVRK

SEQ ID NO: 12239 - protein, 55 aa, Artificial Sequence
  Synthetic sequence.
EDLERTIREVEKELRRLLEDYRRESKKVHEDIDEDRRRLEDAVREVEKEIEKVRR

SEQ ID NO: 12240 - protein, 60 aa, Artificial Sequence
  Synthetic sequence.
SEVERIKEDIKKSNEDIRRTAEEIKERIKKSNKEVEDEVREIKERIKRILDKLKRVKEEG

SEQ ID NO: 12241 - protein, 59 aa, Artificial Sequence
  Synthetic sequence.
KSVVDDLERVMKESEERVKRIIDDLERTLRESEKNLKRIIDDLERVMREAREAIDRLKK

SEQ ID NO: 12242 - protein, 60 aa, Artificial Sequence
  Synthetic sequence.
SEDDELRRRLEELKRRIEDLIRKLREVLKRSEDELRKILRELREVDKDLRRRIEELIKDI

SEQ ID NO: 12243 - protein, 56 aa, Artificial Sequence
  Synthetic sequence.
EDEAKKRLEEILRRAEELLERLKRTNERVNRKVREDMKRAKEHAKRLLEEAEELAR

SEQ ID NO: 12244 - protein, 57 aa, Artificial Sequence
  Synthetic sequence.
DEVEELIKEVEKVNEDAARESEKRNRELKKMLERVKRENKRLIRELKELLDDARRKN

SEQ ID NO: 12245 - protein, 59 aa, Artificial Sequence
  Synthetic sequence.
REVLKKLEEVLRESKKRLKEWNDRNKKTLDDIRREIEKSKKEHEDALRRIEEELKKTET

SEQ ID NO: 12246 - protein, 57 aa, Artificial Sequence
  Synthetic sequence.
SELEKLVKELRDLNEKVARDSKRLNDKLEEVLDRLRRRNEELIKRLEEVLEDVERKN

SEQ ID NO: 12247 - protein, 59 aa, Artificial Sequence
  Synthetic sequence.
KELLDRLRKMLKESRDSLRKLNKENEETLRRIKKKLDESKRKHEEVLKDIKRRLEELSR

SEQ ID NO: 12248 - protein, 57 aa, Artificial Sequence
  Synthetic sequence.
DEVERIIERLRRVNKRVREENERLIKEIEDLITEIAKRSRDLNRELDKTLKDVRRKN

SEQ ID NO: 12249 - protein, 59 aa, Artificial Sequence
  Synthetic sequence.
EEVLRRLEKVLRESRKSLEDSAKKHKDVLDEVKKTLKKLNDENREVLKRIKKELDKTRT

SEQ ID NO: 12250 - protein, 56 aa, Artificial Sequence
  Synthetic sequence.
SEVEKLIEDMKKVAKELADESEEHIKRAEEVIDRLAKEVEKHDRDVEDTIRRLEES

SEQ ID NO: 12251 - protein, 59 aa, Artificial Sequence
  Synthetic sequence.
EEVKKRLREMLEELRRRLERLKDKNKEVLDRLEEKLRKLEKENDDSLKEAEDKLRERER

SEQ ID NO: 12252 - protein, 56 aa, Artificial Sequence
  Synthetic sequence.
SEVEKLIEDIERIIRTLAEEVRRHDEDARRVLEDLARKVRKHNEDVKKVLEDLRES

SEQ ID NO: 12253 - protein, 59 aa, Artificial Sequence
  Synthetic sequence.
EEMKERLRRMLKRAEDELRRLEEENDRVVERLERELRRLTEDNKRTLKKIEEDLRRREK

SEQ ID NO: 12254 - protein, 56 aa, Artificial Sequence
  Synthetic sequence.
DEVRDLIRRLEETVKRLADEVREHDKRARDILRELKKEVKETNRRSEKVADDLEKS

SEQ ID NO: 12255 - protein, 59 aa, Artificial Sequence
  Synthetic sequence.
EEVKERLKKVLEKLKRDLEKLKEDNRRVLKELEEELRKIKEELDKSLDDLRKRLEDRKK

SEQ ID NO: 12256 - protein, 60 aa, Artificial Sequence
  Synthetic sequence.
SLEEKFRRVLEESKESLERLKRKVEKVLRESEERLKRWLDKVKKVLEEVDDALRRLKDRL

SEQ ID NO: 12257 - protein, 59 aa, Artificial Sequence
  Synthetic sequence.
KEIVERLIEELKKLNKELADRLEEIIRRLEEINERLRERIERIITRLRRLLEELEREAE

SEQ ID NO: 12258 - protein, 60 aa, Artificial Sequence
  Synthetic sequence.
SEDEDLKRVLDEAEKRLKDLLDDLRRALKRSEDELRKNNEDLERVLKRVEERLKELLDRV

SEQ ID NO: 12259 - protein, 59 aa, Artificial Sequence
  Synthetic sequence.
REIVEEIKKRIRDLLRELEKKIEELKTTSERLNREHHKKIEDIKKEIEDLVRELEKKVK

SEQ ID NO: 12260 - protein, 60 aa, Artificial Sequence
  Synthetic sequence.
SLREKLEEVLRRIEEALERIREEVEKVLRDSRDDNRRVLKELKELLERVREALEDLLRKV

SEQ ID NO: 12261 - protein, 59 aa, Artificial Sequence
  Synthetic sequence.
DKIVKEIIEELEKLLRDIKKRARELIEESKRINEDNNRRAEEVAEEIRRLLEELERKLR

SEQ ID NO: 12262 - protein, 60 aa, Artificial Sequence
  Synthetic sequence.
SLEEDVKRVLREAEEELKKNNERLRKVIEDSKRDNDRVLDELRKVLEDIEKALRDLLREV

SEQ ID NO: 12263 - protein, 59 aa, Artificial Sequence
  Synthetic sequence.
DKIVDEVRKEIEKLVRDHHKRIKDLKDDLKRLNDENNKRAKEIIDEMKRLLEEIEKRVR

SEQ ID NO: 12264 - protein, 61 aa, Artificial Sequence
  Synthetic sequence.
KDVEDIKRRIEELNKKLKEKIERIKKRIKELNEEAAKKVEEIKERLKRLLDEIRELVRRDG

SEQ ID NO: 12265 - protein, 59 aa, Artificial Sequence
  Synthetic sequence.
DSLRKRLEEVLRESKKTAEDLKRDLRRALEESKKNLKRLLDEVRKVIDEIRKALEELER

SEQ ID NO: 12266 - protein, 61 aa, Artificial Sequence
  Synthetic sequence.
SEVEKIKKDIKDLNDDARRRLEEIKRRLEKLLKELEEKHRELKKELKKLLDEVRDLVRREG

SEQ ID NO: 12267 - protein, 59 aa, Artificial Sequence
  Synthetic sequence.
DRLREDAERVLRESKKNLDELEKDVRRVIKRIEDEARRLNEDLKRMLERIKRELEKLEK

SEQ ID NO: 12268 - protein, 60 aa, Artificial Sequence
  Synthetic sequence.
SEEERLEEVLKRVETELRRLKRELEKVLRESEEALREIIKKIEDAVRDNAEKVKKLSRTV

SEQ ID NO: 12269 - protein, 55 aa, Artificial Sequence
  Synthetic sequence.
RRVEKELEDLLRTATKVLEDLKRDLKRLNEETEEVVKTLEDSHRRSNEEVERRVR

SEQ ID NO: 12270 - protein, 60 aa, Artificial Sequence
  Synthetic sequence.
REREELEEVLERSKRELERLVEEIKRALDESRRRLEEIEKRIEEVIRRNKEEIKKLSRRV

SEQ ID NO: 12271 - protein, 55 aa, Artificial Sequence
  Synthetic sequence.
EKLKEELKELNRESRKVVEDLREKLDRLNKDTERVVRELEKEHRKSNEEVRKTVK

SEQ ID NO: 12272 - protein, 61 aa, Artificial Sequence
  Synthetic sequence.
DEEEELKEDIKRILEELRRLAKEHEELNRRINKELEDLVREHKKRLEDALKRLREIVRDRG

SEQ ID NO: 12273 - protein, 55 aa, Artificial Sequence
  Synthetic sequence.
EELEKVLKEAEDDVERIKKRLKRINDESRKHVERLKEELDRADKRIEDEVEKLKK

SEQ ID NO: 12274 - protein, 61 aa, Artificial Sequence
  Synthetic sequence.
RIEERLKRVVDKVDDTLRKSEKHLEDVVRDADRDIDRNRRENEKVVKEAEDILRRLVEEAG

SEQ ID NO: 12275 - protein, 59 aa, Artificial Sequence
  Synthetic sequence.
EDKVRELEEEAERLLDELRRKNEEAVRRIKKLLDDLNKHSEETIRRIKKLLKELEDKTR

SEQ ID NO: 12276 - protein, 57 aa, Artificial Sequence
  Synthetic sequence.
STEEKLKELKKEADKLLKELDKELRDNLRRLRKIVEELKKENRDLTRESEEVLKRLN

SEQ ID NO: 12277 - protein, 59 aa, Artificial Sequence
  Synthetic sequence.
DKDVKKLIEEIRRILEKAREEVERLSRDSKRVAEELRKRHKELIDRNKRVLEELKRRRD

SEQ ID NO: 12278 - protein, 60 aa, Artificial Sequence
  Synthetic sequence.
SEVEEVARRSRKLNDDLKKIIEELIRRSRKINDELRREIERLIRESRKLNRELEELKRRG

SEQ ID NO: 12279 - protein, 56 aa, Artificial Sequence
  Synthetic sequence.
EDKVRRLNEENKESLRRLERELEKLNKENEDSLRTLEELLRELNKENKRSLDELRK

SEQ ID NO: 12280 - protein, 56 aa, Artificial Sequence
  Synthetic sequence.
SLVEEVEERVKKLHDENRELDRKSKRDVEEVHKKNEKLIKDVERTVREMIRKLREL

SEQ ID NO: 12281 - protein, 56 aa, Artificial Sequence
  Synthetic sequence.
EEELRRLEEELRRSIKESREELRRLEDELRRSIEKLEDALRRLAKELDEVIKDLKD

SEQ ID NO: 12282 - protein, 56 aa, Artificial Sequence
  Synthetic sequence.
SLVDEVRRRVDELHKDNKRLDDESEKKVRDAHRENERLDDESRRKVKEAIRKLEEL

SEQ ID NO: 12283 - protein, 56 aa, Artificial Sequence
  Synthetic sequence.
KESLDRLAEKLKKSIKESEDILRELEKRLRDSIRESRKILEDLRRELEEVIKRLED

SEQ ID NO: 12284 - protein, 56 aa, Artificial Sequence
  Synthetic sequence.
SLAEEVEKRVRDLHRKNEELDRESEKKVRDMDRKNKELIKRAEEEVKKVIDKLRKL

SEQ ID NO: 12285 - protein, 56 aa, Artificial Sequence
  Synthetic sequence.
EEKLRELARRLKESIRESRERLRRLEKELEDSIRELRRAIDTLTKRLEKAIEELER

SEQ ID NO: 12286 - protein, 56 aa, Artificial Sequence
  Synthetic sequence.
SLVEEVERRVRKLHEENKKLDKESEDKVREANRRNEELIKKVTESVRRMIEKLRRL

SEQ ID NO: 12287 - protein, 56 aa, Artificial Sequence
  Synthetic sequence.
EEELRRLADELRRSIEESERILKKLEEELRRSIEELRRALEELDEELKRVIRELER

SEQ ID NO: 12288 - protein, 56 aa, Artificial Sequence
  Synthetic sequence.
SLVEEVKKRVDDLHKRNRELDDRSEKMVRKANEENKELDKKSKEDVDRLIERAERL

SEQ ID NO: 12289 - protein, 56 aa, Artificial Sequence
  Synthetic sequence.
EEELRRLAEKLKRSIEESREILKELERRLRESIRRSREILKRLKEELERAIERLRR

SEQ ID NO: 12290 - protein, 56 aa, Artificial Sequence
  Synthetic sequence.
SLAEEVEKLVRDLHRKNKELDRRSKKTVEDIEREARELDKRSKEEVERMIKKLREL

SEQ ID NO: 12291 - protein, 56 aa, Artificial Sequence
  Synthetic sequence.
EDKLRELEKELRDSIRESREILERLERRLEELIRRSKRILEELERELEEVIRELRR

SEQ ID NO: 12292 - protein, 56 aa, Artificial Sequence
  Synthetic sequence.
SLDDDVEKKVRELDKRNEDLDRKSEKEVEKVHRKNKRLDDESEKEVKRMIEELKKL

SEQ ID NO: 12293 - protein, 56 aa, Artificial Sequence
  Synthetic sequence.
EEELRRLAEELRESIERSRERLKELERRLRESIARSREILEELERRLKRAIEDLER

SEQ ID NO: 12294 - protein, 56 aa, Artificial Sequence
  Synthetic sequence.
SLAEDVEEKVKELNRRNKKLDDESKEMVKRAHDRNRELDERSKDRVRRVIEKLRRL

SEQ ID NO: 12295 - protein, 56 aa, Artificial Sequence
  Synthetic sequence.
KEKLEELAERLRKSIEESRDILRRLEKELRDSIKRSEEILKELTDRLRKVIKDLRD

SEQ ID NO: 12296 - protein, 56 aa, Artificial Sequence
  Synthetic sequence.
SLVEEAERRVRELIKELERLDDRSREMVKEMHERNRELIERVEKRVREVIEELRRL

SEQ ID NO: 12297 - protein, 56 aa, Artificial Sequence
  Synthetic sequence.
EDDLRKLAEDLKRVLKRSRDILRKLEEDLRRSIRELEEALRKLEEDLRRAIEELET

SEQ ID NO: 12298 - protein, 56 aa, Artificial Sequence
  Synthetic sequence.
SLKDDVEKKVEDLKKEAKDLDRESDKKVKTAHKRNEELDRKSADDVRKLIRKLEKL

SEQ ID NO: 12299 - protein, 56 aa, Artificial Sequence
  Synthetic sequence.
EEELKRLAEELERLIRDSRRILEELKRELKRSIEESRKILEDLERELEKVIRELKR

SEQ ID NO: 12300 - protein, 56 aa, Artificial Sequence
  Synthetic sequence.
SLAEEVERDVKRLDEENKRLDDRSRREVEKMDEENKKLIEDARREVREMIEKLKKL

SEQ ID NO: 12301 - protein, 56 aa, Artificial Sequence
  Synthetic sequence.
DEKLKELAKRLRDSLERSKEELKKLEEELRKSIKELEDALKKLEEDLRDVIRKLEE

SEQ ID NO: 12302 - protein, 56 aa, Artificial Sequence
  Synthetic sequence.
SLVEDVERKVRELDKRNRDLDRKSKRKVEEADKENRKLDEDSERKVRELERKATEL

SEQ ID NO: 12303 - protein, 56 aa, Artificial Sequence
  Synthetic sequence.
EESLRRLEEELRKSIKESKEILDELRKELEKSIRESKERLKELEKRLEELIRELKR

SEQ ID NO: 12304 - protein, 56 aa, Artificial Sequence
  Synthetic sequence.
KLVEDAEELVRRLDEENKRLDDDSKRRVEEANRENEKLIKEIEDEVRKMIKKLRDL

SEQ ID NO: 12305 - protein, 56 aa, Artificial Sequence
  Synthetic sequence.
EEELRKLAKRLKDSIDRSRKILEELERELRRSIDELRRALEELTDELRKVIEELRK

SEQ ID NO: 12306 - protein, 56 aa, Artificial Sequence
  Synthetic sequence.
SLAEEVEKEVKKLDEENRKLDRDSTETVKELNKKNERLDRESKRKVDEVIEKLERL

SEQ ID NO: 12307 - protein, 56 aa, Artificial Sequence
  Synthetic sequence.
KEKLDELADELKKSLDRSRRILERLEEELRRSIRRSEDILRRLKEELERVIRELRR

SEQ ID NO: 12308 - protein, 59 aa, Artificial Sequence
  Synthetic sequence.
SVDEEVEKLLKEHEERIRELIKEVEKLNREHAKRIEELIRKLKETNKRIADKIRDLKRQ

SEQ ID NO: 12309 - protein, 56 aa, Artificial Sequence
  Synthetic sequence.
EEKLRTIARRIKELNDRFKRAIDESRKHIEELNRRLEKVVEDSRRHLEELADEVRR

SEQ ID NO: 12310 - protein, 59 aa, Artificial Sequence
  Synthetic sequence.
SVLEELKRLLDEHRERLERLIRELRKLNEDHDRRIKELIERLKKLNEDIAKRIEDLKRD

SEQ ID NO: 12311 - protein, 56 aa, Artificial Sequence
  Synthetic sequence.
EDVLRKIEEDIKRLNREVEKAIRESEENIKRTNKRFKDELRKSEKHLEELVKRFRD

SEQ ID NO: 12312 - protein, 59 aa, Artificial Sequence
  Synthetic sequence.
SVLEEVTKLLKDHEDRIREIIKRLRKLNRDIDERIKRLIDEVRKKNDDIRRKIEELKRR

SEQ ID NO: 12313 - protein, 56 aa, Artificial Sequence
  Synthetic sequence.
EERLKRLREELEKLNRDVERVIKESKENLDRTVTEAKRELKRSEDNLERLAREFER

SEQ ID NO: 12314 - protein, 59 aa, Artificial Sequence
  Synthetic sequence.
TEEEILRRVERDLERLNRELERIVREVEKELKKINDDYERVLKKVKDDIDRIREELDRQ

SEQ ID NO: 12315 - protein, 56 aa, Artificial Sequence
  Synthetic sequence.
DKELEELLKRWEEDVKRIVEEVKKLLDEWRERVKRAKDENEKLLRDLEKLVEDLAR

SEQ ID NO: 12316 - protein, 59 aa, Artificial Sequence
  Synthetic sequence.
SKEDVLREVKRELKRLLDDNRRMLEEVEEAARRLNKDYNDVLKEVEEEIEKIIRELEKK

SEQ ID NO: 12317 - protein, 56 aa, Artificial Sequence
  Synthetic sequence.
EEDLKRLLDEVRRLSEKTKEDLERILRKWKEDVERAKERNRRELERLEREIKELAR

SEQ ID NO: 12318 - protein, 57 aa, Artificial Sequence
  Synthetic sequence.
ELDKIVEEVRKALREILEDYKRFSKEIHDRDKELADRLREILKDVKRAVDELIKKLS

SEQ ID NO: 12319 - protein, 60 aa, Artificial Sequence
  Synthetic sequence.
VEDVVRKLRELLERFRKKAEDLKEENKRINEENERKIREIVKTLRKLLDELREKLERTKK

SEQ ID NO: 12320 - protein, 57 aa, Artificial Sequence
  Synthetic sequence.
SLEDTLRKVDKDLKDNMRRLEETAEKVRRDIDRDEERLRRISEELHRRIEELIKRLS

SEQ ID NO: 12321 - protein, 60 aa, Artificial Sequence
  Synthetic sequence.
VEDVVRDAKRLLDEHHDLARKIVEDLRRLLEDLHRKSKKSVEDNERLLKRMEEILRETER

SEQ ID NO: 12322 - protein, 56 aa, Artificial Sequence
  Synthetic sequence.
SELEEVARRVEKLLEKHKEDLKRLLEKSEEDLRRAEEEVKRLLEEIREELDRLRKR

SEQ ID NO: 12323 - protein, 55 aa, Artificial Sequence
  Synthetic sequence.
EEIKKVRKKVEDVHEESKRLNEENRRRTKEVSDKIREIIKEIRKEIKKASDELEK

SEQ ID NO: 12324 - protein, 56 aa, Artificial Sequence
  Synthetic sequence.
DELERAVEEVEKRLREHLERIKRLLEESRELLKRHEKLLEDVLRRIRELLKRAEDR

SEQ ID NO: 12325 - protein, 55 aa, Artificial Sequence
  Synthetic sequence.
ELIKRVKERVKEAHKRSRELNERNRRETEKMHKKSRDLLRKIREEVDRMSDKLRK

SEQ ID NO: 12326 - protein, 56 aa, Artificial Sequence
  Synthetic sequence.
SEEELLRELEKKLRELRRKVDETLRDLRRRLKELEEDHRRTLEESERHLREVEKKL

SEQ ID NO: 12327 - protein, 55 aa, Artificial Sequence
  Synthetic sequence.
EKLDRRVEELIKEIEELLREVEKLVEDLIRTIKKLNDDLREDNKRLAKEMEDRAR

SEQ ID NO: 12328 - protein, 61 aa, Artificial Sequence
  Synthetic sequence.
SAVEDLEREVRKLIRDLEDLIRRLEERNKRIAEEIEKLNEELNRENKRIADEIRRIKDERG

SEQ ID NO: 12329 - protein, 56 aa, Artificial Sequence
  Synthetic sequence.
EEALERLKRELRKLAEELKKVLKRSRDHLKEVKRRHDENIKRSDDHLKRVADEARK

SEQ ID NO: 12330 - protein, 61 aa, Artificial Sequence
  Synthetic sequence.
SVAEELEKDIRRIEEEIKELLERHRELNERIVREIEDLNRKLNEMNKRVVEELRKVKRDRG

SEQ ID NO: 12331 - protein, 56 aa, Artificial Sequence
  Synthetic sequence.
DRVLKKLEKRLRELEEEAKKLLKESKEHVDEVRKRHEENIRRSEEHLRRVLEELRR

SEQ ID NO: 12332 - protein, 60 aa, Artificial Sequence
  Synthetic sequence.
SVVEELERRIEEIAREIEELNERHNRKNKEIADRIRDLNRRLNEANKKIVREIEEIKRRD

SEQ ID NO: 12333 - protein, 56 aa, Artificial Sequence
  Synthetic sequence.
SRVLDKLRKELDDLRRRHEENVDRSRKHLEEVRKEHEENIKRSERHLEEVKKEAER

SEQ ID NO: 12334 - protein, 61 aa, Artificial Sequence
  Synthetic sequence.
SVVETLEKRVRELIETLERLIERLDRENKRVAEEIKRLLDEHDKTNKEIVERIRDIKRREG

SEQ ID NO: 12335 - protein, 56 aa, Artificial Sequence
  Synthetic sequence.
SRVLRKLEEELRKLEEKLRKLLKDSEDHLREVLERAKRVLDDSRRHVDEVRREAEE

SEQ ID NO: 12336 - protein, 61 aa, Artificial Sequence
  Synthetic sequence.
SVMEDLERRIREIIKEIEKLLEDLKRENRRVAEEIERLNREHNELNKRIAEEIERIKRRRG

SEQ ID NO: 12337 - protein, 56 aa, Artificial Sequence
  Synthetic sequence.
SRVLKKIEDELKKLEDKAREVLKRSRDHLKKVEDDHRENVRRSEEHVKDVLRRFEE

SEQ ID NO: 12338 - protein, 61 aa, Artificial Sequence
  Synthetic sequence.
KVLEDLDRDIKRIIDEIRRLNEELNREIEEIKRRIKRLNEEHNERNKRLAEEARRIKDERG

SEQ ID NO: 12339 - protein, 56 aa, Artificial Sequence
  Synthetic sequence.
DEVLKRLEEKLERLREEHERNAREIRKELEKLEKEHRENVERSRRHVERVEREFET

SEQ ID NO: 12340 - protein, 61 aa, Artificial Sequence
  Synthetic sequence.
SVVERLKEIAEEIIRRIEELNKEHNKRNREIAETIERLNREHNELNKTLVREMKEIKRDKG

SEQ ID NO: 12341 - protein, 56 aa, Artificial Sequence
  Synthetic sequence.
SEVLKKIEEDLRRLLRKHEENSKESEKHVEEVEERHRRNAEDSKRHVEKVKEEVDR

SEQ ID NO: 12342 - protein, 59 aa, Artificial Sequence
  Synthetic sequence.
STEEVLKEIRDRLEELKREAKKVNDDTRERLKELEERNRRANEESKRRLEELERRVEER

SEQ ID NO: 12343 - protein, 59 aa, Artificial Sequence
  Synthetic sequence.
ERLLRELRRKLKEVEDTIRELNERLRKRIREIEEEVRESNERLRKKLREILEEIKETEK

SEQ ID NO: 12344 - protein, 59 aa, Artificial Sequence
  Synthetic sequence.
SVVEEIDKIIKRIADRVRKIIEDLERLNKEIADLLRRIIEELKRLNDRIREEVDRLRRR

SEQ ID NO: 12345 - protein, 56 aa, Artificial Sequence
  Synthetic sequence.
EKVLEDVERKLERLKREVRRVLEESRKRLKEWKDRAREVLEESKRSLEEISRRLRE

SEQ ID NO: 12346 - protein, 59 aa, Artificial Sequence
  Synthetic sequence.
SADETLRKVVEEVARKSEKLNKELEKVNKDLARAVEELIEELKDVITKIEERAKRLKDR

SEQ ID NO: 12347 - protein, 56 aa, Artificial Sequence
  Synthetic sequence.
ERVLEEIRERIERLNKRNKEVLDRSEESLRRLAEKLRRVIERVEEKLRKIEEDLKT

SEQ ID NO: 12348 - protein, 61 aa, Artificial Sequence
  Synthetic sequence.
DKEDAIRTAEKRIRDSERENEKVDEDYRRELKRSEDKNEKADKEYKRRIEELVRRLLETRG

SEQ ID NO: 12349 - protein, 56 aa, Artificial Sequence
  Synthetic sequence.
EDTLRKLVDDIEERNRRIIEELKRHLDKLREDNERVIEELKRHLEEVAREVERRRK

SEQ ID NO: 12350 - protein, 56 aa, Artificial Sequence
  Synthetic sequence.
SEKEEAEKLLREHHEKIKRLKEESKRINDENRKRIEELKRRSREINKELEEKVRRN

SEQ ID NO: 12351 - protein, 56 aa, Artificial Sequence
  Synthetic sequence.
EDTVKRIEDELKKNLDDLRRVLEKSKDDNRKLLEDLERELRESKKDARRLLEEVRK

SEQ ID NO: 12352 - protein, 56 aa, Artificial Sequence
  Synthetic sequence.
SKEEELEKLLREHHEKIKRLKEESKRINDRIRRTVEELIKESEKINRDINDTVRKN

SEQ ID NO: 12353 - protein, 56 aa, Artificial Sequence
  Synthetic sequence.
EDSVERIKRELERNLDDLRRVLKESEDDLREILRRLKEVLEESERDLERVEREVRK

SEQ ID NO: 12354 - protein, 59 aa, Artificial Sequence
  Synthetic sequence.
SELEELLERLERLIEENRRELEELIRELKEESDRTREELKRLIDRLKEKIDRVLKLKED

SEQ ID NO: 12355 - protein, 56 aa, Artificial Sequence
  Synthetic sequence.
KDVLKEARERLRKLHEETKEAKKDLDRILDENEKEVKEVKKRLEDLLKELRDRLRK

SEQ ID NO: 12356 - protein, 57 aa, Artificial Sequence
  Synthetic sequence.
SELEEVLKRIREEAERLMRRNEETLRRVKKTIEDLLRRNEKRLEDVKREADEIEKRK

SEQ ID NO: 12357 - protein, 55 aa, Artificial Sequence
  Synthetic sequence.
ERVKEEIERIEKRVREVHEEVNKRIEDLRREYRKEHKRVEDEIRRILREVREKRR

SEQ ID NO: 12358 - protein, 56 aa, Artificial Sequence
  Synthetic sequence.
SEKEEVKKESEKLSRDTKKRSDEVHKEIKRLTDETERELREVEKEIERLAEELRRQ

SEQ ID NO: 12359 - protein, 59 aa, Artificial Sequence
  Synthetic sequence.
EKVLEDELRENKKENKDLKERHDRTLEEVERTNRKVKEELRRVLRRVEESVREVAERAT

SEQ ID NO: 12360 - protein, 61 aa, Artificial Sequence
  Synthetic sequence.
SKEETIEKRVEELKRENDEKVERIKREIEDLIRRNKELLERIKKEVRELLKELKDRAEKKG

SEQ ID NO: 12361 - protein, 60 aa, Artificial Sequence
  Synthetic sequence.
DRELDKALEDIERRIREHNKELDDELRKVREDSRRHLEKLKRELEEIREEARRITEELKK

SEQ ID NO: 12362 - protein, 60 aa, Artificial Sequence
  Synthetic sequence.
EEKELLDKLKEDADRIKKELEDTLRELKKKHDDVNDRNRKHHEEVRRRAEKIKDKLRRDK

SEQ ID NO: 12363 - protein, 55 aa, Artificial Sequence
  Synthetic sequence.
EEVRKRLDDLEREIKKIIDEIDERHRRLTEENKRSLDRDREELEKLKEEIKRTAD

SEQ ID NO: 12364 - protein, 58 aa, Artificial Sequence
  Synthetic sequence.
DEAEKIKEDAKRLIEENDEIVRRIEEEMKKSHKENREILKKIKEDVDRSHEDLRRRSG

SEQ ID NO: 12365 - protein, 56 aa, Artificial Sequence
  Synthetic sequence.
EEVLKDLRRRSEEHKKKLEDDLRRHEKKSRDHKEKLKELLERHKRRVEEVRKRETK

SEQ ID NO: 12366 - protein, 60 aa, Artificial Sequence
  Synthetic sequence.
SREELMEELERLLERLIREIEKASRENEERVKELKREIEESTKRNKETAKKLLDELTRSN

SEQ ID NO: 12367 - protein, 55 aa, Artificial Sequence
  Synthetic sequence.
DELRKTLEDIRRRVEEAKERHRRILKTIKERSEKLTREHRKVNEDIEEKLRRAKK

SEQ ID NO: 12368 - protein, 61 aa, Artificial Sequence
  Synthetic sequence.
SERETVERVLDRLREELEKIKKELEDVNRESKKEVERLLRRNEELHKKVEKDARDILRKKG

SEQ ID NO: 12369 - protein, 55 aa, Artificial Sequence
  Synthetic sequence.
EELKKTLDKILEDAKEEVREDRKRNEKLNRELEERSRRNEEDLRRLLKKLKDEAD

SEQ ID NO: 12370 - protein, 60 aa, Artificial Sequence
  Synthetic sequence.
DEKETIEERRKEIEKIIKDLEKNVRDHEKRIEEIIKEIRDNTEKLKKEAEDLLRRIRKEG

SEQ ID NO: 12371 - protein, 55 aa, Artificial Sequence
  Synthetic sequence.
RELEETLRRLDERTKKVIKEAEDVHRRLRERLRKIEKEHEDTLRELKKRLDDEAR

SEQ ID NO: 12372 - protein, 61 aa, Artificial Sequence
  Synthetic sequence.
SAEDRLREADERYERELRRLKRELEEVIKEYRKAIEELKKELEDVLRRFREELKRLEEEKG

SEQ ID NO: 12373 - protein, 58 aa, Artificial Sequence
  Synthetic sequence.
EEVREIIERLKESLKRNEEDVRRLIRRLKEELKRNKEEVERLKKELEDILRELADRAR

SEQ ID NO: 12374 - protein, 61 aa, Artificial Sequence
  Synthetic sequence.
DAERELKKVEDEYEKRIRDLERDLRRVLEEYERAIEELKKELDDVLREAEKALEDLLRKKG

SEQ ID NO: 12375 - protein, 59 aa, Artificial Sequence
  Synthetic sequence.
GEEVKEIKKELEESLKRNEDKVRELKRRLEELLKENEKKVRELIRRLEEELRRLAERTR

SEQ ID NO: 12376 - protein, 61 aa, Artificial Sequence
  Synthetic sequence.
SAEEELKKVDDDYEREIRRLEKELEDVLRDVDRDHRRLEEELKKVIRDIEEALKDLLRKKG

SEQ ID NO: 12377 - protein, 58 aa, Artificial Sequence
  Synthetic sequence.
EEVREIKERLRKSLEDNERKVKEIIDRIREDLKENRDRVRKLIKDLDDELKELAKKAK

SEQ ID NO: 12378 - protein, 60 aa, Artificial Sequence
  Synthetic sequence.
DEEREIEERIKRILEDLKRNLEDNERKIRKIVKDNRENNKRNEDKIRRILEELKRAKEEG

SEQ ID NO: 12379 - protein, 55 aa, Artificial Sequence
  Synthetic sequence.
ERVRKLEKDLEKALEEIRRRYEELLKRLKRENEESKKTYDKLIEELRRAAREIKR

SEQ ID NO: 12380 - protein, 60 aa, Artificial Sequence
  Synthetic sequence.
DEKERIEEEIRRILRELEELTERNEKKIRDIVREIRKNSEENRRKIEKILEELEELKKEG

SEQ ID NO: 12381 - protein, 55 aa, Artificial Sequence
  Synthetic sequence.
EEVEELLRRLRKRLEDLERRNKELLEELKERLERAEKRNRDLLKELEDALERIRK

SEQ ID NO: 12382 - protein, 60 aa, Artificial Sequence
  Synthetic sequence.
DEEEEIEKKLRKNIRDAEEKTKRNKERAEDNLRKARENSKRNEEDIRRKLKRLKELKEEG

SEQ ID NO: 12383 - protein, 55 aa, Artificial Sequence
  Synthetic sequence.
ERVDRLKKELERMHRKLDKENRDIEKRVREEHRRLTERNRKLLEDLEEALERIRT

SEQ ID NO: 12384 - protein, 60 aa, Artificial Sequence
  Synthetic sequence.
SEEEEIERRLRDNIRKAEENTRRNKEKIDRILEEMRENSKENKRRIEEILDELRKLKEEG

SEQ ID NO: 12385 - protein, 55 aa, Artificial Sequence
  Synthetic sequence.
ERVDELKEKVERDHERLRKENEDLLRELRKRLDELRRENEKLLRELEEALDRIRK

SEQ ID NO: 12386 - protein, 60 aa, Artificial Sequence
  Synthetic sequence.
SELERVREEIRRLERENEETLREVEEKIRKLLEENREALERVEERVRRVKEELKEVRRRQ

SEQ ID NO: 12387 - protein, 59 aa, Artificial Sequence
  Synthetic sequence.
DDVRRDIERLDEEYERRHKDVNRKLKRLDDEYEKATRDVRRRLEELTKELRDEAEKVRK

SEQ ID NO: 12388 - protein, 56 aa, Artificial Sequence
  Synthetic sequence.
SERERVDRLEERYEEESRRVEEELRRLLKRYEDFHRELRKRLEDIVREVRKTLKEL

SEQ ID NO: 12389 - protein, 56 aa, Artificial Sequence
  Synthetic sequence.
TREIEKRVERLLEENEERLRRVRKEIKKALDENREILKEVEDRARKILEELRRKAK

SEQ ID NO: 12390 - protein, 59 aa, Artificial Sequence
  Synthetic sequence.
SELEEVKRRVEEIKKKLKEDLDDHKRRNEKHIKELEDRLEEHRREIEELVRKLEELKRR

SEQ ID NO: 12391 - protein, 59 aa, Artificial Sequence
  Synthetic sequence.
EEVRKALKELEDDLRRVLEEIKRAHKKSKEDNKRVLDDLTEKHKRSEEELRDVLRDLER

SEQ ID NO: 12392 - protein, 60 aa, Artificial Sequence
  Synthetic sequence.
SSLEELEKRNRERIEELERTLRELEERSRELNERLKRELDEHKKRIDELLEELRRLKEEN

SEQ ID NO: 12393 - protein, 59 aa, Artificial Sequence
  Synthetic sequence.
EEVRRALEELEKSHDEVRERIKRRLDESKERNKRALEKIKRDHEESEERLRRALDRTRK

SEQ ID NO: 12394 - protein, 60 aa, Artificial Sequence
  Synthetic sequence.
SSLEEVKKENEKLIKELKEELDKIRKENEEHIEKLERELERVKREAEKIKKKLEELKREN

SEQ ID NO: 12395 - protein, 59 aa, Artificial Sequence
  Synthetic sequence.
KEVKDALEELKRSHRKVAKEIKEAVKESRKKNEEVAKKIKKALDELKRELDEALKEAKR

SEQ ID NO: 12396 - protein, 60 aa, Artificial Sequence
  Synthetic sequence.
DEVETLEERVRRLKKELRDELKRNEDKVRKLKRELEESLKENAKKVEEVERDLERVKREG

SEQ ID NO: 12397 - protein, 59 aa, Artificial Sequence
  Synthetic sequence.
DEVRREIERLKRELERVIREYREAIERLKRDLKRAIDKYREDIKRLEEKLRRVDKELEK

SEQ ID NO: 12398 - protein, 59 aa, Artificial Sequence
  Synthetic sequence.
SEVERVREENKRSEEKLKKLLEDSRRNLEENRKRLEELLRKSEENLERLKRELDELRKQ

SEQ ID NO: 12399 - protein, 55 aa, Artificial Sequence
  Synthetic sequence.
EDLRRNRETNEELRDRVRRTHEKLEREAEKVHEDVRRRHKELEDEVREVLKELRR

SEQ ID NO: 12400 - protein, 56 aa, Artificial Sequence
  Synthetic sequence.
SDEELIKRIREELERLLKELRDTIKEVEDRNRESLEDLDRVHKRIKEEIERLEKDL

SEQ ID NO: 12401 - protein, 60 aa, Artificial Sequence
  Synthetic sequence.
SEELAKKLKDELRRAKDKVEEIKKRIRDTLEDNRKKAEELKRKNEEDLRRFEKKAEDVRK

SEQ ID NO: 12402 - protein, 56 aa, Artificial Sequence
  Synthetic sequence.
SKEDKAREDVKRTIEELKDRNRKLNDKIRKTIEDLERRNEELNKENKDLVDELRDG

SEQ ID NO: 12403 - protein, 56 aa, Artificial Sequence
  Synthetic sequence.
EEVLRELREEIEKLEKEHRDNVRKLERDLDRLRKKHEDNKERLERHTRRVEEEKRR

SEQ ID NO: 12404 - protein, 60 aa, Artificial Sequence
  Synthetic sequence.
STEEDVRKIVDDARRNLEENKRRIEKIVKELEDKLRENEKKIRKILEDIRRLLEKFKRDD

SEQ ID NO: 12405 - protein, 56 aa, Artificial Sequence
  Synthetic sequence.
EDIMRDLRRRLERIAREYKRLLDELKKRLDDIKKTYEDLLRRLREEIERAEEKARR

SEQ ID NO: 12406 - protein, 60 aa, Artificial Sequence
  Synthetic sequence.
DEEEEVRKILEEIKKELDDNERRIRKNIRDAEETLRENEKRIRDILKEIEDLLKELKDRD

SEQ ID NO: 12407 - protein, 56 aa, Artificial Sequence
  Synthetic sequence.
EDILEKLRRDIERADEEYKRLEEELRRKHDEIRKTYEKLLKELEEAIERVEREAEK

SEQ ID NO: 12408 - protein, 55 aa, Artificial Sequence
  Synthetic sequence.
SSKDLLEELRRTVEEVRKRSDDLSRESEEATRRVRKEHDRINKEVEDELRRVRED

SEQ ID NO: 12409 - protein, 56 aa, Artificial Sequence
  Synthetic sequence.
EDIVREMRKRLEELLRENEKRNEELLRRLKELLDRSRERVREIEERLRELLEEVRR

SEQ ID NO: 12410 - protein, 57 aa, Artificial Sequence
  Synthetic sequence.
DAEKLKRDYEEKSRRVKETLDDLVRRYREEHRRVNEELRKLLEDLKKTVEDVEKEEG

SEQ ID NO: 12411 - protein, 60 aa, Artificial Sequence
  Synthetic sequence.
SERLEREIRKLEEENKRTLERVKEKIERLLEENEKVLKEVRDKVKTIKDRLRKLVEEIRR

SEQ ID NO: 12412 - protein, 60 aa, Artificial Sequence
  Synthetic sequence.
SVEDEVRKIKRRLEEALERSEKKVRDMVRRNKEFLERAKRRVEEVVKENERALEEVKRRG

SEQ ID NO: 12413 - protein, 56 aa, Artificial Sequence
  Synthetic sequence.
EEILRRVRKTVKDVEDTLKELNDRLEKIHREVKKELDRLLKELDDRHRKVAEDLKK

SEQ ID NO: 12414 - protein, 59 aa, Artificial Sequence
  Synthetic sequence.
SVEELLRKLEEVLRKIREENERSLKELRDRAREIVKRNRETNRELEEVIKELEKRLSGA

SEQ ID NO: 12415 - protein, 59 aa, Artificial Sequence; identical to SEQ ID NO: 1739
  Synthetic sequence.

SEQ ID NO: 12416 - protein, 57 aa, Artificial Sequence
  Synthetic sequence.
DEVEKVLEEIKRALDDLRKKVEESKREIKEALKAVEKHTRDSDTANKRTLAEIERGV

SEQ ID NO: 12417 - protein, 55 aa, Artificial Sequence
  Synthetic sequence.
ERVVEEVRRVLEELRRRLEKVTEDSRRAIERLAREDARVSKKSIDVNKKLDDDVR

SEQ ID NO: 12418 - protein, 60 aa, Artificial Sequence
  Synthetic sequence.
DAEELVRELEERIKRSHERLEELLREVKRLIERSHEELKRLNEEVLRELDRVLDEVAKRG

SEQ ID NO: 12419 - protein, 55 aa, Artificial Sequence
  Synthetic sequence.
KDSARELERIVKENAELAERVFREVEKIVRENTKLAEDSVRELKRLVEELKKRAK

SEQ ID NO: 12420 - protein, 58 aa, Artificial Sequence; identical to SEQ ID NO: 1542
  Synthetic sequence.

SEQ ID NO: 12421 - protein, 56 aa, Artificial Sequence
  Synthetic sequence.
EDLVREVEKRVRDIVEESRKLAEETRKAVEDIIEKSKRIAEDTLEKNKEMVERLER

SEQ ID NO: 12422 - protein, 55 aa, Artificial Sequence
  Synthetic sequence.
SESDEVIRDLARLLDELARHVDDSVRRMDEVVKRSTREADELAKRLDELVKEVEK

SEQ ID NO: 12423 - protein, 56 aa, Artificial Sequence; identical to SEQ ID NO: 2803
  Synthetic sequence.

SEQ ID NO: 12424 - protein, 55 aa, Artificial Sequence; identical to SEQ ID NO: 12422
  Synthetic sequence.

SEQ ID NO: 12425 - protein, 56 aa, Artificial Sequence; identical to SEQ ID NO: 2803
  Synthetic sequence.

SEQ ID NO: 12426 - protein, 55 aa, Artificial Sequence
  Synthetic sequence.
SESDDVIRKLRELLEELRTHVEKSIRDLRKILEDSTRHAKRSIEELERLLEEVRK

SEQ ID NO: 12427 - protein, 56 aa, Artificial Sequence; identical to SEQ ID NO: 2805
  Synthetic sequence.

SEQ ID NO: 12428 - protein, 55 aa, Artificial Sequence; identical to SEQ ID NO: 12426
  Synthetic sequence.

SEQ ID NO: 12429 - protein, 56 aa, Artificial Sequence; identical to SEQ ID NO: 2805
  Synthetic sequence.

SEQ ID NO: 12430 - protein, 60 aa, Artificial Sequence
  Synthetic sequence.
DREREVKKRLDEVRERIERLLRRVEEESRRVAEEIRRLIEEVRRRNKKVTEEIRELLKGL

SEQ ID NO: 12431 - protein, 55 aa, Artificial Sequence
  Synthetic sequence.
EELREELKKLERKIEKVAKEIHDHDKEVTERLEDLLRRITEHARKSDREIEETAR

SEQ ID NO: 12432 - protein, 60 aa, Artificial Sequence; identical to SEQ ID NO: 12430
  Synthetic sequence.

SEQ ID NO: 12433 - protein, 55 aa, Artificial Sequence; identical to SEQ ID NO: 12431
  Synthetic sequence.

SEQ ID NO: 12434 - protein, 57 aa, Artificial Sequence
  Synthetic sequence.
SEVDEAVKNNEEDAKESRRVVEEAVKRDEDIARDIERAAREVVERDKEIVDEVRRGV

SEQ ID NO: 12435 - protein, 60 aa, Artificial Sequence
  Synthetic sequence.
SKETKDLLDENSKRSNEISREVKKDLERTVRENKKIVDEVAKALEDTVDKNRRIVEEVTT

SEQ ID NO: 12436 - protein, 60 aa, Artificial Sequence
  Synthetic sequence.
SEAEELLKRLEDRAEEILRRLEEILRTSRKLAEDVLRELEKLLRESERRIREVLEELRGI

SEQ ID NO: 12437 - protein, 59 aa, Artificial Sequence
  Synthetic sequence.
KEVVDEIKRIVDEVRERLKRIVDENAKIVEDARRALEKIVKENEEILRRLKKELRELRK

SEQ ID NO: 12438 - protein, 57 aa, Artificial Sequence
  Synthetic sequence.
SRAETVLKEVTDKIKKLADSSDELLRRNKENIDELKKSSEELLRRLTKAIEEIEKGS

SEQ ID NO: 12439 - protein, 56 aa, Artificial Sequence; identical to SEQ ID NO: 1346
  Synthetic sequence.

SEQ ID NO: 12440 - protein, 57 aa, Artificial Sequence; identical to SEQ ID NO: 12438
  Synthetic sequence.

SEQ ID NO: 12441 - protein, 56 aa, Artificial Sequence; identical to SEQ ID NO: 1346
  Synthetic sequence.

SEQ ID NO: 12442 - protein, 57 aa, Artificial Sequence
  Synthetic sequence.
DEVRELLERNRRLLEEIKKTVKDLIRANEELLKRIEDDAKRLIDRNEELLDELEKGL

SEQ ID NO: 12443 - protein, 59 aa, Artificial Sequence
  Synthetic sequence.
SEELEELRRVVEESDETIKRLLEEAKESVDRSLDRIRKLLEDVRRSVERSAKRIDEKRK

SEQ ID NO: 12444 - protein, 60 aa, Artificial Sequence
  Synthetic sequence.
STEEVLDEIRKLHKTLTEDIKRVLREIEELHRRTIEENKEVLDKIAEDYKRVIDDVRTKD

SEQ ID NO: 12445 - protein, 56 aa, Artificial Sequence; identical to SEQ ID NO: 5433
  Synthetic sequence.

SEQ ID NO: 12446 - protein, 60 aa, Artificial Sequence; identical to SEQ ID NO: 6626
  Synthetic sequence.

SEQ ID NO: 12447 - protein, 62 aa, Artificial Sequence
  Synthetic sequence.
EDSERLVREVEDLVRRLVRRSEKSNEEVKRTVEELVRRMEESNDRVRDLVRRLVEELKRAVD

SEQ ID NO: 12448 - protein, 59 aa, Artificial Sequence
  Synthetic sequence.
SEAEKAKETIDRLADRVRKLLEEIKRSLDDSRRKSKETVEENEKTLDRMRKEVDAAKRG

SEQ ID NO: 12449 - protein, 56 aa, Artificial Sequence; identical to SEQ ID NO: 6953
  Synthetic sequence.

SEQ ID NO: 12450 - protein, 59 aa, Artificial Sequence; identical to SEQ ID NO: 12448
  Synthetic sequence.

SEQ ID NO: 12451 - protein, 56 aa, Artificial Sequence; identical to SEQ ID NO: 6953
  Synthetic sequence.

SEQ ID NO: 12452 - protein, 56 aa, Artificial Sequence
  Synthetic sequence.
SEVEELIKRLAKVLKELVDKVRKVIEDTKELLERLKRRSEDHIRKLREVLKEAKDQ

SEQ ID NO: 12453 - protein, 59 aa, Artificial Sequence
  Synthetic sequence.
EELDRRIEKVLKEIEEKIREVIKEWERVHREVEELLKRLIDENRKVLDEIRKLLEEKSK

SEQ ID NO: 12454 - protein, 56 aa, Artificial Sequence; identical to SEQ ID NO: 12452
  Synthetic sequence.

SEQ ID NO: 12455 - protein, 59 aa, Artificial Sequence; identical to SEQ ID NO: 12453
  Synthetic sequence.

SEQ ID NO: 12456 - protein, 59 aa, Artificial Sequence; identical to SEQ ID NO: 7104
  Synthetic sequence.

SEQ ID NO: 12457 - protein, 59 aa, Artificial Sequence
  Synthetic sequence.
DKALEEAKRVLAENNEVIKDIKRALDELLKELEKSVRESEERLRRLLEEVKRVIEEVAT

SEQ ID NO: 12458 - protein, 59 aa, Artificial Sequence
  Synthetic sequence.
SEAERLEARARELLRANEELMDDLRAKAEELLKRNDRLVKEIEKKVREVLAAIEELKRR

SEQ ID NO: 12459 - protein, 59 aa, Artificial Sequence
  Synthetic sequence.
KRLEELLRRLNEEHKRISDELRKLLDEALEAHRELSRRLEEELERLLREIERLVEEVTR

SEQ ID NO: 12460 - protein, 56 aa, Artificial Sequence
  Synthetic sequence.
SVDEVLKEIEDALRRLKEEVERVLKENEDELRRLEEEVRRVLKEDEELLESLKRGV

SEQ ID NO: 12461 - protein, 59 aa, Artificial Sequence
  Synthetic sequence.
EKAIRDVAKEIRDRLKELEEEIEEVTRRNLKLLADVEEEIRRVHEKTRRLLETVLRRAT

SEQ ID NO: 12462 - protein, 60 aa, Artificial Sequence
  Synthetic sequence.
DDLERAREEVADLIRKHEEKTRRILEESRRLNERHRELSARILDEIRKLAERIEELIKRE

SEQ ID NO: 12463 - protein, 59 aa, Artificial Sequence; identical to SEQ ID NO: 7737
  Synthetic sequence.

SEQ ID NO: 12464 - protein, 57 aa, Artificial Sequence
  Synthetic sequence.
KEVEDAVKELEDLLRANEDKTRSIVEDMRASNKDLEDHSRASEEEVRKLLDDLRRAG

SEQ ID NO: 12465 - protein, 56 aa, Artificial Sequence
  Synthetic sequence.
IKTLLDRVRKLAEEDAERLDRLRRESEELNERVRRVDKKLLEEIRRKAKKVEDDTR

SEQ ID NO: 12466 - protein, 57 aa, Artificial Sequence; identical to SEQ ID NO: 12464
  Synthetic sequence.

SEQ ID NO: 12467 - protein, 56 aa, Artificial Sequence; identical to SEQ ID NO: 12465
  Synthetic sequence.

SEQ ID NO: 12468 - protein, 56 aa, Artificial Sequence
  Synthetic sequence.
DEEEDLERAIKKLLDENRELLKRIAEELRRLLEELRRLTEESADRLRRLLKELKDR

SEQ ID NO: 12469 - protein, 56 aa, Artificial Sequence
  Synthetic sequence.
AETLLRELEKLSRDNKELLKKIEKEIRDLIKEDKERNIELSERLRKLVEELKKKAT

SEQ ID NO: 12470 - protein, 56 aa, Artificial Sequence; identical to SEQ ID NO: 12468
  Synthetic sequence.

SEQ ID NO: 12471 - protein, 56 aa, Artificial Sequence; identical to SEQ ID NO: 12469
  Synthetic sequence.

SEQ ID NO: 12472 - protein, 57 aa, Artificial Sequence
  Synthetic sequence.
DDAERILREMERLLEENKEISDEIAKELKRLLDENRKLSEDVVKALEDLLRDLERRS

SEQ ID NO: 12473 - protein, 59 aa, Artificial Sequence
  Synthetic sequence.
KDTLRELARSIRKLSAENKERLKELLRELKKLSDENKERIKKLLSDAEKIIEDVARRAK

SEQ ID NO: 12474 - protein, 60 aa, Artificial Sequence
  Synthetic sequence.
SSEERLRAVIEDLKRLAEESRKRHKELIDELAKAVERIERRHKKLLDEIKAVVDDIRRGV

SEQ ID NO: 12475 - protein, 56 aa, Artificial Sequence
  Synthetic sequence.
ADTIIEEVKRVLEELARSTEEVEKRVRDAIEELERSSEELARRIKEVLKRLEEETR

SEQ ID NO: 12476 - protein, 60 aa, Artificial Sequence
  Synthetic sequence.
DEARELVKELEDLIREITKTVRRLLEESEELIKRIDDAVDDLRRADEDLNREIKEEIEKG

SEQ ID NO: 12477 - protein, 56 aa, Artificial Sequence
  Synthetic sequence.
ERILRELEERVKELEKEAREILKRSEDETDKLREKAERILEDLERANRRTMDEARR

SEQ ID NO: 12478 - protein, 60 aa, Artificial Sequence; identical to SEQ ID NO: 12476
  Synthetic sequence.

SEQ ID NO: 12479 - protein, 56 aa, Artificial Sequence; identical to SEQ ID NO: 12477
  Synthetic sequence.

SEQ ID NO: 12480 - protein, 59 aa, Artificial Sequence
  Synthetic sequence.
DEIRKVVKEITDLLKASNDKNRKVVEEIRDLLRKSKKLADELVERLRALVEDLRRRIDK

SEQ ID NO: 12481 - protein, 59 aa, Artificial Sequence
  Synthetic sequence.
SEDLKRVEERAREVSRRNEESMRRVKEDADRVSEANKEVLDRVREEVKRLIEEVRETLR

SEQ ID NO: 12482 - protein, 59 aa, Artificial Sequence; identical to SEQ ID NO: 12480
  Synthetic sequence.

SEQ ID NO: 12483 - protein, 59 aa, Artificial Sequence; identical to SEQ ID NO: 12481
  Synthetic sequence.

SEQ ID NO: 12484 - protein, 57 aa, Artificial Sequence
  Synthetic sequence.
STAETVEKKVEEVIRENEKSMRESEEKVDRSTKRIEDVLRRLEETIRKTSDDIAKGV

SEQ ID NO: 12485 - protein, 59 aa, Artificial Sequence
  Synthetic sequence.
REDATRVIEEAKRILDEARKLNEETIRRSEELVRRIERVIEEIIKRSEKLLEDVARESK

SEQ ID NO: 12486 - protein, 57 aa, Artificial Sequence; identical to SEQ ID NO: 12484
  Synthetic sequence.

SEQ ID NO: 12487 - protein, 59 aa, Artificial Sequence; identical to SEQ ID NO: 12485
  Synthetic sequence.

SEQ ID NO: 12488 - protein, 57 aa, Artificial Sequence
  Synthetic sequence.
STAETVAEEVERVLKHSDDLIKEVEDVNRRVEEEIKRVIRELEEENERLVAEVRKGV

SEQ ID NO: 12489 - protein, 59 aa, Artificial Sequence
  Synthetic sequence.
EEAAREIIKRLREVNKRTKEKLDELIKHSEEVLERVKRLIDELRKHSEEVLEDLRRRAK

SEQ ID NO: 12490 - protein, 57 aa, Artificial Sequence; identical to SEQ ID NO: 12488
  Synthetic sequence.

SEQ ID NO: 12491 - protein, 59 aa, Artificial Sequence; identical to SEQ ID NO: 12489
  Synthetic sequence.

SEQ ID NO: 12492 - protein, 59 aa, Artificial Sequence; identical to SEQ ID NO: 8648
  Synthetic sequence.

SEQ ID NO: 12493 - protein, 56 aa, Artificial Sequence
  Synthetic sequence.
AETIERVVRELLEENKEVLRKTEEAVKRSTETNKRLLEASKEVADRLRERIKEAAK

SEQ ID NO: 12494 - protein, 61 aa, Artificial Sequence
  Synthetic sequence.
SRVEEIIEDLRRLLEEIRKENEDSIRRSKELLDRVKEINDTIIAELERLLKDIEKEVREKG

SEQ ID NO: 12495 - protein, 59 aa, Artificial Sequence
  Synthetic sequence.
EDKARKVAEVAEKVLRDIDKLDRESKEAFRATNEEIAKLDEDTARVAERVKKAIEDLAK

SEQ ID NO: 12496 - protein, 61 aa, Artificial Sequence; identical to SEQ ID NO: 12494
  Synthetic sequence.

SEQ ID NO: 12497 - protein, 59 aa, Artificial Sequence; identical to SEQ ID NO: 12495
  Synthetic sequence.

SEQ ID NO: 12498 - protein, 61 aa, Artificial Sequence
  Synthetic sequence.
SEVDEIIKELERLLAEIARENERIIRESRKLADEVRKRNEDAIRKLEELVARLADAVRRKG

SEQ ID NO: 12499 - protein, 59 aa, Artificial Sequence
  Synthetic sequence.
KDEVTKVKKVADDVLAEIKKLDDETRRVIEDTNKKIADLDKATRDVVRKVLEEVKKLEK

SEQ ID NO: 12500 - protein, 59 aa, Artificial Sequence; identical to SEQ ID NO: 8710
  Synthetic sequence.

SEQ ID NO: 12501 - protein, 59 aa, Artificial Sequence
  Synthetic sequence.
SEKLKELRDVIAEVAKRIDELDEYTRESIRRAKKEIERLNRETKKVIEEVVKRIEEERK

SEQ ID NO: 12502 - protein, 59 aa, Artificial Sequence; identical to SEQ ID NO: 8710
  Synthetic sequence.

SEQ ID NO: 12503 - protein, 59 aa, Artificial Sequence; identical to SEQ ID NO: 12501
  Synthetic sequence.

SEQ ID NO: 12504 - protein, 59 aa, Artificial Sequence
  Synthetic sequence.
DAVEEAEKLIRKVIADSEKLLRDLADLNAKSIRRSEKLVEDDRRANEDVIRKLEELRRN

SEQ ID NO: 12505 - protein, 59 aa, Artificial Sequence
  Synthetic sequence.
EELLRRIKKLLDEIKKAIEDSSREIKRLLEESERVMKRSSEDIKRTLDDTRRVVEEVRR

SEQ ID NO: 12506 - protein, 59 aa, Artificial Sequence; identical to SEQ ID NO: 12504
  Synthetic sequence.

SEQ ID NO: 12507 - protein, 59 aa, Artificial Sequence; identical to SEQ ID NO: 12505
  Synthetic sequence.

SEQ ID NO: 12508 - protein, 56 aa, Artificial Sequence
  Synthetic sequence.
SSDEVLKEIEEIIRRLEAEVRRVNAEVNASTEDLAREVEEVLRATNELIEELERRV

SEQ ID NO: 12509 - protein, 59 aa, Artificial Sequence
  Synthetic sequence.
EEALSKAIKDVRDIVKKVKDELKEWRDRNKELVDRLSEELKEWLKDVERVLKELTDKDR

SEQ ID NO: 12510 - protein, 57 aa, Artificial Sequence
  Synthetic sequence.
SEADDVLKKLAETVKRIIERLKKLTDDSRRLVEEVHRRNDKLSKESAEAVRKAEERG

SEQ ID NO: 12511 - protein, 55 aa, Artificial Sequence
  Synthetic sequence.
EELSAEVKKLLDEVRKALARHKDENDKLLKEIEDSLRRHKEENDRLLEKLKESTR

SEQ ID NO: 12512 - protein, 57 aa, Artificial Sequence; identical to SEQ ID NO: 12510
  Synthetic sequence.

SEQ ID NO: 12513 - protein, 55 aa, Artificial Sequence; identical to SEQ ID NO: 12511
  Synthetic sequence.

SEQ ID NO: 12514 - protein, 59 aa, Artificial Sequence; identical to SEQ ID NO: 9304
  Synthetic sequence.

SEQ ID NO: 12515 - protein, 59 aa, Artificial Sequence
  Synthetic sequence.
EDKVERVVREVEKLHEEDRKRLEESTRSVRKLLEELKRELEKSTRSVKALVDELRERVR

SEQ ID NO: 12516 - protein, 59 aa, Artificial Sequence; identical to SEQ ID NO: 9304
  Synthetic sequence.

SEQ ID NO: 12517 - protein, 59 aa, Artificial Sequence; identical to SEQ ID NO: 12515
  Synthetic sequence.

SEQ ID NO: 12518 - protein, 59 aa, Artificial Sequence
  Synthetic sequence.
SEAEEIRRRLEEISRRSVEHLRKVLEEIKRISERSKRHLDRVLEENARRLEELAELLKR

SEQ ID NO: 12519 - protein, 56 aa, Artificial Sequence
  Synthetic sequence.
EEVLRELEELLKESEERIKRIEEEIKKIIDKSREDIKRVLEEIERLNAKAADDLRK

SEQ ID NO: 12520 - protein, 60 aa, Artificial Sequence
  Synthetic sequence.
SEVDDVLRRLEELIKTLEDINAKSLEDIKKLIDDLAKILEDALRKHEKLIRELREAKKGI

SEQ ID NO: 12521 - protein, 56 aa, Artificial Sequence
  Synthetic sequence.
KEALDRMREEIRRLEEESRKSDETIERLIRELRRRVEEVLKTSTDLIRELEEEVKK

SEQ ID NO: 12522 - protein, 60 aa, Artificial Sequence; identical to SEQ ID NO: 12520
  Synthetic sequence.

SEQ ID NO: 12523 - protein, 56 aa, Artificial Sequence; identical to SEQ ID NO: 12521
  Synthetic sequence.

SEQ ID NO: 12524 - protein, 59 aa, Artificial Sequence
  Synthetic sequence.
SDAEELLKRVADLLKASLESLEKILRDSKELMDRWRKKLEDLLRESEELVDRAEKILRR

SEQ ID NO: 12525 - protein, 55 aa, Artificial Sequence
  Synthetic sequence.
ERVREELKKLLTRVEEEHRKVLETDKKILKEAHKESKEVNDRDRELLERLEESVR

SEQ ID NO: 12526 - protein, 57 aa, Artificial Sequence
  Synthetic sequence.
DAAERAKEKLDKILEDLRDVVRASKENLDRLHAENAETLERSKANLDRLLEKVKKDG

SEQ ID NO: 12527 - protein, 59 aa, Artificial Sequence
  Synthetic sequence.
ERDIERILRELEAVLKKLTDESERLNREVERVSRDTKKKSKELNEELKAVLDEVKRKAD

SEQ ID NO: 12528 - protein, 60 aa, Artificial Sequence
  Synthetic sequence.
SEIETVRREIEKILDDLRRTVKRIEDEVRKIHEDLRRSLEDSKRNIEEILKDLERAARRD

SEQ ID NO: 12529 - protein, 59 aa, Artificial Sequence
  Synthetic sequence.
KEDIDKLLKELRDLVEKIKKDLKELLERYEEIVRRIKELLKDLNREAEEVVRRLKEELR

SEQ ID NO: 12530 - protein, 57 aa, Artificial Sequence
  Synthetic sequence.
KELEDVIEEVKKLLKTVNEESRRVAEEVRKLIREVSEELTEVIRRVERLVEEVAKGV

SEQ ID NO: 12531 - protein, 56 aa, Artificial Sequence
  Synthetic sequence.
AETVLRSAEDIVAKNRKLAEEVLRRVKKIVEENRKIASEVLDDVRKLVEDVLARAS

SEQ ID NO: 12532 - protein, 60 aa, Artificial Sequence
  Synthetic sequence.
SKLEEVEKAVRKVIEDSRRVNEEVNRRSEEVVRELEKVHREVNDASRRVVEKARRVLKGS

SEQ ID NO: 12533 - protein, 58 aa, Artificial Sequence; identical to SEQ ID NO: 9973
  Synthetic sequence.

SEQ ID NO: 12534 - protein, 60 aa, Artificial Sequence; identical to SEQ ID NO: 12532
  Synthetic sequence.

SEQ ID NO: 12535 - protein, 58 aa, Artificial Sequence; identical to SEQ ID NO: 9973
  Synthetic sequence.

SEQ ID NO: 12536 - protein, 56 aa, Artificial Sequence
  Synthetic sequence.
SAEEVKEELKRIATKLKEEIKENIRRLEESVEKIAKELAENIKRLEDILRDVKRGL

SEQ ID NO: 12537 - protein, 56 aa, Artificial Sequence
  Synthetic sequence.
GEELVERLRRVVEEVRERLKDSSRELRKINEDSRKAVEDSSAEVAKVVEELERRDT

SEQ ID NO: 12538 - protein, 57 aa, Artificial Sequence
  Synthetic sequence.
SEIERVKKRLEELLAEVEESTRRLEERLKRLLEEAKRSSEEVEKELRRLLEAVRRGL

SEQ ID NO: 12539 - protein, 56 aa, Artificial Sequence
  Synthetic sequence.
ADDVLARVEELAKRAHDENERLIREVEELVRAHNKRNKELVDEVKRLVEKVIEEER

SEQ ID NO: 12540 - protein, 57 aa, Artificial Sequence; identical to SEQ ID NO: 12538
  Synthetic sequence.

SEQ ID NO: 12541 - protein, 56 aa, Artificial Sequence; identical to SEQ ID NO: 12539
  Synthetic sequence.

SEQ ID NO: 12542 - protein, 60 aa, Artificial Sequence
  Synthetic sequence.
SDVDRVLEEIRKLLEDLKRHSEKVSEENEDLLRANTELNKRVSEDNERLLEELKRLRERG

SEQ ID NO: 12543 - protein, 59 aa, Artificial Sequence
  Synthetic sequence.
EEAKKKLDEVLERAKRTIDRLLETSDRSLEKVEADLRRLNEELDRSLERAERTIRELAK

SEQ ID NO: 12544 - protein, 60 aa, Artificial Sequence; identical to SEQ ID NO: 12542
  Synthetic sequence.

SEQ ID NO: 12545 - protein, 59 aa, Artificial Sequence; identical to SEQ ID NO: 12543
  Synthetic sequence.

SEQ ID NO: 12546 - protein, 55 aa, Artificial Sequence
  Synthetic sequence.
STEDVLRKIKEDVKRVIDDNRRILDEVRRTSKRVLDDLRANLKHIAEEVERVLRG

SEQ ID NO: 12547 - protein, 56 aa, Artificial Sequence; identical to SEQ ID NO: 1348
  Synthetic sequence.

SEQ ID NO: 12548 - protein, 60 aa, Artificial Sequence
  Synthetic sequence.
SAEELLREVAELVKRVDEDLRRLLEEVRASNEEVIRRLEEILKRIEEENRKVVEELRRGG

SEQ ID NO: 12549 - protein, 59 aa, Artificial Sequence
  Synthetic sequence.
EETVKRLLDELRELLERLKRTIEELLKRNRDLLADAEEKARRLLEENRKLLKAARDTAT

SEQ ID NO: 12550 - protein, 59 aa, Artificial Sequence
  Synthetic sequence.
SEDEDLDRVAEKLAREHKKSVEEIKRVLKSADEESKKLVRDTERVIEEIKREVEEARRG

SEQ ID NO: 12551 - protein, 55 aa, Artificial Sequence
  Synthetic sequence.
EEVLKKLAEIVRRVKEENRKVNEEVEKRLRELEEENKKVIEDLKSTVEELVERLR

SEQ ID NO: 12552 - protein, 59 aa, Artificial Sequence; identical to SEQ ID NO: 12550
  Synthetic sequence.

SEQ ID NO: 12553 - protein, 55 aa, Artificial Sequence; identical to SEQ ID NO: 12551
  Synthetic sequence.

SEQ ID NO: 12554 - protein, 60 aa, Artificial Sequence; identical to SEQ ID NO: 10832
  Synthetic sequence.

SEQ ID NO: 12555 - protein, 56 aa, Artificial Sequence; identical to SEQ ID NO: 10833
  Synthetic sequence.

SEQ ID NO: 12556 - protein, 57 aa, Artificial Sequence
  Synthetic sequence.
SKEDRLREELKKLLARLAEEIERLKRALEESNKDLKRTIDASEKHLRDVNEDVKRGG

SEQ ID NO: 12557 - protein, 59 aa, Artificial Sequence; identical to SEQ ID NO: 11975
  Synthetic sequence.

SEQ ID NO: 12558 - protein, 57 aa, Artificial Sequence; identical to SEQ ID NO: 12556
  Synthetic sequence.

SEQ ID NO: 12559 - protein, 59 aa, Artificial Sequence; identical to SEQ ID NO: 11975
  Synthetic sequence.

SEQ ID NO: 12560 - protein, 60 aa, Artificial Sequence; identical to SEQ ID NO: 12002
  Synthetic sequence.

SEQ ID NO: 12561 - protein, 59 aa, Artificial Sequence
  Synthetic sequence.
RETAERARETLKRLLDENRDRSKKVKEEIRRILEDLTRTTERVKREIAKLLKELEDTAR

SEQ ID NO: 12562 - protein, 60 aa, Artificial Sequence; identical to SEQ ID NO: 12002
  Synthetic sequence.

SEQ ID NO: 12563 - protein, 59 aa, Artificial Sequence; identical to SEQ ID NO: 12561
  Synthetic sequence.

SEQ ID NO: 12564 - protein, 58 aa, Artificial Sequence; identical to SEQ ID NO: 1565
  Synthetic sequence.

SEQ ID NO: 12565 - protein, 58 aa, Artificial Sequence; identical to SEQ ID NO: 1453
  Synthetic sequence.

SEQ ID NO: 12566 - protein, 58 aa, Artificial Sequence; identical to SEQ ID NO: 1565
  Synthetic sequence.

SEQ ID NO: 12567 - protein, 58 aa, Artificial Sequence; identical to SEQ ID NO: 1453
  Synthetic sequence.

SEQ ID NO: 12568 - protein, 56 aa, Artificial Sequence
  Synthetic sequence.
SKEEELEKLLREHHEKIKRLKEESKRINDRIRRTVEELIKESEKINRDINDTVRKG

SEQ ID NO: 12569 - protein, 56 aa, Artificial Sequence
  Synthetic sequence.
EDSVERIARELERNLDDLARVLKESEDDLAEILRRLKEVLEESERDLERVEREVRK

SEQ ID NO: 12570 - protein, 59 aa, Artificial Sequence
  Synthetic sequence.
SEAEEAAERAKRAAKEAVERAKRAVERNEEAARRAAEKAREATERAERAARRAADKARK

SEQ ID NO: 12571 - protein, 60 aa, Artificial Sequence
  Synthetic sequence.
IKDAADKLAEAAKRAVDISKKAADDLKRLAKEDNEIAREAARRLAEAAKEAVKLVDDVTR

SEQ ID NO: 12572 - protein, 56 aa, Artificial Sequence
  Synthetic sequence.
SEKEKAAEDLRRAIEEAKKRSEEAAKELEDALRKAEKEARDSAETLKEAAKRAADA

SEQ ID NO: 12573 - protein, 59 aa, Artificial Sequence
  Synthetic sequence.
KDAATEAKKAADTIAKLIEDNAKRALEAAREIAKLIEKSAKEALEAAERIARLIEEAAN

SEQ ID NO: 12574 - protein, 59 aa, Artificial Sequence
  Synthetic sequence.
SVEEAARRAAKALKDAAKKLLEANEKAARAWKELAKELIKADEKALKILEEAARKARRD

SEQ ID NO: 12575 - protein, 57 aa, Artificial Sequence
  Synthetic sequence.
AEEAAKEAIRIAEEALRRSAEAAERAARIAEDAARKSRKAAEDAAKIAKEAADRARK

SEQ ID NO: 12576 - protein, 62 aa, Artificial Sequence
  Synthetic sequence.
SEEDRLRELAERARRLAKRNRELAKEIIDEIRKLIRDAREAAKKSAEKAKRLIDDARRVAGK

SEQ ID NO: 12577 - protein, 56 aa, Artificial Sequence
  Synthetic sequence.
IEEAAKANEEAIKASEEAVDEAARALEEAAEASKRANEKADKALEDAVRAAEEATR

SEQ ID NO: 12578 - protein, 61 aa, Artificial Sequence
  Synthetic sequence.
SEKEDVLRRIREAHERNKRLLERVAEEIKRIVEESRKLLEDVRKKAEDAARRAEEALRKEA

SEQ ID NO: 12579 - protein, 56 aa, Artificial Sequence
  Synthetic sequence.
KEALLKAAKEALEALEEALRLIAKATEEAARAAKEALDLILEADRKSAKAAEEALR

SEQ ID NO: 12580 - protein, 61 aa, Artificial Sequence
  Synthetic sequence.
SEREEVAKRATDAHEENERLLREVEKRIKEALERNEELLKRVSDKAREAAKKLEDALRRRA

SEQ ID NO: 12581 - protein, 56 aa, Artificial Sequence
  Synthetic sequence.
KEALRRAAKKALDAAEEALELIRKASKEAADAAREALKLILEADKKSLEAAREALR

SEQ ID NO: 12582 - protein, 60 aa, Artificial Sequence
  Synthetic sequence.
SEREEIEEIKKRVDRTLEEYERKVEDIRRKLTELKDESDKKVKDVRRKLKETEDRVREEG

SEQ ID NO: 12583 - protein, 58 aa, Artificial Sequence
  Synthetic sequence.
EELRELIERLVRIAEEVSEEDERVLRSLEDILRKVVEENERLLERLKRILEELIRRTR

SEQ ID NO: 12584 - protein, 58 aa, Artificial Sequence
  Synthetic sequence.
SEDEELKKELEKLLKELEEKLEKYRDDLRKDKERLKEKLDRYRERLRELMEELKDLLD

SEQ ID NO: 12585 - protein, 59 aa, Artificial Sequence
  Synthetic sequence.
EDVLRDIVRRVVEVLRKNLKIVEEIIRKIEELLEKNLRLVEEILRRIARLLEEVLEKTR

SEQ ID NO: 12586 - protein, 60 aa, Artificial Sequence
  Synthetic sequence.
SDAEVIEELVRLHRKLLEDILKLLKELVDIHRETLRRIEEIVERIVRLIEALLDKIRKEG

SEQ ID NO: 12587 - protein, 59 aa, Artificial Sequence
  Synthetic sequence.
KEALERLLERLKEIVDRIKEELDRLLKRSEDSIREIEERVKRLLEESKRVVDEIRERLK

SEQ ID NO: 12588 - protein, 57 aa, Artificial Sequence
  Synthetic sequence.
SKEKKILDRLRELLKESRDLNRRVKETLKKLLEDSKRLLDEIRKRLKELLDELEKEN

SEQ ID NO: 12589 - protein, 55 aa, Artificial Sequence
  Synthetic sequence.
EAVKRLKEVLDEVAELVKTLLEVNRKILEDVDKLIEEVLKLNDDILREVVKLAED

SEQ ID NO: 12590 - protein, 61 aa, Artificial Sequence
  Synthetic sequence.
SEKEKLLEDIADIARKILKLLKEHLDKLRKLLEEIRRLLEEHSRVLRELIERILDALRRKK

SEQ ID NO: 12591 - protein, 55 aa, Artificial Sequence
  Synthetic sequence.
KDLERELKRVKEISRKLEEELKELKERVKRDSEKMNEDLDRLLEDAERRIRKTRE

SEQ ID NO: 12592 - protein, 59 aa, Artificial Sequence
  Synthetic sequence.
SEEDKVLEELKRLLEELLRKHEEVLKEIKELLDKIIKKHEESLRRIKKLAEEIKERAKK

SEQ ID NO: 12593 - protein, 59 aa, Artificial Sequence
  Synthetic sequence.
KTLTEELKRIEDKLEELIRRSKDELDKIVREAEKIIEESKRRLEKLLRELERIIEDAKR

SEQ ID NO: 12594 - protein, 60 aa, Artificial Sequence
  Synthetic sequence.
SELEELVKRIEKTLRDLRRKNEELRKEVEEVEREDRERLERAAEDLERVEKKVEDEVRRR

SEQ ID NO: 12595 - protein, 57 aa, Artificial Sequence
  Synthetic sequence.
IEKTIEDARRLLEKILKLHRENSEESRRLIEDINRVNRELIDEVAELAKKILRRVEE

SEQ ID NO: 12596 - protein, 61 aa, Artificial Sequence
  Synthetic sequence.
RDEELLERVERLLRELLDTNRRKLEEVEKELRRLLETNKKTLDDVRRLLKELLDVLETREV

SEQ ID NO: 12597 - protein, 55 aa, Artificial Sequence
  Synthetic sequence.
DDLRELKKRIEDLLKEDKERLEKIARDIERDLERYRRDLKRLEDELREDIERARR

SEQ ID NO: 12598 - protein, 58 aa, Artificial Sequence
  Synthetic sequence.
REEEVLRRLREIIKRLLDKNRKVNEDLVRLIKRVLDKNREVLKRLRDLIRELLEVVRN

SEQ ID NO: 12599 - protein, 60 aa, Artificial Sequence
  Synthetic sequence.
DEDLERALKKVKDELERIVRENEDADRKIKEEVDRLSEENEKVNREIKKELDDVVEETKK

SEQ ID NO: 12600 - protein, 56 aa, Artificial Sequence
  Synthetic sequence.
EEDERLTKRVEEIKRENRELLRRLEEEVKELERKSEKIVRDLKEKVDRAKEKLDSN

SEQ ID NO: 12601 - protein, 57 aa, Artificial Sequence
  Synthetic sequence.
DKDVLTELKRILDELLKLVEKLIRRNLRLLEELLRLVREILRTSNEILEEILKDARR

SEQ ID NO: 12602 - protein, 60 aa, Artificial Sequence
  Synthetic sequence.
SELDTLVELIKRILEEITRVNKELVDEVRKLLEEIVRINERSVRTIEKILRDIAELIRRG

SEQ ID NO: 12603 - protein, 60 aa, Artificial Sequence
  Synthetic sequence.
EEELEKELRRLKKELEEVVRKSREDLERLKKELEKIVKESEDELKKVEEKVKKLADDARR

SEQ ID NO: 12604 - protein, 58 aa, Artificial Sequence
  Synthetic sequence.
TEEEVLRKVEKLIKDLLDVLRDLLRASEEVVREALRVLEELIEENKRVIEELSRALSD

SEQ ID NO: 12605 - protein, 60 aa, Artificial Sequence
  Synthetic sequence.
ERKLRRDLTETKKELEKRHEDLRRELEKLLRDYKRELEEIERRLEEIEKTLKRRADETRR

SEQ ID NO: 12606 - protein, 58 aa, Artificial Sequence
  Synthetic sequence.
SDLERLEKEIRDLLDELRRLTEELEKRSRDILKRLKEILEELKRRIERLLDELRRRRG

SEQ ID NO: 12607 - protein, 58 aa, Artificial Sequence
  Synthetic sequence.
DSVRELIEVLKKALEDVRRVLRAIEEIVRRSVELNEKHSRELRRVLKELLELVAKAAE

SEQ ID NO: 12608 - protein, 55 aa, Artificial Sequence
  Synthetic sequence.
SEEEELRKLAKKIEEVIKTSRDKLDKSRKELEKVIRDIERRLRELRRELEELVRR

SEQ ID NO: 12609 - protein, 57 aa, Artificial Sequence
  Synthetic sequence.
REDVLREIEKLLEEILRALRKLLKDLLDLHDEVLKADEKLLKRLREIVKKVLEEVRK

SEQ ID NO: 12610 - protein, 55 aa, Artificial Sequence
  Synthetic sequence.
SEEEKLRELRKRLEDTVRRSKEELEKSTEELKDVIKKSEEKLEELKRRLEEMKRR

SEQ ID NO: 12611 - protein, 57 aa, Artificial Sequence
  Synthetic sequence.
SEKLLTDAARILDDVVRVDRELLRLVLELHKRLVRADEKLLTDIRELARRVLEETRK

SEQ ID NO: 12612 - protein, 59 aa, Artificial Sequence
  Synthetic sequence.
DEDERLRELRDRVRRSEEEDERRNKRHEERVKELEDEDKERNERHRKRLKEITDRLKER

SEQ ID NO: 12613 - protein, 55 aa, Artificial Sequence
  Synthetic sequence.
EDLLKVVRDSLEILKELIRTVLKAIEESLRILEELIERLKRHIETILRLAAETTT

SEQ ID NO: 12614 - protein, 59 aa, Artificial Sequence
  Synthetic sequence.
DEEELEKEIKKLLEEATKKHEDVKREIKERLEKLRRDHEEAEKRVRDELRRLEEELERR

SEQ ID NO: 12615 - protein, 55 aa, Artificial Sequence
  Synthetic sequence.
EDLIRVLKKLIEDLERLLTKNRRLLEEIVKILTKLLKDNRDLLRRILRKVEETAK

SEQ ID NO: 12616 - protein, 57 aa, Artificial Sequence
  Synthetic sequence.
DEARRIKEIVDRAVEIWRRLVEEIKRIVKEVLDKWRKLIRELIELVRKALEDLRRTN

SEQ ID NO: 12617 - protein, 58 aa, Artificial Sequence
  Synthetic sequence.
DELKRLEDDVRKKLKDLEDKLRKLRKELEETHRRLAETIRRIAEELERLHRELKRESK

SEQ ID NO: 12618 - protein, 57 aa, Artificial Sequence
  Synthetic sequence.
SKDERLRKVLEDVERLLREVLKKHRKVIDDLRELLKRVVEIHRRVLEEILKRLEEEG

SEQ ID NO: 12619 - protein, 59 aa, Artificial Sequence
  Synthetic sequence.
DEVVERIRRTLEEIERRLRKTDKDLEKDLRELKKDLDRTDEELKRKVEKLKRELKETSK

SEQ ID NO: 12620 - protein, 61 aa, Artificial Sequence
  Synthetic sequence.
DEKDRLEEEVRKLLKEAEDELRRLKRENEKLNRELKETLKRVKEESERLLRKLREDVRKDG

SEQ ID NO: 12621 - protein, 57 aa, Artificial Sequence
  Synthetic sequence.
LEEVLEELDRLNKEVLKAIEEAAKKLEDLNRRVLEVLEDILRKLKEIVDEALKVLRK

SEQ ID NO: 12622 - protein, 59 aa, Artificial Sequence
  Synthetic sequence.
KEEELLERLREVLKTDLDLLRDLVRTLKEDLDKDARLLEELVERLKKLLDKIKRLLEEE

SEQ ID NO: 12623 - protein, 56 aa, Artificial Sequence
  Synthetic sequence.
ERVKREIRKDLDKIRREIEKIVKESEESNERSLEKIDRILEESKRRNERLKRELDR

SEQ ID NO: 12624 - protein, 60 aa, Artificial Sequence
  Synthetic sequence.
SKKETIRKLIEENKDIIRKLAEKLKRLLEESERIAEEALRLIKELLERIERALRRVAKDI

SEQ ID NO: 12625 - protein, 55 aa, Artificial Sequence
  Synthetic sequence.
KELEKLLEDLEREIRRLKKRLKELSDRLEEKIRKIKRELDDLSRRLREKIERTRK

SEQ ID NO: 12626 - protein, 60 aa, Artificial Sequence
  Synthetic sequence.
DDEKRLKDRLREALKRNEELLDRLRRRVEEILDRNRKLLERVRRELERVLKELEDLIRRG

SEQ ID NO: 12627 - protein, 56 aa, Artificial Sequence
  Synthetic sequence.
ETVLRELVEELERVVRRILELLKRLSDASKRVVEEILELLRRLSEKTAKAVDDTRT

SEQ ID NO: 12628 - protein, 56 aa, Artificial Sequence
  Synthetic sequence.
DDERRLETLIRLSRELIERVRKLLRDIIRTSKELIEEVLETVKRILDKIEELAKEV

SEQ ID NO: 12629 - protein, 55 aa, Artificial Sequence
  Synthetic sequence.
EKISRKVEELEKEIRRLIEELKKKNEEVEKKIREIMKELDERSERLRRELDRTRD

SEQ ID NO: 12630 - protein, 60 aa, Artificial Sequence
  Synthetic sequence.
SKEDELRKELEEVVKRIEDALRKLKERSKRVAKRVKKLLDDLKKESEEVVESLREKLEKE

SEQ ID NO: 12631 - protein, 59 aa, Artificial Sequence
  Synthetic sequence.
ESVRKLLEELRRLHERIIKIIEEILELLRRVHKEVAKDVRRLARELEELVRRLVETLRR

SEQ ID NO: 12632 - protein, 58 aa, Artificial Sequence
  Synthetic sequence.
SAEEILDTVAELIKTHLKIVREVLKTVRDLNRRSLDLIRRILERMRRLVERLVRLIRN

SEQ ID NO: 12633 - protein, 56 aa, Artificial Sequence
  Synthetic sequence.
EKRLREVEEEVERRLDTVRRELEEVEKESDRLLEELEKKSEDFERDIRRLLKEAKT

SEQ ID NO: 12634 - protein, 56 aa, Artificial Sequence
  Synthetic sequence.
SKREEIEKLLEDLKRDNKRVLDRLREVIKDNEDKNEKAVRDARELLERLKRELEEG

SEQ ID NO: 12635 - protein, 55 aa, Artificial Sequence
  Synthetic sequence.
EALKRLEEVAKELLKLIEEVLKENERSNREILRLIAELVKRNARVNEELLEIARR

SEQ ID NO: 12636 - protein, 61 aa, Artificial Sequence
  Synthetic sequence.
EKDDRIREKVKEIERRNDKALDDIRRRVEEIKRENDEVLDRIRKELEDLKKEVEEVAKRTG

SEQ ID NO: 12637 - protein, 59 aa, Artificial Sequence
  Synthetic sequence.
EELKKLLDKLLEDLRRIVKKLEELLKKNDDELRKIVKEVKDLLKRNHDELERIVREARR

SEQ ID NO: 12638 - protein, 61 aa, Artificial Sequence
  Synthetic sequence.
SKEEKIERDVDEIRKENEEVLRRIRKKVRDIERENDEILRKIEEDLRRIEKDLERVAKERG

SEQ ID NO: 12639 - protein, 59 aa, Artificial Sequence
  Synthetic sequence.
EDLRELLRKVLESLRRIVERVDRTLKDNDRKIEEIVRELKELLKKNNDALRKIVEDAKR

SEQ ID NO: 12640 - protein, 59 aa, Artificial Sequence
  Synthetic sequence.
SREEVFELLLDVLRKIVELIKDLAKKNIDVLKKLMELIDELVKINEKSLEDLLRLIREG

SEQ ID NO: 12641 - protein, 56 aa, Artificial Sequence
  Synthetic sequence.
EKELEDEARRLKKEYRDEVERLKKEIREIIERYKDALRKLEREIEDITRRLKERAD

SEQ ID NO: 12642 - protein, 62 aa, Artificial Sequence
  Synthetic sequence.
SKLEDLLRRAEELLKDIVRANERLLEEIRKLLKEIVKANEDLLRKVKRLLEEAVEMAIRERG

SEQ ID NO: 12643 - protein, 56 aa, Artificial Sequence
  Synthetic sequence.
EEIVTRVRKKVEELKEEVKRINDEVRKKVRDLEETSKRILERVEDLVRELKERARR

SEQ ID NO: 12644 - protein, 59 aa, Artificial Sequence
  Synthetic sequence.
SKEDKARELEKRLRDNLKKLEEVVRELAEVLKRNLEKLRRLAEELLRALKRLLDKLRAG

SEQ ID NO: 12645 - protein, 56 aa, Artificial Sequence
  Synthetic sequence.
EDLVRDIRRELKELEERARKILRDDERDLRALEKRIRDIIREDREELERLKERARK

SEQ ID NO: 12646 - protein, 60 aa, Artificial Sequence
  Synthetic sequence.
KREDILKKLEDIIRDIIDKLRRILEKVKRLNEDIIREIKRLLDESLKTLEDLLKRIADKS

SEQ ID NO: 12647 - protein, 58 aa, Artificial Sequence
  Synthetic sequence.
EEIKRLKEELERRHRRLEEEVERVARELEKRHRDLERDIRRVAEELKKLLKKLRDDRR

SEQ ID NO: 12648 - protein, 57 aa, Artificial Sequence
  Synthetic sequence.
REKEELSEEIRRRLDELRKLLEEYEEEVKRLLTRLRDKLRRYKEEVERLLRKLKEDN

SEQ ID NO: 12649 - protein, 55 aa, Artificial Sequence
  Synthetic sequence.
KEAVDLVRDVLRRVEKVNRELLELIKEVADRVRERNKELVELIDRLLERLKRADK

SEQ ID NO: 12650 - protein, 60 aa, Artificial Sequence
  Synthetic sequence.
SEEETVERLLEEARKRHEEIIKKAKELLDRAREEHERIIREAEKLLEEIKKRVDELVRDG

SEQ ID NO: 12651 - protein, 56 aa, Artificial Sequence
  Synthetic sequence.
RKTLLREIEKLLKTLEDILRDLLRLVEKTLKELEEILKDLVDKARENLKRLRERIR

SEQ ID NO: 12652 - protein, 57 aa, Artificial Sequence
  Synthetic sequence.
SKEEEIVKEVEKIVEKLLEVNRRALERIEEIVRKNLKVNRELVEEIERIVEELIRTG

SEQ ID NO: 12653 - protein, 56 aa, Artificial Sequence
  Synthetic sequence.
EEMLRRVLKKIEEVIRRAREEHEKSTRELEEVIKELKKRHEDVTREAKKVIDDLKR

SEQ ID NO: 12654 - protein, 56 aa, Artificial Sequence
  Synthetic sequence.
SEKEELKRLLDKLLKELKRLSDELKKTIDKILKILKEVSEEVKRTADELLDAIRRG

SEQ ID NO: 12655 - protein, 59 aa, Artificial Sequence
  Synthetic sequence.
EDELRKVEEDLKRLEDKLKKLLEDYEKKVRELEETLDDLLRKYEETLRRLEKELEEEER

SEQ ID NO: 12656 - protein, 56 aa, Artificial Sequence
  Synthetic sequence.
SRVERLEKLLEEHKRLVEDLIRLLDELAKKHDEDVRRLIERLKELAERLKRLLERS

SEQ ID NO: 12657 - protein, 56 aa, Artificial Sequence
  Synthetic sequence.
KRDVDRIREEIKKLIEDVRREIKRVEDKHKKDIDRVKEKLDRVRDRHEKMAEDSKR

SEQ ID NO: 12658 - protein, 60 aa, Artificial Sequence
  Synthetic sequence.
REKEELLRLLKEIAERILDILRKALELLDRVVELDNRTSKELLELSAELVKRILEAVRDG

SEQ ID NO: 12659 - protein, 60 aa, Artificial Sequence
  Synthetic sequence.
EEEKKRLLDDLRRILREYEERVKKLNDEHKKLEKEIKDKVKRILDEIRRTLDKILKELRK

SEQ ID NO: 12660 - protein, 60 aa, Artificial Sequence
  Synthetic sequence.
KDEERLVKKIRDSLRKYEDLLRKLVERIRDLLRRYEEELRKLLTEIEKTLEDVRDVLRRK

SEQ ID NO: 12661 - protein, 58 aa, Artificial Sequence
  Synthetic sequence.
DLLEMLRRLVERLKRLIERVLKLNRELVKKLLELLEEALRRNRRLVEDILKIADEARK

SEQ ID NO: 12662 - protein, 58 aa, Artificial Sequence
  Synthetic sequence.
SDEDRKRKKLEDVERRLEKLLREYEEKVRRVLEELRRLLEENKRHVEELEKRLRDRAK

SEQ ID NO: 12663 - protein, 56 aa, Artificial Sequence
  Synthetic sequence.
LEEALERLRRLLEELLRINERIIELIRELLEDNRRILEEILKLIKDLLRRAERIVD

SEQ ID NO: 12664 - protein, 56 aa, Artificial Sequence
  Synthetic sequence.
SEEEDLEREKRRLDKYSEDDRRRAEKVLRELEEEVKKSRKRLEDAKRRLDEEVRRN

SEQ ID NO: 12665 - protein, 59 aa, Artificial Sequence
  Synthetic sequence.
EEVLRILKTLVKELEDILRELLKINEDLVRRLERILRELLKSNDNLVKELEKLLEKARR

SEQ ID NO: 12666 - protein, 63 aa, Artificial Sequence
  Synthetic sequence.
EKKERIREALERAVRTLEKLLEDDKRELDKARREVRELLRRDKEELDKVVERVERELDRARER

SEQ ID NO: 12667 - protein, 58 aa, Artificial Sequence
  Synthetic sequence.
RKLEEILRLLEEALRRNSETLEEILRKLEEILKRNRKTLEDLLKLVKEILDEIRERLR

SEQ ID NO: 12668 - protein, 59 aa, Artificial Sequence
  Synthetic sequence.
SLTERVLDLARDLIRILLEIHKRALKLIAELVKKLLKIHEDVLKLSEELVEELLEIVAR

SEQ ID NO: 12669 - protein, 60 aa, Artificial Sequence
  Synthetic sequence.
EDTLRRVLERIREEVERVKEKHRRLLEELKKLLEELRKRSKDLLEDIKRKVRELEEKTRR

SEQ ID NO: 12670 - protein, 60 aa, Artificial Sequence
  Synthetic sequence.
REDEELTKRVEKILRDAERLVRKLHRENREILKTLKRLVEELEKENRKVLKDAEDLVRKE

SEQ ID NO: 12671 - protein, 56 aa, Artificial Sequence
  Synthetic sequence.
ARELLKELKRIVKKSLDELRKLLKKLEDIVRESNERLKEVLKKITDLIRKVLEDIR

SEQ ID NO: 12672 - protein, 58 aa, Artificial Sequence
  Synthetic sequence.
SEEDKIAEELKETLKRYRDRLEEIRKELEDKLREYEKRLEDLARELEKKLRKLEARDV

SEQ ID NO: 12673 - protein, 55 aa, Artificial Sequence
  Synthetic sequence.
EDVRRVVRELLRKLEDILRESEETNKETLEKIDEILKESERTNREVIRKLKETTD

SEQ ID NO: 12674 - protein, 56 aa, Artificial Sequence
  Synthetic sequence.
SAEETLRRITEESKRVLEEITKKYEDLERESREVLRKLREDLDRIKRELEDVLTKG

SEQ ID NO: 12675 - protein, 60 aa, Artificial Sequence
  Synthetic sequence.
RERLARLLKKLADKLIRVLEEILKINEELNRKIIKFARENLERNRRVNKKVIEVLREAAR

SEQ ID NO: 12676 - protein, 56 aa, Artificial Sequence
  Synthetic sequence.
SEDEKLKKEVDDVLERAKRLLDRLREANEDVLRKAKEDLDRLLKSNREILEELRKI

SEQ ID NO: 12677 - protein, 56 aa, Artificial Sequence
  Synthetic sequence.
ERVLERLLKALKEHSDELKKVVEELLKLLEEHLREVEKLVRELLADLKRLLDKTRK

SEQ ID NO: 12678 - protein, 61 aa, Artificial Sequence
  Synthetic sequence.
SKIEELLTKLAELLKEVIDELRKNLKRLEETVDENLKTMEDLLRKLEEVVREVLDIATKKN

SEQ ID NO: 12679 - protein, 55 aa, Artificial Sequence
  Synthetic sequence.
DEVRKRLDERAERLEKEVEEVKKENDERAKRSAEEVKKLLDKLDEALRRLEEEVR

SEQ ID NO: 12680 - protein, 61 aa, Artificial Sequence
  Synthetic sequence.
SEDDELIKKIKKLAEEIIDEIRKLIEKSKEILKRLLDELRKLIEKSKKLLKETLDKLRKDK

SEQ ID NO: 12681 - protein, 56 aa, Artificial Sequence
  Synthetic sequence.
EEALKELEKKTRDLEDEIRKVKDDVKRRHDELKEEIERVLDELRKVLKRLEDEARK

SEQ ID NO: 12682 - protein, 61 aa, Artificial Sequence
  Synthetic sequence.
KTEEILKRVKEILDELAKELRDIIRESLRTIEELLDELRRILEESERTLEELVKTIKDEVK

SEQ ID NO: 12683 - protein, 59 aa, Artificial Sequence
  Synthetic sequence.
DEVKRRLEEKERRIRTRYEELRRRLRKRVKDYEDKLREIEKKVRRDAERIEEELERAKK

SEQ ID NO: 12684 - protein, 57 aa, Artificial Sequence
  Synthetic sequence.
EELEDVLRRIEEVLREIIRLLEEHHDMVRRAVERIKRLLEDHHKKVEDILREIKRRI

SEQ ID NO: 12685 - protein, 59 aa, Artificial Sequence
  Synthetic sequence.
EKVKKELKDLARKAEKLSEDVRRELEETVKDLRRKSKEVEDRLDKLTEEIRRTLEEKRR

SEQ ID NO: 12686 - protein, 59 aa, Artificial Sequence
  Synthetic sequence.
KDEERLTKTAKESLDHNKELLDRIRKKSKEVLDHNKELLDRIREEIKRLLEELDRLKRE

SEQ ID NO: 12687 - protein, 56 aa, Artificial Sequence
  Synthetic sequence.
VEEVIKEVKKMLERALEELREVNDRDRRANERALRILEALNEEDKRATKRVLERKK

SEQ ID NO: 12688 - protein, 60 aa, Artificial Sequence
  Synthetic sequence.
REKEELLKLIKRVIELLKRVLEEHLRLVEDVIRRLKELLDSNEKIVREVIEDLKRLLDEV

SEQ ID NO: 12689 - protein, 59 aa, Artificial Sequence
  Synthetic sequence.
EDLLRKAKKVITEVREKLKRNLEDVRRVIEDVKRKSRRILEEARRLIEEVERELEKIRK

SEQ ID NO: 12690 - protein, 58 aa, Artificial Sequence
  Synthetic sequence.
SKVERILRLIEELLRLLREALRKIHRINEELIRTLEEVLREIHRINEDLNRKLREATG

SEQ ID NO: 12691 - protein, 59 aa, Artificial Sequence
  Synthetic sequence.
EELKDRVREELDRSRKKLRKLEEEMRRKLKRSREELKKLEEDLRRELKKLREELERIRR

SEQ ID NO: 12692 - protein, 57 aa, Artificial Sequence
  Synthetic sequence.
SRKERIKRALEEHIRKLKEITDEVRKTNEELLELTRRILEEAKKANEELVKKIREAL

SEQ ID NO: 12693 - protein, 56 aa, Artificial Sequence
  Synthetic sequence.
EEALKELEEKLDRYRRKLEDLLRKYAKKLEDYKRKVKKLEEENEELLKRIEKEMEK

SEQ ID NO: 12694 - protein, 56 aa, Artificial Sequence
  Synthetic sequence.
SEKEELEKRLRKKLEEIKELVERYKRRLEELLRRHREELKEIEKRLEDLERKIEEL

SEQ ID NO: 12695 - protein, 55 aa, Artificial Sequence
  Synthetic sequence.
EEVKKIIEELLRLAEEVLRRNKRLIEALLELHEDEFRKVEEIIKELSEEAKRASK

SEQ ID NO: 12696 - protein, 57 aa, Artificial Sequence
  Synthetic sequence.
REKEKIREALETNLRLLEELIKRLKEILDTHNELLRRVIETLERLLKELLELLEEAG

SEQ ID NO: 12697 - protein, 56 aa, Artificial Sequence
  Synthetic sequence.
KEDLERLRRKVEELEDRLRRLLEKLKRDSDELMRELERILDRYRRESEELDRRLAE

SEQ ID NO: 12698 - protein, 58 aa, Artificial Sequence
  Synthetic sequence.
SELERLRKILDDLRKKVERVAEEHKRANDKLAEEIRRVLKTHREMNERAIEEVKRTVG

SEQ ID NO: 12699 - protein, 55 aa, Artificial Sequence
  Synthetic sequence.
REVDKRLRELLEEHKKLVDDLDKRARKVHKEHKDKVDKLREELEKTLRDIKRETD

SEQ ID NO: 12700 - protein, 60 aa, Artificial Sequence
  Synthetic sequence.
DSDEIVKTLLEKLRRILKEVEEIARENHKRDRDANREINKLVEDIARRLEEVAERLREVI

SEQ ID NO: 12701 - protein, 59 aa, Artificial Sequence
  Synthetic sequence.
EKDLRRLRKDIERLKEEVKRALDELRKKYKKIEDDNRRLVERIRRELKKILDELDEKRQ

SEQ ID NO: 12702 - protein, 58 aa, Artificial Sequence
  Synthetic sequence.
SEIEKVLEINRRVLKELERIVKKVLDIDKEAAELLRDIIRRVLEIIKKVIDDIIRTRG

SEQ ID NO: 12703 - protein, 59 aa, Artificial Sequence
  Synthetic sequence.
KDLEEKLRRVLEELKRLVDDLRRLIDEIKKRYERMVEELKKEIERVLRENEEAVKDLER

SEQ ID NO: 12704 - protein, 59 aa, Artificial Sequence
  Synthetic sequence.
SEEEELEKIAREVLRELKEILEELDDIYRRVTDRLRKLLERLKKEYEEVKKELEDLKRR

SEQ ID NO: 12705 - protein, 56 aa, Artificial Sequence
  Synthetic sequence.
EELVDRLIKLLDENLKRSEEVIREIIELARKNAEDSRRVIKKIIELLREMLKDARR

SEQ ID NO: 12706 - protein, 62 aa, Artificial Sequence
  Synthetic sequence.
DSERELEKVLKDAKEKLDRSLEEVKKVTRETEKRIEEIDKEVKEVLEEADRRVKKIETDKER

SEQ ID NO: 12707 - protein, 56 aa, Artificial Sequence
  Synthetic sequence.
ERLIREIKRIIERVIEILKDIAKEILDLDRESVRLDTEVLKKLLDIIREVVKEAKK

SEQ ID NO: 12708 - protein, 62 aa, Artificial Sequence
  Synthetic sequence.
DEEREVRKVLRRAEELLRRSLKKAEEVTRETRKRIKELLDELRKVLERAERELRRIRREKER

SEQ ID NO: 12709 - protein, 56 aa, Artificial Sequence
  Synthetic sequence.
DRLIEEIKRILEEIIKLIADLARRVLKIDEESVKLDEDNLREVLKILEDVVRDSER

SEQ ID NO: 12710 - protein, 56 aa, Artificial Sequence
  Synthetic sequence.
SEEEEIKKDLERLIDKLRRTSKRLIDDYRRVLEELERTIKRLLEELEELIDELRRR

SEQ ID NO: 12711 - protein, 59 aa, Artificial Sequence
  Synthetic sequence.
EKVERALERILELLKRVIEELERLAEEVLRLSKRVAEENKKLLEEILRILEEIIRRAKK

SEQ ID NO: 12712 - protein, 62 aa, Artificial Sequence
  Synthetic sequence.
SKEEELEKLVRKVEEDLKRLEEESERIKKEIKDTLRKIRKRSEDLKRKVKELLRRLEEEARR

SEQ ID NO: 12713 - protein, 60 aa, Artificial Sequence
  Synthetic sequence.
VDEALEMLKRLLDKALKVHEDVLRKLVELVDEVLKVHEESLRKLLTLAKKVLEVLRKITK

SEQ ID NO: 12714 - protein, 60 aa, Artificial Sequence
  Synthetic sequence.
DDERRKLEDLERMVEELKRKSDKLLKEIREEVERLERETRKLLEELKRKVDELREDLRRN

SEQ ID NO: 12715 - protein, 55 aa, Artificial Sequence
  Synthetic sequence.
EDLEKAERLVKDILRLNEEHTKELEDVVRDLLRKLEKHTRDLEKLVKDALDKVKT

SEQ ID NO: 12716 - protein, 60 aa, Artificial Sequence
  Synthetic sequence.
SEKEELLKRLEDVLRRIKERLDELRRRYKKALDELREESKRLIEKLDKVLREIEELIKRK

SEQ ID NO: 12717 - protein, 59 aa, Artificial Sequence
  Synthetic sequence.
EEILRLLLELLEESIRVAREVNRLLLRLLEKNKELVEEVLKRLLDLLKKIIDIVREVIT

SEQ ID NO: 12718 - protein, 62 aa, Artificial Sequence
  Synthetic sequence.
SKIDEALKKLRKILEDAIKLNKELNDTTREILKEIIKLNREVLEKIRRILKELVDLILKDLK

SEQ ID NO: 12719 - protein, 55 aa, Artificial Sequence
  Synthetic sequence.
EELRRVVEKVRKELEDDKERYKRLEEEVRRLLEEMKRRSEDLERKVEEILRRLTE

SEQ ID NO: 12720 - protein, 58 aa, Artificial Sequence
  Synthetic sequence.
SEKELLEDLRRKAKEVKDRHEELLRDLERTLKKLKDEHDKKLKDLRDELRRVEKKLDD

SEQ ID NO: 12721 - protein, 55 aa, Artificial Sequence
  Synthetic sequence.
KELLKEVKDLLRKLEKVVRDSLELLKRLLEDIEKRVRDSNRELKRILDDIEKKAK

SEQ ID NO: 12722 - protein, 57 aa, Artificial Sequence
  Synthetic sequence.
DKEEELLKKLEEVLKKAEDLIRESNKALKELLDEAVKIVEDSLRELERTLRDIERKV

SEQ ID NO: 12723 - protein, 55 aa, Artificial Sequence
  Synthetic sequence.
EDLRETEKDLRRLSEEHKRLLEELRDKARRLTERHEKALKEIEDELRKIKDEARR

SEQ ID NO: 12724 - protein, 59 aa, Artificial Sequence
  Synthetic sequence.
DEEEKIREDLERTLREYERELRRAKEELKETLKRYEEELREVKEDLDRTLEEVDDLLRR

SEQ ID NO: 12725 - protein, 60 aa, Artificial Sequence
  Synthetic sequence.
KKTLLRDLKEALKTLIKLIREILEDNLRVLRRIIELIETLLEDNRRVLEEIIKLIEEATT

SEQ ID NO: 12726 - protein, 59 aa, Artificial Sequence
  Synthetic sequence.
STKEEVERIVEELRRAHEKSLRDVKKILDDLAKIHDDSLEDARRIIEKLDRILEEIKDR

SEQ ID NO: 12727 - protein, 56 aa, Artificial Sequence
  Synthetic sequence.
DKLLEDVKEEIRKVKERIEDLLRRSRELLERLRKRLDDLLADSERKIDEVTKRTRK

SEQ ID NO: 12728 - protein, 58 aa, Artificial Sequence
  Synthetic sequence.
DELEKVERLLEEIEKIIEDLIRRVEELVRRILEFNKTTLKRNEELVRELEKLVEETTG

SEQ ID NO: 12729 - protein, 59 aa, Artificial Sequence
  Synthetic sequence.
KEVVRKLEEDLRRVRERSKKLVREHEKFLEDLEETIKEEKRRVDEELKRIKEEIKETRR

SEQ ID NO: 12730 - protein, 56 aa, Artificial Sequence
  Synthetic sequence.
SEKERLMRLLDKLKDLNRRLVERIKELLDKALELHKKLVKELRELLERLKELVERA

SEQ ID NO: 12731 - protein, 59 aa, Artificial Sequence
  Synthetic sequence.
EETVRRLREALKKLEDDLRKIERDAEREYKKLKDELEELTERYRREIRKLKEELKKDRK

SEQ ID NO: 12732 - protein, 56 aa, Artificial Sequence
  Synthetic sequence.
SKREELKELLERLLKLDRDTLEELKRLLDELKKTNDDTLEILKRLLEEVLRVIRET

SEQ ID NO: 12733 - protein, 59 aa, Artificial Sequence
  Synthetic sequence.
KDRVREIERRLEELRKRLEKVERDLRDRHRKVKKKLDDVIEKVKRRHDELRKELEDAER

SEQ ID NO: 12734 - protein, 59 aa, Artificial Sequence
  Synthetic sequence.
KDEEEVEKEIRRLLEKVKDVLRRSLEELERLLREIKEVLEKLEREDEENIERIKRELER

SEQ ID NO: 12735 - protein, 60 aa, Artificial Sequence
  Synthetic sequence.
RETLIREIEKILRRLNELNRRLLREVERILERLLELHKRLLDELLRIAERLMRLVEEVKK

SEQ ID NO: 12736 - protein, 56 aa, Artificial Sequence
  Synthetic sequence.
SEAEDLEELIKELAELLKDVIRKLEKINRRLVKILEDIIRRLKEISKEAEEELRKD

SEQ ID NO: 12737 - protein, 59 aa, Artificial Sequence
  Synthetic sequence.
KDEAERRRRELKDKLDRLREEHEEVKRRLEEELTRLRETHKKIEKELREALKRVRDRST

SEQ ID NO: 12738 - protein, 57 aa, Artificial Sequence
  Synthetic sequence.
DEVEKLKKLLKELEELNREVVDTVKKLLDELVKLNRDVLREVRELLKKLIDALEKTG

SEQ ID NO: 12739 - protein, 59 aa, Artificial Sequence
  Synthetic sequence.
EELRRELKKLEEEIERALERIRRRSEETADRIRRTLEKLREKSERKRREIEDTLRKDRK

SEQ ID NO: 12740 - protein, 59 aa, Artificial Sequence
  Synthetic sequence.
SLLEKVKKVIERLLEIHKKLLEELKRLIEKVLRITRENLEEVKRLIKRAVEILRRIAEE

SEQ ID NO: 12741 - protein, 60 aa, Artificial Sequence
  Synthetic sequence.
EEEVTRKIEELRKKLTKLIRELEETLKEVKKRNEDALRRLEKESKDLAERVRRLIEELEK

SEQ ID NO: 12742 - protein, 60 aa, Artificial Sequence
  Synthetic sequence.
SDKEEIKRRVEKTARDLETEHDKIKKRLEDTVRDIKRELDELLEKYERVLRKIEKTLREG

SEQ ID NO: 12743 - protein, 60 aa, Artificial Sequence
  Synthetic sequence.
EKRLIEEVVRLLRENLDVVRRILEALAKLIKELLEALEEVLRRNKELIRELLRVLDEALK

SEQ ID NO: 12744 - protein, 60 aa, Artificial Sequence
  Synthetic sequence.
DEEERVKKLLTDLRRLLRKLHEESKKLLDELRKKLRELRRRSEEKLREVERRLREAEKKL

SEQ ID NO: 12745 - protein, 59 aa, Artificial Sequence
  Synthetic sequence.
EELLRVLEELVRTLKKLLDENLKMVERLIRELEKVLDDHERKVRRLIEELLEVLDRDAK

SEQ ID NO: 12746 - protein, 60 aa, Artificial Sequence
  Synthetic sequence.
DEDRIIEEIARLLEELLRELLELIKKLIETNRRLNEEHERAVRELARLLEELLDRLVKKV

SEQ ID NO: 12747 - protein, 59 aa, Artificial Sequence
  Synthetic sequence.
EKIKKEIERELEELRRMIKRLHEDLERKLKESEDELREIERRLEEKIRRLEEKLERKRR

SEQ ID NO: 12748 - protein, 59 aa, Artificial Sequence
  Synthetic sequence.
STEEKLRELVKRLEELLRDLERLLRELEKSNRDLNETALRLVEESDKLLEELLEKLARN

SEQ ID NO: 12749 - protein, 59 aa, Artificial Sequence
  Synthetic sequence.
KDTVKRLKEDLDKARKDHEKKLEDLERLLKRNEERLRKMKKELEDKVERLRRELEKKRK

SEQ ID NO: 12750 - protein, 59 aa, Artificial Sequence
  Synthetic sequence.
DEEEKIRTTLDLLRKLLKVLREILEELIRSNKELNERLLRLVEDSDRLLEELLKKLEDD

SEQ ID NO: 12751 - protein, 59 aa, Artificial Sequence
  Synthetic sequence.
EEKVRDTEKKLRDLREKHKEIAKELERLLRENRRRLEELKREAKKVLDELRKRLEDERR

SEQ ID NO: 12752 - protein, 59 aa, Artificial Sequence
  Synthetic sequence.
SEKEEVEKRLKDLEEESERLLKEVRDTLKRLEEESKKLIDELRRKLEELRKEVKELVDR

SEQ ID NO: 12753 - protein, 56 aa, Artificial Sequence
  Synthetic sequence.
DKALTKVVDDVLRVLERVIERLLRLNKESLKELERILEDLRRLNKKTLDVLREVTR

SEQ ID NO: 12754 - protein, 59 aa, Artificial Sequence
  Synthetic sequence.
KEKEEVEKKLKEAEEEHRRLNREVEEDLKRAKRESERLLEEMEKKLDELEERVERLLRE

SEQ ID NO: 12755 - protein, 56 aa, Artificial Sequence
  Synthetic sequence.
REVLEKLVRDALRTLREVLDRLRRLNEELLEVLRRVLRELERLTRELLKVLRDALK

SEQ ID NO: 12756 - protein, 60 aa, Artificial Sequence
  Synthetic sequence.
SEAEEVARRIKELVRELEKLLRDSEETIKRLIDKNRDLLRRIAETIDKLIKDLRDLLRRI

SEQ ID NO: 12757 - protein, 60 aa, Artificial Sequence
  Synthetic sequence.
DEDVRRALERVEKLLREILERLKRHSEELAELARRLLDENRRIIEEIIKLIEDILRELKR

SEQ ID NO: 12758 - protein, 61 aa, Artificial Sequence
  Synthetic sequence.
DLERLVEELARLLKEALDTLARHSERLIKLAREILETLRRHSERIAELIERILRELMERRG

SEQ ID NO: 12759 - protein, 59 aa, Artificial Sequence
  Synthetic sequence.
EELKKKLEDISREIKKSLEEVEERLRRISDDVRRSLEELKRILDEIEREIERRLREAKR

SEQ ID NO: 12760 - protein, 60 aa, Artificial Sequence
  Synthetic sequence.
SDEERLRKEIRDRVEELRKRLDDTEEEYDKRIRDLRRKIKEVEDRYREKIKRLEEKLRRG

SEQ ID NO: 12761 - protein, 60 aa, Artificial Sequence
  Synthetic sequence.
KDTVLRILKELMDRDEEILRRILKLIKELLDESKKTVRRVLELLKELLRKILKLVEEITR

SEQ ID NO: 12762 - protein, 56 aa, Artificial Sequence
  Synthetic sequence.
SKKEILKEVLRRILKLIRELIETIKKVLKRSLDLNKELIDINKEALDRILKLLTDI

SEQ ID NO: 12763 - protein, 59 aa, Artificial Sequence
  Synthetic sequence.
KRRLKKLADELKEILDRLREKNKEIADRAKELHDEVRERLKEIAKRLKDVLRDARERVR

SEQ ID NO: 12764 - protein, 60 aa, Artificial Sequence
  Synthetic sequence.
REMEEVLKRNLDAARRVLETLKRILDRLKELNERSLRSLRDILRELLDIAREVLDLRRAG

SEQ ID NO: 12765 - protein, 56 aa, Artificial Sequence
  Synthetic sequence.
IEKVRKDVEDLAKELEDRLRDVERESRRLLEELRETLERALRRVKELHDELREAIK

SEQ ID NO: 12766 - protein, 56 aa, Artificial Sequence
  Synthetic sequence.
SRKEELLRILRRILEIAEEIIRDLKKWLDDDRELVREILELIKRLNEDNNRLIREA

SEQ ID NO: 12767 - protein, 58 aa, Artificial Sequence
  Synthetic sequence.
DELRRLEEALKESKRLVEEVLKRIEDVLRESKKLADEIRKKIEDLVRELEEELERVAR

SEQ ID NO: 12768 - protein, 60 aa, Artificial Sequence
  Synthetic sequence.
SKEEKKKELEKKAREIKRRLEENKREYKEKVDRLKEELRRLLEEIREKVKRLEERIRRAI

SEQ ID NO: 12769 - protein, 56 aa, Artificial Sequence
  Synthetic sequence.
KDLVKELEDVLKELLDLLREILKTVKRVNEDSVRSAEKLIEDLERMIRELLKEARK

SEQ ID NO: 12770 - protein, 56 aa, Artificial Sequence
  Synthetic sequence.
DERERIEEDLKRLRDTLDTKEEESRRRIRELEEDLKRKIEESRRRIEKLKRRMEED

SEQ ID NO: 12771 - protein, 55 aa, Artificial Sequence
  Synthetic sequence.
EILDRLRKVLEELARRDRKILEDLERAVRELDKLDRDILRTLLRVAEELLRRREK

SEQ ID NO: 12772 - protein, 61 aa, Artificial Sequence
  Synthetic sequence.
DKLEEILKLLKEVIKTLLRLSEDLNRLNRELVRTVLELLKRVVELLKRVLEEVRKKVRDAN

SEQ ID NO: 12773 - protein, 59 aa, Artificial Sequence
  Synthetic sequence.
DKVERDVRRIKEKIKRILDDLRRRVEELKKKNKEDLEKYDEDIRRLEEEIKRLLEEARR

SEQ ID NO: 12774 - protein, 56 aa, Artificial Sequence
  Synthetic sequence.
REEKELLDEIRKRVKESEDRLEKLLRDYEKELRRLEKELRDLKRRIEEKLEELRRR

SEQ ID NO: 12775 - protein, 56 aa, Artificial Sequence
  Synthetic sequence.
KDALSRLLEELLRVVDDLIRVLKELIDKSRKVIEELLELLKRINEENLKVLAEIIK

SEQ ID NO: 12776 - protein, 59 aa, Artificial Sequence
  Synthetic sequence.
SRKEKLLKESEEEVRRLRRTLEELLRKYREVLERLRKELREIEERVRDVVRRLKEVLDR

SEQ ID NO: 12777 - protein, 56 aa, Artificial Sequence
  Synthetic sequence.
ERLVKTLIEDVERVIKRILELITRVAEDNERVLERIIRELTDNLERHLKIVREIVK

SEQ ID NO: 12778 - protein, 61 aa, Artificial Sequence
  Synthetic sequence.
SEKEKLREIIKRHLRSVEEVLRLLAKILKDLTDASEENLRLLKELLRRLLEVIRKLVEDVK

SEQ ID NO: 12779 - protein, 56 aa, Artificial Sequence
  Synthetic sequence.
EDALRKLKKKLEEIEKTVKDSIDKLRELLEELERRVRKIAEENKRLLEELVREVKK

SEQ ID NO: 12780 - protein, 60 aa, Artificial Sequence
  Synthetic sequence.
KDEERLEDELRELTERMREKLKEHEERVRELSKEVKRKAEDSEEKLKKDLKEVEDTLRKK

SEQ ID NO: 12781 - protein, 55 aa, Artificial Sequence
  Synthetic sequence.
EELLERIERIIRTSKKLLTEALEIIREIIKRSKDSNRDLHRDLEAILRRIEEAKK

SEQ ID NO: 12782 - protein, 61 aa, Artificial Sequence
  Synthetic sequence.
SDEERLVAELERLIEISLRILEELLEVLRRLVEESLRLLEELVKVAEEIIERLLRLLEETV

SEQ ID NO: 12783 - protein, 55 aa, Artificial Sequence
  Synthetic sequence.
ERLKKTADEIKKRLDKVRKDSDDLAEEIKRILKRVEDESRDTARKVKKVLEDAKR

SEQ ID NO: 12784 - protein, 59 aa, Artificial Sequence
  Synthetic sequence.
SKEDEVLERLKRAIERSIKIVEEIVKRNVETNERSERILRELAETLRRVLDTIRKLLED

SEQ ID NO: 12785 - protein, 56 aa, Artificial Sequence
  Synthetic sequence.
EEELKRRLEEIERKLKEVLDRLKKKHDDDNKENKDVLDEVRKRHKELLDKLREKRK

SEQ ID NO: 12786 - protein, 57 aa, Artificial Sequence
  Synthetic sequence.
DEEEKVLRILEELLKEHKRVLEELLELVRRIIERHKEVLKRVLKLVEDLIRRIKEAN

SEQ ID NO: 12787 - protein, 56 aa, Artificial Sequence
  Synthetic sequence.
EEAAKEVEKRLEEVKTDLRRLARESEETLRRVEERLEELKERSERELKRVEEEIRR

SEQ ID NO: 12788 - protein, 56 aa, Artificial Sequence
  Synthetic sequence.
SEEEELKRILDENHESLKDLLREIKEILRANHETVKKLLETIKEILDTVLKILRDV

SEQ ID NO: 12789 - protein, 55 aa, Artificial Sequence
  Synthetic sequence.
EELLETLKRLIRELVKRLEKILDDDRKLIDRLVRRLEEILKEDKRRIEEALERLR

SEQ ID NO: 12790 - protein, 60 aa, Artificial Sequence
  Synthetic sequence.
SELERAEELIKKLLKLHEDVLRRLTEVDDELLEIHDRVLKRLKEVDDELLKLIRDMLRRA

SEQ ID NO: 12791 - protein, 58 aa, Artificial Sequence
  Synthetic sequence.
EEAKDIREKLERLLRKSEELVRKSLKELKELLDKSKKLLEDSKRRLEEILKEIKDDSR

SEQ ID NO: 12792 - protein, 60 aa, Artificial Sequence
  Synthetic sequence.
DEEDEVEKLIREAIELNKRILEEIKELIERIVRRNKEILREAKEAIERLIKIARDLTKDK

SEQ ID NO: 12793 - protein, 56 aa, Artificial Sequence
  Synthetic sequence.
EEKLERIARELKKLLEEVERRSRKAIEDLKRELKRVMDRSREAERKLRELLKETKR

SEQ ID NO: 12794 - protein, 58 aa, Artificial Sequence
  Synthetic sequence.
SEDEVLKKIEDELREVEKKLEDVLREIKRRHDELKKRLDEKLERLRRRHEELKEALDR

SEQ ID NO: 12795 - protein, 60 aa, Artificial Sequence
  Synthetic sequence.
EEEVKRDLKRILDRLLEVNTKSIEDLKRILDKLLEVNRRNVDEIRRILDELRKVIERVTK

SEQ ID NO: 12796 - protein, 60 aa, Artificial Sequence
  Synthetic sequence.
DETERVKEVLDRSLKLNEDLLRKIDEILKRLFEINKEVIDIIRELLERLVRIAREVLEKN

SEQ ID NO: 12797 - protein, 55 aa, Artificial Sequence
  Synthetic sequence.
EEVEKRIKKLLDDLEKVAREIRKKHKELLEELEKVAREVMDAHRRLLEDLKRTDD

SEQ ID NO: 12798 - protein, 59 aa, Artificial Sequence
  Synthetic sequence.
SLKEIVKEIIDRASELLKRLLERSEDSLRTASELLRKILEDSRRSLRTIARLLEELLRT

SEQ ID NO: 12799 - protein, 55 aa, Artificial Sequence
  Synthetic sequence.
REIEKEIRRILEELKRKHDEIEKKIRELEREIKRKHEELEDRIRKIERDLDRRTK

SEQ ID NO: 12800 - protein, 58 aa, Artificial Sequence
  Synthetic sequence.
SLRELVEKILRDAAKLIERLLKLSEEVLKRIEELLEELLRLSERSLRELLRLLEELLR

SEQ ID NO: 12801 - protein, 55 aa, Artificial Sequence
  Synthetic sequence.
KDIKKELDDIVRDVKRKHDKLREELKKIVEDAERAHRDIDRKIREILKELKERTD

SEQ ID NO: 12802 - protein, 57 aa, Artificial Sequence
  Synthetic sequence.
REEELRKKIEDELRDLKRKLEDLLRRYEEKLREAEKKLKDLLRRYEERVREIKKELS

SEQ ID NO: 12803 - protein, 60 aa, Artificial Sequence
  Synthetic sequence.
EDELLRVLEKVIEDNLRIVEELIRRLEEVLKRHEDLVRTLLDLLKRVLEAVKKLLDEAVT

SEQ ID NO: 12804 - protein, 60 aa, Artificial Sequence
  Synthetic sequence.
SSEELLKRIVDEDERVLEEWRRVLEEIKDLSKRVVDLLDKVLKEIEKIVDEVTRRLERDG

SEQ ID NO: 12805 - protein, 55 aa, Artificial Sequence
  Synthetic sequence.
KDLLETIKKRVEEIRRTLEKIKRDYDKAIEEIRRKLERKLEEYKEVIDDLRRKTK

SEQ ID NO: 12806 - protein, 59 aa, Artificial Sequence
  Synthetic sequence.
SSDELLEEIIKEIARLIEELLEILRENLERSEESLRRVLRAIDDNLRRVERLIEALARG

SEQ ID NO: 12807 - protein, 56 aa, Artificial Sequence
  Synthetic sequence.
KKAMDEELEKIRRDHERLKKEIEDRLRELKDKHRRAFEELKKMLDDIKRKVDEAKR

SEQ ID NO: 12808 - protein, 59 aa, Artificial Sequence
  Synthetic sequence.
DEEEILREILRVAEELSRLNEEVNKRVLEVLERLSRMNEKLLKEVKDVVDRLIELRRRK

SEQ ID NO: 12809 - protein, 60 aa, Artificial Sequence
  Synthetic sequence.
DKEVKRRIEKALRDIEELIERILRRNEEVKREIERLDEENRRRNKEALERIRRLIEETKR

SEQ ID NO: 12810 - protein, 59 aa, Artificial Sequence
  Synthetic sequence.
KDEEELKRRVEKVIRDLERKLKDLEEDHRRVLEELKRELEETKRRLDKVIEEIERVLRR

SEQ ID NO: 12811 - protein, 60 aa, Artificial Sequence
  Synthetic sequence.
KERLIRVLEEILRLVLRLHEEVVRLVRRLLEESHRILRKIVELLREILEDLKKILDDIRR

SEQ ID NO: 12812 - protein, 56 aa, Artificial Sequence
  Synthetic sequence.
DEEDEIRKRLKELLDDVKRRLDELRRESERLLKEVDDLLRESKKRLEDEKKKLEER

SEQ ID NO: 12813 - protein, 55 aa, Artificial Sequence
  Synthetic sequence.
KEVLERLEKIVRRNEEVNDEVRELVTRLNETSNRAARELLELAKRIIEEIKKAVK

SEQ ID NO: 12814 - protein, 57 aa, Artificial Sequence
  Synthetic sequence.
SKLETIKELLERLHELNERAVRELKKTLEDLHRDNARLIEELIRKNERLLEALREKV

SEQ ID NO: 12815 - protein, 55 aa, Artificial Sequence
  Synthetic sequence.
EDADRDVKRLKEESEELLRRSKKRADDLKREVERLLEESRRRLDELLKELKDRSK

SEQ ID NO: 12816 - protein, 61 aa, Artificial Sequence
  Synthetic sequence.
SRLEEIKKLLEKVMELIRRIAEELLRINEKVLEVLERIVRTILRLNEEHLKDVRDIARKLK

SEQ ID NO: 12817 - protein, 55 aa, Artificial Sequence
  Synthetic sequence.
TEIRKRLKELRDKNEELKKKVEEMIRRLEEESKKTKKRVEEILKRIEEEVREKAR

SEQ ID NO: 12818 - protein, 57 aa, Artificial Sequence
  Synthetic sequence.
SREETLRERIERIKRKSEEDVERIKRTLDREREENEETVRRIKETVDRLREEVEREL

SEQ ID NO: 12819 - protein, 58 aa, Artificial Sequence
  Synthetic sequence.
RELDRVEEIIRRIVKKLEEILRDLKRRAEDHIRRLTELIERSLKIVRDLAEDIRRAIE

SEQ ID NO: 12820 - protein, 59 aa, Artificial Sequence
  Synthetic sequence.
DADELLRRLAEEVERVIREAEDLLRRWKETIKKVLDDLKRLLDELKKRNEDVIRELTKT

SEQ ID NO: 12821 - protein, 56 aa, Artificial Sequence
  Synthetic sequence.
KDDLEDILRKNLDRLRKLLERLREILRENLEALKKTLKRLEDVVREILEDLKRERK

SEQ ID NO: 12822 - protein, 59 aa, Artificial Sequence
  Synthetic sequence.
TEKELLEELEEDVKRVIEELERLLREWKEELRRVLEESERLLRELRERNKRELEDIRRI

SEQ ID NO: 12823 - protein, 56 aa, Artificial Sequence
  Synthetic sequence.
LEEVTRILERNLKELERNLRDLDRTVKTNERLLRELLKKLRDIVRTILELLERKTK

SEQ ID NO: 12824 - protein, 57 aa, Artificial Sequence
  Synthetic sequence.
SEKEDVRRKLEEDREKHERDLRRIEEELRRTIEESERRLKEVKKRLKELIDDVRRRD

SEQ ID NO: 12825 - protein, 60 aa, Artificial Sequence
  Synthetic sequence.
KEELKKAVETILEELVRIADKLIDIHREILEKLLRVAEKLLEVSRRALDKLKKLIDKTDK

SEQ ID NO: 12826 - protein, 56 aa, Artificial Sequence
  Synthetic sequence.
DKAEVLREALKLLKDLLEELIKIHEESLKRILDLIDTLVKVHEDALRKLKELLERS

SEQ ID NO: 12827 - protein, 55 aa, Artificial Sequence
  Synthetic sequence.
EEIDRELKRVVEELRRLHEEIKERLDDVARRSEEELRRIIKKLKEVVKEIRKKLK

SEQ ID NO: 12828 - protein, 59 aa, Artificial Sequence
  Synthetic sequence.
REKEEIERTLEELKRILDELVKDDKKSLDRLREIMERSVRIAEETLRKLRETLELKARG

SEQ ID NO: 12829 - protein, 56 aa, Artificial Sequence
  Synthetic sequence.
KDEVLKRLDDLIKEWRDVLEKLLRDLRELLERSKKRLRKVREDLKRLLEELERRAD

SEQ ID NO: 12830 - protein, 56 aa, Artificial Sequence
  Synthetic sequence.
STREKAKKVLDTLRRDNEDMKRVVEKILRALKRTNERAEKLAREITEEIKRILKEV

SEQ ID NO: 12831 - protein, 56 aa, Artificial Sequence
  Synthetic sequence.
EDLLRKLEEELRRIKEKLRKALEELEREHRELEKELDKLHDESRKEHERIEEELRR

SEQ ID NO: 12832 - protein, 60 aa, Artificial Sequence
  Synthetic sequence.
DKERVLEDVKRRAKELEELLKEVEDRYEEDLRRIEETLKDTERRYREKLEKIKEELKRTV

SEQ ID NO: 12833 - protein, 59 aa, Artificial Sequence
  Synthetic sequence.
EKIKRIVEKIIKEHRDVLERLKRIIEEITRSDRESLERLKEILKELIRILKELADRERK

SEQ ID NO: 12834 - protein, 60 aa, Artificial Sequence
  Synthetic sequence.
KSEDVVRELIKLHRELNDKARKVIETILERNRELVETAERVIRRLIKLLEDALRILKKSS

SEQ ID NO: 12835 - protein, 56 aa, Artificial Sequence
  Synthetic sequence.
EEELRRLEEEIRDIVRRLRKRVEEYRKELEDLEKELADEVKKYEDEVKRIREELRK

SEQ ID NO: 12836 - protein, 60 aa, Artificial Sequence
  Synthetic sequence.
STEELLREIEEIIRRILEIADKTSKEWADLIKRILELIKRNLEELRKLVREVLEEVRKEG

SEQ ID NO: 12837 - protein, 56 aa, Artificial Sequence
  Synthetic sequence.
KDTIDKLRKRLKEIKDRTKELLDRIREEIRELRERNKEIVKDIERRLRELKDRIRK

SEQ ID NO: 12838 - protein, 57 aa, Artificial Sequence
  Synthetic sequence.
SKKELVREVVKELHELNKDVLRVLTEIVERVKELDKRVLEVLRRIVEEVERLAKEAG

SEQ ID NO: 12839 - protein, 59 aa, Artificial Sequence
  Synthetic sequence.
KDRLREIEERVRKILEEIDKLLDDLRKAYDRILERIERLVRELSRKHKEVADKITELVK

SEQ ID NO: 12840 - protein, 60 aa, Artificial Sequence
  Synthetic sequence.
SEDERVTRLKEELERLLDELRKRYEKLREEIRRVLEDLKKKYDELKEELDKMLRDLERRG

SEQ ID NO: 12841 - protein, 55 aa, Artificial Sequence
  Synthetic sequence.
EELLRELERVSREDERLVKEAADELRRILDTDRKLLKEVVDTLERVLRRILKETR

SEQ ID NO: 12842 - protein, 61 aa, Artificial Sequence
  Synthetic sequence.
SEEERVEELLRRIEKLLKESEEDVERLKKRHEEENRRLKEEVKRLMDELREILRRLEEETG

SEQ ID NO: 12843 - protein, 58 aa, Artificial Sequence
  Synthetic sequence.
KDVDKLVEVLDRVLRRVRELLEELAETNRESIRRYERLSEKNAELVTEIIERLRRTVK

SEQ ID NO: 12844 - protein, 56 aa, Artificial Sequence
  Synthetic sequence.
SKMEKLLKDLREALEKVKRRYEELERRLDEVLKEHEEIVKRLLEELEKVLKRIEEG

SEQ ID NO: 12845 - protein, 59 aa, Artificial Sequence
  Synthetic sequence.
ERVEELIERLIRIIERLLREVIKSHEKLVRTIERLIEESIRVNEELLEVIERLLDRARK

SEQ ID NO: 12846 - protein, 57 aa, Artificial Sequence
  Synthetic sequence.
DLERVVEDIVDKAKRLLDKNLEVLKRIVDEVLRLLERLLRESRKVVKRVKEIIEELV

SEQ ID NO: 12847 - protein, 59 aa, Artificial Sequence
  Synthetic sequence.
KDLLTELEKKLRKLKRDSEKVVDDLKKELERIKREVKRLIEENRRTLKDIKRAVDEARK

SEQ ID NO: 12848 - protein, 57 aa, Artificial Sequence
  Synthetic sequence.
DEDELVEEIERRLREIEKRLRDVMEESKRRLEEILRELKRIIDESRKRLDDLRRRLK

SEQ ID NO: 12849 - protein, 59 aa, Artificial Sequence
  Synthetic sequence.
ERIEKILEEILRLSRESLRKLKKILEELLKVSEDSLRDLIRILEDLLRLLKDLLEKLKK

SEQ ID NO: 12850 - protein, 59 aa, Artificial Sequence
  Synthetic sequence.
SEDEELEDLKRKLRRALERYEDRLREIKRRLDEKLKEIKRDYDRLKKELDDLLREIERR

SEQ ID NO: 12851 - protein, 55 aa, Artificial Sequence
  Synthetic sequence.
EVVKELLDLVREIIKRLKEIHEEILRLIETVLEDLERANRRLLDLARKILEDARK

SEQ ID NO: 12852 - protein, 60 aa, Artificial Sequence
  Synthetic sequence.
SKEEKLEDLIRRIKERLEEALRRNKKTADEIRKELKKATDRNRKRAKELRERLREVLRRT

SEQ ID NO: 12853 - protein, 55 aa, Artificial Sequence
  Synthetic sequence.
EVVEELLRLLEELLEHNREVIEKLVDLIRELLRHDKEVTEEILRLIEELLKEVEK

SEQ ID NO: 12854 - protein, 56 aa, Artificial Sequence
  Synthetic sequence.
SERELIERWLELHKEILRLIRELVERLLKLHREILDTIKKLIRELLELLEDIARKL

SEQ ID NO: 12855 - protein, 59 aa, Artificial Sequence
  Synthetic sequence.
DDERRTLTELLKRMEDILEKVERTLKKLLDDSKRMAEEVKKTLKELLERSEKVAEDVRK

SEQ ID NO: 12856 - protein, 60 aa, Artificial Sequence
  Synthetic sequence.
SEDELIRRIREELKRLEKEHEDMVRELEKKHKKLKEELDRAIEEIERRLRELKERVEREG

SEQ ID NO: 12857 - protein, 55 aa, Artificial Sequence
  Synthetic sequence.
DELVKEIKRLLEELLRLLERLVRSSRRLNEELLRLSEKLIRDAERLARELLEAAR

SEQ ID NO: 12858 - protein, 56 aa, Artificial Sequence
  Synthetic sequence.
KKEEDLRREVEEVKEEIRELIERSRESVRRILKEIKDLIRKSKESIDKILEDLKRK

SEQ ID NO: 12859 - protein, 59 aa, Artificial Sequence
  Synthetic sequence.
EEVLRVVEELLKLLKEHLEENVRILRRILELLRRHHDTNRKIVKRILELLRRVLESIRK

SEQ ID NO: 12860 - protein, 60 aa, Artificial Sequence
  Synthetic sequence.
SVEEILRELLRVLEEILKRIADINEKLLRVSRKIVEDLKRLLDEALRVLRRAVEEIEKEG

SEQ ID NO: 12861 - protein, 58 aa, Artificial Sequence
  Synthetic sequence.
ERLREILEELERVLEKVMRDLRRILREYEEVLKEAREEYRKILEELRKVLKEVDDRLR

SEQ ID NO: 12862 - protein, 57 aa, Artificial Sequence
  Synthetic sequence.
SELEKIDRLLEKVLRENKRALDELVRLLEELIKTNRDALEKLREINERNIERLREEV

SEQ ID NO: 12863 - protein, 59 aa, Artificial Sequence
  Synthetic sequence.
KKVLEDLERHLEESKKTVERLVRELRKTHRKVEEDVKRLIEELRRLHEELRKRLEDDDR

SEQ ID NO: 12864 - protein, 56 aa, Artificial Sequence
  Synthetic sequence.
REKEELIKLIRDILEKLREHSRTIVELLETILRVVREHSKRIEKLLRELLDILRRQ

SEQ ID NO: 12865 - protein, 60 aa, Artificial Sequence
  Synthetic sequence.
EKEVEDLLRKAVEDIEKLIRENEKLLEDVLRTIRKLIRENEELLRDIVEKIKRLADEARK

SEQ ID NO: 12866 - protein, 59 aa, Artificial Sequence
  Synthetic sequence.
SEEEEVKKVVDEIKKVLDELRKANEDSARRLREVLEELRKRNEESKKEVKDLLEELKRV

SEQ ID NO: 12867 - protein, 60 aa, Artificial Sequence
  Synthetic sequence.
TDTKVKELIEIVDELLEIDDRILEEIERTVRKVIDLNRKVLEDIEELVKEAIKVLEEIAK

SEQ ID NO: 12868 - protein, 59 aa, Artificial Sequence
  Synthetic sequence.
DEEEELRELKERIERTIEKLKEDTKKLKKELEDRIRELKRKTKELLDDMKRLIKEVKDK

SEQ ID NO: 12869 - protein, 55 aa, Artificial Sequence
  Synthetic sequence.
EDIIRLVRDLIRLNREHLRDLEEAVREIIKLLREHLERLERVVDRMIRELRKAAK

SEQ ID NO: 12870 - protein, 57 aa, Artificial Sequence
  Synthetic sequence.
SEEEELDKLRRELEELAKESTREVKELLRELREMLERHKKRLKEIKDKLDEDIKRED

SEQ ID NO: 12871 - protein, 58 aa, Artificial Sequence
  Synthetic sequence.
DELERLKDLLRTLIKKLEDLLENLRRLVERVIESLRRLVEKDEEINKRTIKELRRAIE

SEQ ID NO: 12872 - protein, 60 aa, Artificial Sequence
  Synthetic sequence.
DEERIVDKILKVIRESAEALRKIVEDVLRVLEELMRRHKKNVEELDTIVEDLLRKVRERV

SEQ ID NO: 12873 - protein, 56 aa, Artificial Sequence
  Synthetic sequence.
EEVLREARRRIREVERHNKKVHDDARKRLRDLVEELKRLHRELEEKLRRIIEEIDR

SEQ ID NO: 12874 - protein, 61 aa, Artificial Sequence
  Synthetic sequence.
SEDEKVRKLLRDLAEEIKRLLETYDRKLKEIAKRIEDTLREYRERLEELKRRLEELVRKKN

SEQ ID NO: 12875 - protein, 59 aa, Artificial Sequence
  Synthetic sequence.
EELVREIRRTLETILRLNEELLKRIRDVLREIIELNREVIERLREILERLADLIRRRAE

SEQ ID NO: 12876 - protein, 60 aa, Artificial Sequence
  Synthetic sequence.
SELEKLARLLEEILELLRELHRKTAEALKEILELLDRHLDDLRRAVKEILEDLDKDLEDE

SEQ ID NO: 12877 - protein, 56 aa, Artificial Sequence
  Synthetic sequence.
DDKAKKVREKLEELLRRLKEKNDDLRRKLERLARELEKLHEEVKKRLKELEDEARR

SEQ ID NO: 12878 - protein, 60 aa, Artificial Sequence
  Synthetic sequence.
RELEKLAEVLERIVRALETHLKLIADVLREILRLLDEHLKIIKKVVRDILRELDEVLRRR

SEQ ID NO: 12879 - protein, 56 aa, Artificial Sequence
  Synthetic sequence.
SDTLEKLRRRLEDRRRKLKEANDRVREVLDRLRKELEEIDKRLEDVLKKLREDLER

SEQ ID NO: 12880 - protein, 60 aa, Artificial Sequence
  Synthetic sequence.
SKKELLEEVVRRAIELLKRHLEKLKRILEEIVRLLEEHLEKVERVLEAILRLLDDLLRRV

SEQ ID NO: 12881 - protein, 56 aa, Artificial Sequence
  Synthetic sequence.
KDKLKEIEDELRRLLEELRRLDKKIKDRLRELKKDLDEANRRIKETLKKLLREVEK

SEQ ID NO: 12882 - protein, 56 aa, Artificial Sequence
  Synthetic sequence.
SDLEELEKLIRRLLKINEDLIRIIEDLIRKSLTLLKRIVDLIRELIREIEEIIRRT

SEQ ID NO: 12883 - protein, 55 aa, Artificial Sequence
  Synthetic sequence.
EEIRKRVRDLEEKVKKLLRDLEEESRRVAEKVEEDLKRVEEESRRTAREVEEKER

SEQ ID NO: 12884 - protein, 60 aa, Artificial Sequence
  Synthetic sequence.
SKEERADELLKDLERKVDKLRREHEELLKELKRKVDELRKEHKKLLDTLREEVRRIEEKV

SEQ ID NO: 12885 - protein, 59 aa, Artificial Sequence
  Synthetic sequence.
EDVLREITRLLEKAKRIIEESLREITELVKEIEKIIKESLDAARRLLEEIKKILEELAR

SEQ ID NO: 12886 - protein, 59 aa, Artificial Sequence
  Synthetic sequence.
SIEELARKLVKENRRLATEANKILKDIVKTNRDSIRKVREILKELVERLRDLIRKVRRD

SEQ ID NO: 12887 - protein, 55 aa, Artificial Sequence
  Synthetic sequence.
EDLKRELERAKRELERLLRELDEEHERMKKKVKDEIRRLKKESEEVKKEVKDTED

SEQ ID NO: 12888 - protein, 59 aa, Artificial Sequence
  Synthetic sequence.
DEEEITRKLEETIRRLEEEIDKIIKDLLRMLEENNKEIKKVIEKVLETSRRILSALARN

SEQ ID NO: 12889 - protein, 56 aa, Artificial Sequence
  Synthetic sequence.
EEVLREAEKRIRDSAEEVKRILEEHKERLRELVKKLERVKETVRKKIEELREEAKR

SEQ ID NO: 12890 - protein, 56 aa, Artificial Sequence
  Synthetic sequence.
SELEKDLKDAEEIIKELEEINKRLLEEIRRIVERITKINRDLLETVKRLIEELIKE

SEQ ID NO: 12891 - protein, 56 aa, Artificial Sequence
  Synthetic sequence.
EERLKEIEERIRRTEEDVKRKHDDVRRELDEEDDRYKRELDKVRKKLKEKADRIRD

SEQ ID NO: 12892 - protein, 56 aa, Artificial Sequence
  Synthetic sequence.
SKLEDLLRKVEEIIKEIERINEELLKRVAEIVETLLRENKKLLEEIKEILKRLIED

SEQ ID NO: 12893 - protein, 56 aa, Artificial Sequence
  Synthetic sequence.
ERKLDKIRKDLERVVREYEEKLKEVRKRLRELVERVKEKHKRIEEELRKTAKEVRD

SEQ ID NO: 12894 - protein, 59 aa, Artificial Sequence
  Synthetic sequence.
SSKELVEKLKELIKDHLRVADEVIKKLEELIRRHLRKVEEIARRLEELIRELADELRRA

SEQ ID NO: 12895 - protein, 55 aa, Artificial Sequence
  Synthetic sequence.
RRLDRLEEKVEKDLRKLARELEDVNRRLEEELRRLEKRSEDLNRRIREEIKKDAK

SEQ ID NO: 12896 - protein, 61 aa, Artificial Sequence
  Synthetic sequence.
KDDEILRKLLEILERLLKLSEEVLRELLRLLEELLRLSKESLKRLSRLLEEALKTLVEEEG

SEQ ID NO: 12897 - protein, 59 aa, Artificial Sequence
  Synthetic sequence.
ERLKAVVDRIEKAIKKVTEDSRRLVKRIETELRELVKRSKDLAREVEKRLKEVVEEAKR

SEQ ID NO: 12898 - protein, 59 aa, Artificial Sequence
  Synthetic sequence.
SDLERILDKVTKLAEDAKKLAKKSVDLHRDNIRRLKTTLKRILESLRKAIKRLKDALRR

SEQ ID NO: 12899 - protein, 55 aa, Artificial Sequence
  Synthetic sequence.
EELEELKRDLDRLFEKIRTDLKRLRDTNRKLFDDLRKEHEAVEDKVRRVAEELTK

SEQ ID NO: 12900 - protein, 56 aa, Artificial Sequence
  Synthetic sequence.
SEEDLVREVLRAIKRILELLTTLSKENLEVVKRIIEDLERVARENLRVIEEIIKKI

SEQ ID NO: 12901 - protein, 56 aa, Artificial Sequence
  Synthetic sequence.
ERIIEEIRRTATEVLKRNEAVVKKIRELIKRVTERNRKVLEEIKELVKRIKDELRR

SEQ ID NO: 12902 - protein, 56 aa, Artificial Sequence
  Synthetic sequence.
DKEREIDDIAEKLRRKYKKLREDLDRIEEELRERYERLKRKLDELARRLTKKARDE

SEQ ID NO: 12903 - protein, 55 aa, Artificial Sequence
  Synthetic sequence.
ERLEELLKEVVETLRRLLEELKRLSEEVLKKAKEVIDRIRRLSEEVVKSLRDAAK

SEQ ID NO: 12904 - protein, 61 aa, Artificial Sequence
  Synthetic sequence.
SEEEELDKLLKEYERVVREIEEKLDRVKRDIERLVEEITRDLRRVLEEYRKVVEELAKDEG

SEQ ID NO: 12905 - protein, 58 aa, Artificial Sequence
  Synthetic sequence.
DTARRIERLSREVIKKLEKALKELEDLVREVLRRLKEAVEEIHKLSRDVIKMLTDATR

SEQ ID NO: 12906 - protein, 59 aa, Artificial Sequence
  Synthetic sequence.
DDEERLKKVKEEIEEKAKRLKEDLERALKRYEDIIKKLEDDNRKVLERIRRKVEELKKN

SEQ ID NO: 12907 - protein, 60 aa, Artificial Sequence
  Synthetic sequence.
DELIRKALEELLRIAEEILRRDLRLLEENRRVVKESLDVLAELLERLLELLERILREVRK

SEQ ID NO: 12908 - protein, 60 aa, Artificial Sequence
  Synthetic sequence.
SERDVLRELLERIKKLLETLIRIVEELVRRSEETIKRLAELNRRLIEEIRRIVEEVKKDV

SEQ ID NO: 12909 - protein, 55 aa, Artificial Sequence
  Synthetic sequence.
EEVKKRVEELRREYRETLKRLRDESEKIAEELKRLLDELRRRLEELARELRERTK

SEQ ID NO: 12910 - protein, 58 aa, Artificial Sequence
  Synthetic sequence.
TEEEIIKEIVKLLRDLARLHEEVDRTNKRLLDELVRLHREVDERLTRLAEDLIRLAEK

SEQ ID NO: 12911 - protein, 56 aa, Artificial Sequence
  Synthetic sequence.
RKDLRKVVEELRRRIEELNRRHDKLAEDLRREIEELNKEHKRMLRELEKKIEDDRR

SEQ ID NO: 12912 - protein, 57 aa, Artificial Sequence
  Synthetic sequence.
DAEEILKEIHEIDKRTIDEIRKILKKLLEADKKSIDDIRRILKKLLEIVKRLIDLLR

SEQ ID NO: 12913 - protein, 56 aa, Artificial Sequence
  Synthetic sequence.
DKTLKKILDELRRKVKETDDRLRKLHEDLKRKVKELIDRLERLNEDIARLLKETRD

SEQ ID NO: 12914 - protein, 57 aa, Artificial Sequence
  Synthetic sequence.
KTEELLRELIKVLKETLDRLKRVLEKLAETNDKSLKELLKLLEELLKAIRDVLRRIL

SEQ ID NO: 12915 - protein, 55 aa, Artificial Sequence
  Synthetic sequence.
DEVVEELEKVARELADKLRRVLKESEDVVKRVKDELREVLDRSKKVLEELKKKRK

SEQ ID NO: 12916 - protein, 58 aa, Artificial Sequence
  Synthetic sequence.
SKEELVKEIDELNKRVNDLLEELLRKSEKLHKEILELLERLLREIIKLLRRILEIVER

SEQ ID NO: 12917 - protein, 56 aa, Artificial Sequence
  Synthetic sequence.
EDELRRLLEDIERKIERLLRELKKESEEIRKRIRELLEDNRDKSRKIKKAIEELKK

SEQ ID NO: 12918 - protein, 56 aa, Artificial Sequence
  Synthetic sequence.
KLEDAARIAAKAAEEWAEAHKRAAKINAEASEEWAKAHREAAKIAAEAAKRAADEA

SEQ ID NO: 12919 - protein, 55 aa, Artificial Sequence
  Synthetic sequence.
EDALRVIEKAAEDAERAAKESLDVAERALRESEKAAKESLEVLERALRDAKRAAD

SEQ ID NO: 12920 - protein, 55 aa, Artificial Sequence
  Synthetic sequence.
SALETAAKLAKEAADRWLEASKRAAELAKDAADKWLDASRRAAELAKKAAKEALD

SEQ ID NO: 12921 - protein, 60 aa, Artificial Sequence
  Synthetic sequence.
DTDLKRRAAKAAEDIKKAADELLKKSEDAAREIKEAADKLLEDSKRAAEEIKRAADEITR

SEQ ID NO: 12922 - protein, 57 aa, Artificial Sequence
  Synthetic sequence.
DEAEKLAKEAREAIKRYADASEKIAKEAREAIKKYLEASKRIAKELREALKELARRL

SEQ ID NO: 12923 - protein, 56 aa, Artificial Sequence
  Synthetic sequence.
KDAVREADEAAERAREKLERLSREAKKAAKDAKDKLKRLSDEAKKVARRLIEELKR

SEQ ID NO: 12924 - protein, 58 aa, Artificial Sequence
  Synthetic sequence.
SKDEKAIEALKRAADETRKAAEKSADAARRAAEKSEKAAREAAEALKRAVEEAARALG

SEQ ID NO: 12925 - protein, 55 aa, Artificial Sequence
  Synthetic sequence.
EAVLRAAEKAIKAAEEAARANKKAADEAIRANEEAAEANKRAADKAIKAIRDAAR

SEQ ID NO: 12926 - protein, 58 aa, Artificial Sequence
  Synthetic sequence.
DREDAARRVEKAAREIAEKNKKAARDIKELAKEAIKRTKEAAERVKRAAKRIAEAAEE

SEQ ID NO: 12927 - protein, 56 aa, Artificial Sequence
  Synthetic sequence.
KDAVKRALEELARAAEEAARADAEAAKKLAEAAERAARANIKALRDLAKAAKDAAR

SEQ ID NO: 12928 - protein, 60 aa, Artificial Sequence
  Synthetic sequence.
REEEAAREAAEAARRAAEIAIKANEEAARAAKRAAEISIKASEDAARAAEEAAKEAARSN

SEQ ID NO: 12929 - protein, 59 aa, Artificial Sequence
  Synthetic sequence.
EDALRRAKKAIEDAIKVLKEALDKSAKAIEEAIRVAKEANERSAKAIKDAIEVAERAAR

SEQ ID NO: 12930 - protein, 59 aa, Artificial Sequence
  Synthetic sequence.
SEAETLVERLKRLSERDERAARRLVEELKRLAEEDKRAAEELARRLEELARRAEDVARA

SEQ ID NO: 12931 - protein, 116 aa, Artificial Sequence
  Synthetic sequence.
EEAARAIKLAREAAKRAIDASKESADAAERAAKEAIKASKRSAELAEEAAREAIKALKDAAEEAAKRLRRAAEEALKINKRANEELERAAREALDLNRRANEDLEKAAEDALRTAK

SEQ ID NO: 12932 - protein, 59 aa, Artificial Sequence
  Synthetic sequence.
REAEELVKRLKELAEKDRRAAKRLVEEAEKIIRRARELSKKTVKKLEDLIERAKRLADA

SEQ ID NO: 12933 - protein, 56 aa, Artificial Sequence
  Synthetic sequence.
AEDAARRAEEAARRALKINEDAAREAERAAREALKINDEANKRLEEAARRALETAR

SEQ ID NO: 12934 - protein, 60 aa, Artificial Sequence
  Synthetic sequence.
KELEEILKTVEDLVRRAKELLRRIHEINRESIEDIRRLLKEIHDTNKRSIEKVDELLKRK

SEQ ID NO: 12935 - protein, 56 aa, Artificial Sequence
  Synthetic sequence.
ETEIRKILKESNDRLTEVIKEVEKVLRESDELLRDALKKIVDVLREVLKRLEDTVR

SEQ ID NO: 12936 - protein, 59 aa, Artificial Sequence
  Synthetic sequence.
EKEKEIKDAEDEARKAAEESKRKIDKADEDAKKALEELERSIREADKDAKRALDEERRE

SEQ ID NO: 12937 - protein, 57 aa, Artificial Sequence
  Synthetic sequence.
REDAARIAAKAAKDALKANEEAARILARAAKEALKILEDATRILKEAADRALDILRK

SEQ ID NO: 12938 - protein, 60 aa, Artificial Sequence
  Synthetic sequence.
SEVEEIEKVARRNLELIKRLLEKAERVAKKSLDLIKKAADDARRIAEETLKLIREAAEAG

SEQ ID NO: 12939 - protein, 62 aa, Artificial Sequence
  Synthetic sequence.
KEAEDLLREAAKRAEELIRRAEEAAKRLKEEWERLIRELKRALEEYAKEAKKLIKELEDRTR

SEQ ID NO: 12940 - protein, 62 aa, Artificial Sequence
  Synthetic sequence.
SKREEAEKAARRAEKLAREAREAARRSLERAKDLARRHEKLSRELLEEAKRLAEEVKETAKK

SEQ ID NO: 12941 - protein, 56 aa, Artificial Sequence
  Synthetic sequence.
IDEALKALKRAADLSADANRRALEALEKAARLSARAAEEALEALRRAAELARRAAE

SEQ ID NO: 12942 - protein, 57 aa, Artificial Sequence
  Synthetic sequence.
SAEDIIRESEKADKDALDEWRRLIKKLEDLIEELLKENERLIRKLEELIKKALEADK

SEQ ID NO: 12943 - protein, 56 aa, Artificial Sequence
  Synthetic sequence.
GEEAAERAKRAADEAKKASDEAAKEAREAAERALRAAEEAAKEAEKANRDALRSAK

SEQ ID NO: 12944 - protein, 61 aa, Artificial Sequence
  Synthetic sequence.
SEDEELAKEAKRAVEEAKKRLEDLLRRAEEAHRRAKKELDELARRAEEAHKKAKRDIDRDA

SEQ ID NO: 12945 - protein, 62 aa, Artificial Sequence
  Synthetic sequence.
EEIVRRADELAKRAEELNRRLAEEADKIAKKAKDLNERLLREARDIARRAKELIKRLLDARR

SEQ ID NO: 12946 - protein, 56 aa, Artificial Sequence
  Synthetic sequence.
SKAERVVDEARKTDEEVLREAEKVNRKVEEVIRRVLKRNEDVNREIARAIERVLRG

SEQ ID NO: 12947 - protein, 59 aa, Artificial Sequence
  Synthetic sequence.
EEVLRTAEEVVREALRLVTDAHRVNEEVIRDVLRLVERVHRVYEEVNRRNDELLKELTD

SEQ ID NO: 12948 - protein, 58 aa, Artificial Sequence
  Synthetic sequence.
KDEERLREILKKYKEDSERILREVREILERYRRAIEEILKRLEDILRKLEEDVRRELK

SEQ ID NO: 12949 - protein, 55 aa, Artificial Sequence
  Synthetic sequence.
TKALKTVRDVLELLRKILEEVRRLNEKLLEELKRLLDEVVEKNERLIKLLEKDAE

SEQ ID NO: 12950 - protein, 57 aa, Artificial Sequence
  Synthetic sequence.
DELETLEDVLRKIEDLLRRWLEKLEETLKRIIRLLETSLKLLEESIRRILRILERDV

SEQ ID NO: 12951 - protein, 58 aa, Artificial Sequence
  Synthetic sequence.
KKVRDVLREIEELLERHKRLLEKLARELRELAKRHREEIKKVLETLKKLAEELTRRVR

SEQ ID NO: 12952 - protein, 60 aa, Artificial Sequence
  Synthetic sequence.
SEKEELRRELEEHAKRSRDTVKRLEDENRRVLESLKRKVDTLRRINEETLREIRRLAREE

SEQ ID NO: 12953 - protein, 55 aa, Artificial Sequence
  Synthetic sequence.
EKLKRDLEDLKRKHDELRKRLKEELDELRRKHEKIKEELDRHLKELEDKLREARR

SEQ ID NO: 12954 - protein, 60 aa, Artificial Sequence
  Synthetic sequence.
SEKEKLTEILRRHERESERVVKELDEENKRHLKKSREIADTLRKLNEETLERIRELVKRA

SEQ ID NO: 12955 - protein, 55 aa, Artificial Sequence
  Synthetic sequence.
ETLKRELERLKEEHERLKEELDRHLKALEEKHREIRREIDEHLKELKRRLDEERR

SEQ ID NO: 12956 - protein, 60 aa, Artificial Sequence
  Synthetic sequence.
SEKEKLIEDLRRILKETEERLKRVKERLRELLDEYRRRSEDKLRELKKELEEEEEKIRRS

SEQ ID NO: 12957 - protein, 62 aa, Artificial Sequence
  Synthetic sequence.
DRLRKRIKETADRLREMLKRHRELLERSMELLRRALEEAKKVLDETEETARRLLKLAEDEER

SEQ ID NO: 12958 - protein, 60 aa, Artificial Sequence
  Synthetic sequence.
KEIEETLKELEDLNREMVETNRRVLEETRRLNKETVDRVKATLDELRKMLKKLVDDVRKE

SEQ ID NO: 12959 - protein, 55 aa, Artificial Sequence
  Synthetic sequence.
KKVEELEKALEEIKRRLKEVIDRYEDELRKLRKEYKEKIDKYERKLEEIERRERT

SEQ ID NO: 12960 - protein, 57 aa, Artificial Sequence
  Synthetic sequence.
SEEEDREREYEERHKKAEEDLRRAEEEYARELRREEERLKEEAKRLEKELRDARTKL

SEQ ID NO: 12961 - protein, 59 aa, Artificial Sequence
  Synthetic sequence.
EKAKKALDEAVKRVKEDIKRLEDSVKTADDKDRKAIRRAEETVRTHIRTNEEAVRREEK

SEQ ID NO: 12962 - protein, 56 aa, Artificial Sequence
  Synthetic sequence.
SELEETLKRLKETNKRLLKKVKELVDESLRLNEELLRRLREVIRKIKETIKEVLEE

SEQ ID NO: 12963 - protein, 55 aa, Artificial Sequence
  Synthetic sequence.
ERVDELRKRIRKTEEEIEDIKRRYEKRVRELKETLDRIVKELRDRYKKIREEIDT

SEQ ID NO: 12964 - protein, 59 aa, Artificial Sequence
  Synthetic sequence.
DIEDVLKKVLEKNLRVLREVHEVNKRVLDEIVKLLRELHRVNKRVLEIILRLLEALRRG

SEQ ID NO: 12965 - protein, 56 aa, Artificial Sequence
  Synthetic sequence.
DEDLKRIEDELRRTLEEHRKRLREVERELEKKVEEHERELRKYEEETKRLLREAER

SEQ ID NO: 12966 - protein, 61 aa, Artificial Sequence
  Synthetic sequence.
REEERLRELITDYKRKLDDLKRRSEDLLREYEKTLEDIRRESERTKKELRESLKRDLDREG

SEQ ID NO: 12967 - protein, 55 aa, Artificial Sequence
  Synthetic sequence.
EKVKRELEKHTKLLKEILDTVRDLNRKHSEEIRRTVEEVRKANRRLLEELKETRK

SEQ ID NO: 12968 - protein, 60 aa, Artificial Sequence
  Synthetic sequence.
SELEETLKKIKELAEISRKLADETRREIKKLIDDSRKLLEDTHRTNEEMVRRVETKAKDK

SEQ ID NO: 12969 - protein, 59 aa, Artificial Sequence
  Synthetic sequence.
EEKLREVRELLERYREDVRRLKKEYEELLREEDKKVKKKKEDYERILRKTKKELDERRK

SEQ ID NO: 12970 - protein, 59 aa, Artificial Sequence
  Synthetic sequence.
SEDEKAAEDLKKLAEESIRELEKALRDAARLHEEALKRLKKALDEAARLAERAIEEARK

SEQ ID NO: 12971 - protein, 55 aa, Artificial Sequence
  Synthetic sequence.
EELIKLIEDLLRLAAELAKKIAELAERHLRLLEEAARKHIELVERLIELAKRDTD

SEQ ID NO: 12972 - protein, 60 aa, Artificial Sequence
  Synthetic sequence.
SEDEELEKLLEEAKKLIEESSRRLDELLEEDRRVVKRIEEEVEKLLKEVKEEIDKIKKEV

SEQ ID NO: 12973 - protein, 54 aa, Artificial Sequence
  Synthetic sequence.
KVLEIVKEIIDRIRKLLKKTFDISDELLRKWEDLLRRNNDLSRRLLKEAEDKAR

SEQ ID NO: 12974 - protein, 60 aa, Artificial Sequence
  Synthetic sequence.
SEKEDLARKLRKLVEELTREYEELVKKLERLIEEIEKVSEESVRKLEKLLREISEEVRKL

SEQ ID NO: 12975 - protein, 59 aa, Artificial Sequence
  Synthetic sequence.
DELLRKLVELLVEVLRRLIRVNRELVKLLREVLERLLRILRESVKKLKRLIEKVIKDET

SEQ ID NO: 12976 - protein, 57 aa, Artificial Sequence
  Synthetic sequence.
KEEEDLLERVKRVLDELIEIVDRNHELNRRVVETSARLVERLLEEVERALETLEREI

SEQ ID NO: 12977 - protein, 59 aa, Artificial Sequence
  Synthetic sequence.
SRLVKKLDEIVKEVAKKLEDVVRRNEELWRKLVELNKESVRRLREIVERVARDLEETAR

SEQ ID NO: 12978 - protein, 59 aa, Artificial Sequence
  Synthetic sequence.
RRTEEVIKKIAKLIDELIETLKKIVEDSAKLIKELIDLLEEIIKRSADLIRELEKVSKR

SEQ ID NO: 12979 - protein, 56 aa, Artificial Sequence
  Synthetic sequence.
ERRIAERIRELLRESKKLVRDVVEEAKRLLKENRDSTRKIIEDIRRLLRKIEDSTR

SEQ ID NO: 12980 - protein, 59 aa, Artificial Sequence
  Synthetic sequence.
DKEDIIRRLARVLERHDEANREVVKEHDEVLEEHLDVHRRVVRSNIEVLRTLLELVEKL

SEQ ID NO: 12981 - protein, 56 aa, Artificial Sequence
  Synthetic sequence.
EKDIRKVIEDIERLHRESMEEVRKLVEEIKRLNKEVLKRSEELVEEAKRLLKEVAD

SEQ ID NO: 12982 - protein, 59 aa, Artificial Sequence
  Synthetic sequence.
DTKEVIEKLIRVLERAVKLLRELVDRDNRSLKKAVDLHREVVRKIIEVLEEAVRLLATV

SEQ ID NO: 12983 - protein, 60 aa, Artificial Sequence
  Synthetic sequence.
EEKLLREVERLVRELAKRLRESLKTVEDLVRELADTNRRSVKTVEDIVRDLERKAREVTR

SEQ ID NO: 12984 - protein, 60 aa, Artificial Sequence
  Synthetic sequence.
SKRELLERVIREAERVLKEWEDLLRELTETSDRVIRDVERLLRELLRKAEEVIKDILRKS

SEQ ID NO: 12985 - protein, 59 aa, Artificial Sequence
  Synthetic sequence.
EDLKRVLERLTRVAEEILELLEEVLKKSNRSLEKAVEANAEALDRLIEVLRELLDDLRK

SEQ ID NO: 12986 - protein, 60 aa, Artificial Sequence
  Synthetic sequence.
SKEELLKKVEDEARKVLEEWKEEVKRLIEESKRVLDDWRRLVDEVSKDIKRVIDEARKDS

SEQ ID NO: 12987 - protein, 59 aa, Artificial Sequence
  Synthetic sequence.
EDLKRVLEKLIKVIEKIVRLNEEALRKSNESLERIVKLNEEALRELIRVIERLVELVRK

SEQ ID NO: 12988 - protein, 55 aa, Artificial Sequence
  Synthetic sequence.
KEREEIDELVKELEKELRRLVRENEKLVEDNERTLKRLLEENKRLVEELVKRLRD

SEQ ID NO: 12989 - protein, 57 aa, Artificial Sequence
  Synthetic sequence.
KDEVVEIVIRVLEEILRLSEEALRIHIRVTREVLRLSKELIDEIRKVLREIADRIRK

SEQ ID NO: 12990 - protein, 59 aa, Artificial Sequence
  Synthetic sequence.
SKEELLKELLDRVRRVLTEIKKLLERLLRRSKEVIDDSERLVREVLKRVEDLAREIKAE

SEQ ID NO: 12991 - protein, 59 aa, Artificial Sequence
  Synthetic sequence.
KDALDKLRRLIDELARLLREVHERDKELIRDHLREVEEIAKEIARLIKRLAEEIREITT

SEQ ID NO: 12992 - protein, 60 aa, Artificial Sequence
  Synthetic sequence.
SERELAKRALERAKEAAEESKRLAKELLDRSRELAKRSKELADEVLKRAKKAAEEIKKKR

SEQ ID NO: 12993 - protein, 59 aa, Artificial Sequence
  Synthetic sequence.
KDAAREARKLLKDLLELAERAHKKDRDAIEEHLRLAEEASKRDKELLKELLDLIREIAR

SEQ ID NO: 12994 - protein, 56 aa, Artificial Sequence
  Synthetic sequence.
SKEEEVEKVLRKWEEILRRLIEENKRANDKIRREYEELVKEIRRVLEEIKEVAERL

SEQ ID NO: 12995 - protein, 56 aa, Artificial Sequence
  Synthetic sequence.
KDVVRKLIEVIERLLRVAEEVIRRILKVNTELMRVDERSIRESLKAIREVLKVLDT

SEQ ID NO: 12996 - protein, 60 aa, Artificial Sequence
  Synthetic sequence.
SKEELVDTVKKKLEEVLKKIDKLSRDVKEKLRRVIEELRKLSREVHETNREVARRLREEA

SEQ ID NO: 12997 - protein, 60 aa, Artificial Sequence
  Synthetic sequence.
EETVLRTLEKIIRDHNKAHKRVTDAVAKILEELIKLHDEVSRRLKDILRRLLELLDEVTR

SEQ ID NO: 12998 - protein, 60 aa, Artificial Sequence
  Synthetic sequence.
RKEELVDTVKKDLERVIETVRKLSEDVKEKIRRVLEDIDRLSKEVHETNKRVVEELEDKK

SEQ ID NO: 12999 - protein, 60 aa, Artificial Sequence
  Synthetic sequence.
EETVLRELVKLIRDHNRMHEEVVRRLKKIIEEALKLHDEVSRRVAELLREVIELLDRVAK

SEQ ID NO: 13000 - protein, 60 aa, Artificial Sequence
  Synthetic sequence.
DKEREVDEILRRVTKLLKELEKRSKEILDRVRELVREYKRKVEEILKRVEDLIRRLIKDK

SEQ ID NO: 13001 - protein, 55 aa, Artificial Sequence
  Synthetic sequence.
DELRKILKELEELLRTLNKELKEVVKELRELLKELHDRLREILEELKRLLEEIAR

SEQ ID NO: 13002 - protein, 60 aa, Artificial Sequence
  Synthetic sequence.
DEDELIRKLLEDLKDIVRKILELIERDLRDIERVVRRIVKVIRDDLKKIKEVVDDIRRRV

SEQ ID NO: 13003 - protein, 59 aa, Artificial Sequence
  Synthetic sequence.
SELADRIRKLIEDLERHTKKVLEDVKRAITELRKNSKDILEEVRKLIDELRKRIKEVED

SEQ ID NO: 13004 - protein, 56 aa, Artificial Sequence
  Synthetic sequence.
KAEEIAKIAVDAVRKIAELLRRASKINLDAIRKAAKLSKEASKINLDAIRKIAEEV

SEQ ID NO: 13005 - protein, 56 aa, Artificial Sequence
  Synthetic sequence.
RKALEKARKLAEDALRANKRANDEAKKLADEALKENRKALEDAKRLARKAAEDAKR

SEQ ID NO: 13006 - protein, 59 aa, Artificial Sequence
  Synthetic sequence.
SEEELLRRIRELLKKALEDNKDVLREIEELLRKVTEDNDRVLEEIRKLLEEVDEVVKRA

SEQ ID NO: 13007 - protein, 59 aa, Artificial Sequence
  Synthetic sequence.
DELRRVVEKIEKVLRDVVRALRELVRINARVLEEILRLIEELVRRNAEVLKRILELVAT

SEQ ID NO: 13008 - protein, 61 aa, Artificial Sequence
  Synthetic sequence.
SKEDELRKAEEDARRVVEEILDLNRESVEKSRRVAERVLRLNEDSVRKSRDVVRRIKEEVN

SEQ ID NO: 13009 - protein, 54 aa, Artificial Sequence
  Synthetic sequence.
VVRKLIEANEDHLRVNKEIVDRLIKANEEHLEVNRRAVEKLIEVLKRLLDVARK

SEQ ID NO: 13010 - protein, 60 aa, Artificial Sequence
  Synthetic sequence.
SEKEDLVRTIEEVVKTIEELVERHERKIDEIVKRSRELVRTHVEKIEEIVRRVEELVRRG

SEQ ID NO: 13011 - protein, 57 aa, Artificial Sequence
  Synthetic sequence.
LDTLAEEVKRVLKEHVDLVRKAARLDSETLKKHVDLVRTAAERVSEVMKELVELVRR

SEQ ID NO: 13012 - protein, 60 aa, Artificial Sequence
  Synthetic sequence.
SEIEELVKDIERIVREIKKLIDDHVRKLEKIIEDIERDMRRHEETVREVVRKIEDEVRRG

SEQ ID NO: 13013 - protein, 57 aa, Artificial Sequence
  Synthetic sequence.
LDSLAKKVSDVARKHLDLARRVIKLISEALKKHIRLVEKAMEDISRILEDLVRLVRK

SEQ ID NO: 13014 - protein, 60 aa, Artificial Sequence
  Synthetic sequence.
SKLEDAVRRIEEILRHIVRSLEEVVKDIEKILRDHVRMLREVVKRIEDVLRRVVELLRRA

SEQ ID NO: 13015 - protein, 56 aa, Artificial Sequence
  Synthetic sequence.
KDVLREVAERIRKVIERLKELLDRSRERAEDVIKKLRDLLKENERLIEEVRRRLEK

SEQ ID NO: 13016 - protein, 57 aa, Artificial Sequence
  Synthetic sequence.
SREEAVADVIRRLEEILEKNLRLLEEIIRRLLRILEHNLRLNEKAVEIIEDLIRKLL

SEQ ID NO: 13017 - protein, 56 aa, Artificial Sequence
  Synthetic sequence.
SRLADDLRRVVKKIVEDLEENLERIKDIIRRLVEELERSLEEIRRLIDRLVKEIRR

SEQ ID NO: 13018 - protein, 58 aa, Artificial Sequence
  Synthetic sequence.
SEEEAAREAERLLEEAARVAERIVRDSERLLDEAAEVARKAVEDSKKLLEDALRAARE

SEQ ID NO: 13019 - protein, 56 aa, Artificial Sequence
  Synthetic sequence.
REAAERVARRAERANEEALKEAEEVIKRAKEANKRALEEAKRVIDRADKALKEARK

SEQ ID NO: 13020 - protein, 59 aa, Artificial Sequence
  Synthetic sequence.
RDRDVLRKVKREIEELVRRIEKVSRDALKEVKRLLDENRKIAEDVLRLIERLLRKIRDT

SEQ ID NO: 13021 - protein, 59 aa, Artificial Sequence
  Synthetic sequence.
EEVVEELLRMLKRVAEEMKRVHDDLSRAVEKVVRDVVRVDKELLDELRRILRRLEEVIT

SEQ ID NO: 13022 - protein, 56 aa, Artificial Sequence
  Synthetic sequence.
SKDEELMRLLEELVERWRKIVEDLERDHRRLVKEIRELVERIRKKLEELVDRIRKN

SEQ ID NO: 13023 - protein, 58 aa, Artificial Sequence
  Synthetic sequence.
EEIRRILEELKRIVDDVLRIIARILKLLRDLTRRLAEVAKKVHKLLEELLRKLKEDTR

SEQ ID NO: 13024 - protein, 56 aa, Artificial Sequence
  Synthetic sequence.
KDAETLEKVLRDVLERADEIIKRLEDIYREIKKRLEAIIKEAEDINRKILEEIRRL

SEQ ID NO: 13025 - protein, 56 aa, Artificial Sequence
  Synthetic sequence.
VKRALEELKDLIDRNLKVLKDLLDATRKLIEENIRVLREILKRIKDIARELLEATK

SEQ ID NO: 13026 - protein, 61 aa, Artificial Sequence
  Synthetic sequence.
SSKEEVLELIKELVRSSKEVLERVVRLNEKSLRISVEVLDRIVELIEEIVRIVVRELEKKV

SEQ ID NO: 13027 - protein, 55 aa, Artificial Sequence
  Synthetic sequence.
RELLKEIKRIIEEIDRLVKESLKRHKDINDEIRELAKRTLDEIKEVIDRIRERLR

SEQ ID NO: 13028 - protein, 60 aa, Artificial Sequence
  Synthetic sequence.
SEEEDVIRDVKRRLEEILKTNADVIRDIEEILKEVKERNKRVVEELKDILRKVLEELRKK

SEQ ID NO: 13029 - protein, 55 aa, Artificial Sequence
  Synthetic sequence.
KEVVDLIREIVERLARAVEESLKLLKEIIDLLTESSKELVKLLEEILRTLKEAAR

SEQ ID NO: 13030 - protein, 56 aa, Artificial Sequence
  Synthetic sequence.
SDEERLEKVVKDVIEKVRRILEKWKKDIDKVVKELRRILEEWEKIIREVLDKVRRL

SEQ ID NO: 13031 - protein, 56 aa, Artificial Sequence
  Synthetic sequence.
ERLLKRVVDILKRLLELNATTIERLLRILEELLKLNKELAERVIRVLEKLLEEIKR

SEQ ID NO: 13032 - protein, 60 aa, Artificial Sequence
  Synthetic sequence.
KDMERVLTEHKKAVKELIELLERLLEEHERASRELIKLLRELLERHKRATDELIKLLREN

SEQ ID NO: 13033 - protein, 56 aa, Artificial Sequence
  Synthetic sequence.
VEEVVKRLEDVNRTLEEIIRKVEEEAKRVNEDLRKRIEDVVRTLEEVNKRLKEITK

SEQ ID NO: 13034 - protein, 56 aa, Artificial Sequence
  Synthetic sequence.
SELEEVAELLKRSKELIDEVEERIRRLATESLRFLDEVVRRIRELLTRLLKEVRDS

SEQ ID NO: 13035 - protein, 55 aa, Artificial Sequence
  Synthetic sequence.
ERLLKKTEDVVREILRLIEEVLRTHAEIIREILELIERLLELHKTLVDRLLERIE

SEQ ID NO: 13036 - protein, 56 aa, Artificial Sequence
  Synthetic sequence.
SVLETVKRLAEESSERIRKIVEDDKRVADDSSRKIKELIEEIKRRVKELLDRIKDL

SEQ ID NO: 13037 - protein, 56 aa, Artificial Sequence
  Synthetic sequence.
KEVVIRLIEELVKLLEDVLRRLLEVNETLVELNKRVWDRLVRINEELAEVALRVAT

SEQ ID NO: 13038 - protein, 56 aa, Artificial Sequence
  Synthetic sequence.
SVLETVKKLLEDSSEKIERIVEEDERVAKESSDRIRRLVEEDKRVADEILDLIEKI

SEQ ID NO: 13039 - protein, 56 aa, Artificial Sequence
  Synthetic sequence.
KDAVIKVIEKLIRANKRVWDALLKINEDLVRVNKTVWKELLRVNEKLARDLERVVK

SEQ ID NO: 13040 - protein, 59 aa, Artificial Sequence
  Synthetic sequence.
SIRELLKELEDVVREIIRDIRRLLEESRRVVERIERETKRLLDEIRDVARRIEETIRRL

SEQ ID NO: 13041 - protein, 59 aa, Artificial Sequence
  Synthetic sequence.
KEAVDELRRLLEELKKIVEDILRTLEKLNRELLEIDKRVADRLRELLRTLKKLIEEAAT

SEQ ID NO: 13042 - protein, 57 aa, Artificial Sequence
  Synthetic sequence.
SKEEAIKELLKKHKRITEDIIRMARELDREHEEITREIAERLRRLLKKLLDDVRREV

SEQ ID NO: 13043 - protein, 55 aa, Artificial Sequence
  Synthetic sequence.
ERAKRVLDKILDDVRRLVEEAAKLLDESVKKSTDIVRRVRKLLDDSLKEVAELAK

SEQ ID NO: 13044 - protein, 57 aa, Artificial Sequence
  Synthetic sequence.
KKEDDVRRLLKEHEDITREIIKLIRDLARKHLELNKRVIRALEKVLKDLEDEVRKDV

SEQ ID NO: 13045 - protein, 55 aa, Artificial Sequence
  Synthetic sequence.
ERVRRVLDRVVERVAELVREWKELLKRSLDEVREVVKRARDMLRRSVKTVKELVD

SEQ ID NO: 13046 - protein, 58 aa, Artificial Sequence
  Synthetic sequence.
DEVEDARKKLEDLERENRKVIKEIEDALRELVKDHDRVVEELRRRLRRLLEELKKLVD

SEQ ID NO: 13047 - protein, 60 aa, Artificial Sequence
  Synthetic sequence.
DEEMLKRVVDVLEDLVRTIEKVLRELSETLRELVRRLLELLRENNESVRRLIRILEEALR

SEQ ID NO: 13048 - protein, 60 aa, Artificial Sequence
  Synthetic sequence.
SEDEAAERLLREAKKILKRLEDAARESLKSAERILEELEKAARDSLRKAEKIIRDAKRKG

SEQ ID NO: 13049 - protein, 55 aa, Artificial Sequence
  Synthetic sequence.
KEAEKLATKLVEDSERAAREAKKLADENVKRSKEAAEEAKRLADRLVKEAEDDAR

SEQ ID NO: 13050 - protein, 59 aa, Artificial Sequence
  Synthetic sequence.
SEDEELLKRLDELLKEILKVIEELIRRLEKAHKENMDKIRDSARRLRELLRKLAEDERE

SEQ ID NO: 13051 - protein, 56 aa, Artificial Sequence
  Synthetic sequence.
EELVKEILERVDRLLRKSLERLREVLEESRRRLEEVLRALEEVIKRVRDLLRKLRE

SEQ ID NO: 13052 - protein, 57 aa, Artificial Sequence
  Synthetic sequence.
RKKEELARVLEESLEVNRKLVRDLAEVLRKDLEIIRELVKRLVEILKKILKVLADVI

SEQ ID NO: 13053 - protein, 59 aa, Artificial Sequence
  Synthetic sequence.
EETLRKVVEDLERLLREARRVVKEAVEKSRRSLEDLRRIIEEAIRRNEKILRKLKEIVK

SEQ ID NO: 13054 - protein, 59 aa, Artificial Sequence
  Synthetic sequence.
KEDELLRRIKEVIDKTLEDMKRLLKKHKELLDEILRLLAELVEENKKLIDEILKLVEDS

SEQ ID NO: 13055 - protein, 59 aa, Artificial Sequence
  Synthetic sequence.
EEAKELVRRLKRAVEESKKKLDELVKDVKRLADDSARDLRELVKRIAELVKKIRDELRD

SEQ ID NO: 13056 - protein, 63 aa, Artificial Sequence
  Synthetic sequence.
DAEEALKRAREVLKEAADLNRKAVEDARKILKDAADDNKRALEEAERVLRKALEDAKDARARN

SEQ ID NO: 13057 - protein, 56 aa, Artificial Sequence
  Synthetic sequence.
AEKAAEDAKRLLEEAEEASKKLIKAAEELLRELAKASKRALDEARKLIEEAEKAAR

SEQ ID NO: 13058 - protein, 61 aa, Artificial Sequence
  Synthetic sequence.
SEREDLLRLIEEVIRELIKLLETNLRLNEETIRTLIRLIKKDLDLNRRSVEELVKLLKERV

SEQ ID NO: 13059 - protein, 59 aa, Artificial Sequence
  Synthetic sequence.
SEAADEVRKKLAEDERLNDKSLEELKRILDKDREINRRVAEKLTRILETLRKIIEDVAR

SEQ ID NO: 13060 - protein, 58 aa, Artificial Sequence
  Synthetic sequence.
DDLERVLDELRRIIEEIKRRIDKILEDYERVLRDAKRLIDDVLREYRRIIEELKDLLD

SEQ ID NO: 13061 - protein, 59 aa, Artificial Sequence
  Synthetic sequence.
KDVLERIKRLLDELRRANEEVVRRVKKILDESLKENRDVVRELKKILDELLEIVAEAAR

SEQ ID NO: 13062 - protein, 57 aa, Artificial Sequence
  Synthetic sequence.
SKKERLKKLIKEHLDLLRRLLKELEDLIRKHLELLRRLLRRLKELLRELLKLIEELV

SEQ ID NO: 13063 - protein, 54 aa, Artificial Sequence
  Synthetic sequence.
RVEKEVRRALEKVERLIREIKRLVERSLEEVEKLIREIKKRVRDSLRKVKKESE

SEQ ID NO: 13064 - protein, 60 aa, Artificial Sequence
  Synthetic sequence.
DEIETVLKRLAELIKESLDLLRETLDELRKIIEESKKSLEDVLRRLKELIDRLRRLAEEK

SEQ ID NO: 13065 - protein, 60 aa, Artificial Sequence
  Synthetic sequence.
KDELLRRVEEILKRLLELIRRIIEEHRKILERLLETHEDLIRKHEEILRRLLKAADEERQ

SEQ ID NO: 13066 - protein, 60 aa, Artificial Sequence
  Synthetic sequence.
SEKEDVLRRVEEIARRVRDILRRNLEKVERIAEELKKINDDLLKEIERIIKELKEVLRDV

SEQ ID NO: 13067 - protein, 56 aa, Artificial Sequence
  Synthetic sequence.
IEEVLEILDRILKTARDVSKENLESLKRALELDRRTNERLEDLLREILELLRKDIQ

SEQ ID NO: 13068 - protein, 60 aa, Artificial Sequence
  Synthetic sequence.
SELEELRKLAEEAIEAAKRALDRLHKLSRELIEAAKEILKRLKKLSEDLIRAAEEAARRS

SEQ ID NO: 13069 - protein, 58 aa, Artificial Sequence
  Synthetic sequence.
EDAKRAKEIAKEAIERSKKIADEAREIAKRAIDKSKKIAEEAKKIADEVLKRAEDIAR

SEQ ID NO: 13070 - protein, 61 aa, Artificial Sequence
  Synthetic sequence.
RESEELIRLLRKIIELLEELVERIRDLLRKHLKLLEEVVELLKRNLDEILRLLEEVLREAN

SEQ ID NO: 13071 - protein, 58 aa, Artificial Sequence
  Synthetic sequence.
EKAKKLEELLRDLLRTVREIVKEVRELLEESLRTAEKLVEDIKRELDELRKRLKELVD

SEQ ID NO: 13072 - protein, 58 aa, Artificial Sequence
  Synthetic sequence.
DEERLVEEIIRTIKRVIELNEESLREIERVLEEVIKMDKRSLEEIKRVLDEILKLARD

SEQ ID NO: 13073 - protein, 60 aa, Artificial Sequence
  Synthetic sequence.
GEELERVLRELKKVLEELIKDNERVNDELRRVLEKLKERNRKVLEDIKRVLEELRDEVER

SEQ ID NO: 13074 - protein, 58 aa, Artificial Sequence
  Synthetic sequence.
SSEEIIRTLEKAIRESEEKLERLVRRDEEVVKDLRTKLRENLDRVRRMVEELVRMLES

SEQ ID NO: 13075 - protein, 60 aa, Artificial Sequence
  Synthetic sequence.
KDTLVKVLKEVLERHVEADEKAVRELAKVLEENVRLLEELVRVNKEVLRRILELVKELAK

SEQ ID NO: 13076 - protein, 57 aa, Artificial Sequence
  Synthetic sequence.
SKEEKLKDDVRRVLEDLDRVLKELEKLSEDNLRELKRVLDRITDLHRRILDELRKKI

SEQ ID NO: 13077 - protein, 59 aa, Artificial Sequence
  Synthetic sequence.
SKVAEDILRVLEKLVKVSREAIKLILELSEHHVRVSTRIARLLLDVARKLFEVIKEAER

SEQ ID NO: 13078 - protein, 57 aa, Artificial Sequence
  Synthetic sequence.
KKEDELEKMVRDVLEDLDRILREAEELSRKNNDDLRRVLDRLRRLAEEVIKRLEEKV

SEQ ID NO: 13079 - protein, 59 aa, Artificial Sequence
  Synthetic sequence.
SEVARVILEILKRLLKALKEAAEELKKISEHHLRVSEKVVRDLDRVVKKIVDVARRVAT

SEQ ID NO: 13080 - protein, 57 aa, Artificial Sequence
  Synthetic sequence.
SEKEKLLRDLEEVVRDVIRLSKESVDKLKETVDRLVEESRRTVEELRRIVDRVAKEV

SEQ ID NO: 13081 - protein, 58 aa, Artificial Sequence
  Synthetic sequence.
EIVKLLEDVVRELVEVLRKSTEVIERAVKKLVDILRESLKLIEDVVRRLVEIMEEIVR

SEQ ID NO: 13082 - protein, 61 aa, Artificial Sequence
  Synthetic sequence.
SEIEDVIRRLRKILEDLERVSEKLLREIKKILDEARRLNEEVIKEIKRVLEDAVRVFRDIR

SEQ ID NO: 13083 - protein, 56 aa, Artificial Sequence
  Synthetic sequence.
IEDLVREVERLIKRIEDSLRELEKTVRELLKRIKEASDKVREDVDRLIKELKEAAD

SEQ ID NO: 13084 - protein, 60 aa, Artificial Sequence
  Synthetic sequence.
SREEIVATLEDLARKILEVVKKLAKEIEDAWREIERKVREILKRLEELWREIEDVVRKKV

SEQ ID NO: 13085 - protein, 59 aa, Artificial Sequence
  Synthetic sequence.
RELVKELVELLEEILERNTRVIKEIIDLLRTVIRIHEKIVEDLIKLLEELLRRLEEATR

SEQ ID NO: 13086 - protein, 58 aa, Artificial Sequence
  Synthetic sequence.
KEKEDALKKLEDLARKSREDLERVLRKHKKILDKIEELLKRVLDEHKKIVDDILRKTG

SEQ ID NO: 13087 - protein, 59 aa, Artificial Sequence
  Synthetic sequence.
EELAREVERVIKELLDKSKEILERIERAIDELLKVSEEILKLSEDASEELLKILREFAK

SEQ ID NO: 13088 - protein, 58 aa, Artificial Sequence
  Synthetic sequence.
DEKEEALKTVERIIRDIVRRLRELLKEHEDIVREIERELKEVHEKHKRLVEKALEELG

SEQ ID NO: 13089 - protein, 59 aa, Artificial Sequence
  Synthetic sequence.
DRLADLIRRAVDRLRDISREILKRLVEVIERLLEVSEKILKLVEEVIRELLRVVEEAAK

SEQ ID NO: 13090 - protein, 59 aa, Artificial Sequence
  Synthetic sequence.
SVVEILAEVLKRLLDILRKLVDAIRDVVKKHVEVVEKLVRLHEEVLRRLVDILRKIAEV

SEQ ID NO: 13091 - protein, 60 aa, Artificial Sequence
  Synthetic sequence.
EEILRRLVEEAKRLVAESIKKLRDLVRKIREAHKEAIKRLEEIVRKVEEIVRKVIDELRK

SEQ ID NO: 13092 - protein, 62 aa, Artificial Sequence
  Synthetic sequence.
SDEEKLRRLLEEVRRLAKRVIDELERVLRESKRLAEENIEELDKALEEVKRLIDDVIKKLRD

SEQ ID NO: 13093 - protein, 60 aa, Artificial Sequence
  Synthetic sequence.
SETIERLLRELLKVLKEIVDRHRRIIERLLKASEDAVRELKKLIEETLRVLTDVVRRTET

SEQ ID NO: 13094 - protein, 56 aa, Artificial Sequence
  Synthetic sequence.
SLVDELRKSLERNVRVSEEVARRLKEALKRWVDVVRKVVEDLIRLNEDVVRVVEKV

SEQ ID NO: 13095 - protein, 56 aa, Artificial Sequence
  Synthetic sequence.
DEELKRVLEKAADLHRRLKDRHRKLLEDLERIIRELKKKLDEVVEENKRSVDELKR

SEQ ID NO: 13096 - protein, 55 aa, Artificial Sequence
  Synthetic sequence.
SKEERLREVAEKHKKDLEDIVKRVDEAAKETKRRLEEILKRLEEVLKKILDDLEK

SEQ ID NO: 13097 - protein, 55 aa, Artificial Sequence
  Synthetic sequence.
KEVLDILERAVEVVRRVIKALKEVLERHVDATREVIERVKRVNKRLLEAVREVVT

SEQ ID NO: 13098 - protein, 56 aa, Artificial Sequence
  Synthetic sequence.
SREEKLEELIKELERRLKDVLDRSRELNREIRKTTEEVIREVDRLLREIEKIVRDV

SEQ ID NO: 13099 - protein, 59 aa, Artificial Sequence
  Synthetic sequence.
EDTARLVREVAELIEKVVREIVKLIDEDLKKLERVVRENARLLREVVELLLKVVRDVAK

SEQ ID NO: 13100 - protein, 62 aa, Artificial Sequence
  Synthetic sequence.
DEKELLEEIIKKVEDLLRESRELWERLIKRVKELLKRSKETVDEILKRIKELLDELRKVAAE

SEQ ID NO: 13101 - protein, 60 aa, Artificial Sequence
  Synthetic sequence.
DKRLLDVIKEIVEKLIEVVRKLLEADKRIIEELIRVLEKIAEVDETIVKRLIEVLKKIAD

SEQ ID NO: 13102 - protein, 61 aa, Artificial Sequence
  Synthetic sequence.
SEEEDIERVLRELKKLHKDHLDLLREVVKRAEELLRRHLEILREVLKREKKLLKDVLRDAR

SEQ ID NO: 13103 - protein, 55 aa, Artificial Sequence
  Synthetic sequence.
DELLEEAKKLVKEVRELAEETLRRLARLVEDVKRLNDEAVKRLRELVRRIKEEVR

SEQ ID NO: 13104 - protein, 59 aa, Artificial Sequence
  Synthetic sequence.
RTEEILREIVDLLRRVAEENLRTLEELVELLDRVARRNLESLRELVRILEEVLKKLLKK

SEQ ID NO: 13105 - protein, 56 aa, Artificial Sequence
  Synthetic sequence.
EDVLRELDEVVRRVIERDREILRELKRLVEEVIRKNEDIVRKLEEAVERVLRKLKD

SEQ ID NO: 13106 - protein, 59 aa, Artificial Sequence
  Synthetic sequence.
SEKEEVIKDLRKVLEEVLRRHEELVERLKEVLRKVLEDHKKLVEDLKRVLDEVRRKLEN

SEQ ID NO: 13107 - protein, 57 aa, Artificial Sequence
  Synthetic sequence.
REELLRRLERIVEDIIRLLEESLKLAAEVIKTIIRLLEESLERLKRLVDDIVEKLRK

SEQ ID NO: 13108 - protein, 60 aa, Artificial Sequence
  Synthetic sequence.
SEKELLERLEEVERRLLEIVRRLLKRNRDVHEELLRIVEANLRRNKKVHEDLLEKVRKSV

SEQ ID NO: 13109 - protein, 59 aa, Artificial Sequence
  Synthetic sequence.
DKVVKELEDIVEELMEENKDSLRRLKEIVEELLEENRRVLEKLRKIVEDVARELEETAT

SEQ ID NO: 13110 - protein, 58 aa, Artificial Sequence
  Synthetic sequence.
SIEEVLREIVKLLREVLERLIRVDERLVEALKRVAEKNIEVLRRAVDALRKVLELLRR

SEQ ID NO: 13111 - protein, 57 aa, Artificial Sequence
  Synthetic sequence.
EETVIRRVEDVLRDLLRRLEEVVRRSTEEAKRLLKESRDVVRDVEKTLRELLEELRR

SEQ ID NO: 13112 - protein, 58 aa, Artificial Sequence
  Synthetic sequence.
SVEEVIRKAVTDLDRVLKTNIRVDERLIEMLKRVADENREVLEKIVRLLKEVLDLLRN

SEQ ID NO: 13113 - protein, 57 aa, Artificial Sequence
  Synthetic sequence.
EKEVVDKVKRVLDELRRDLERVVEESEKLARDLLRKSRDVVRRTRELLKKLLEEVET

SEQ ID NO: 13114 - protein, 64 aa, Artificial Sequence
  Synthetic sequence.
SRRETLEKLLKEIEDLIRESLERLEKLLEENRTLIDDDERRVRELARDIKELIKEIEERLRREN

SEQ ID NO: 13115 - protein, 55 aa, Artificial Sequence
  Synthetic sequence.
EEILKIIEELIKRLEKLNEDSNELMKELVKRNERLARENLKLVEELLRRIEETTR

SEQ ID NO: 13116 - protein, 56 aa, Artificial Sequence
  Synthetic sequence.
SEVERLRELVERWREELKKLLDELRKVVEEIARELKKINDELRKLVEDIAREARRE

SEQ ID NO: 13117 - protein, 56 aa, Artificial Sequence
  Synthetic sequence.
ERVIEELIRVLRKVVEDHADVTRRLVEVLRKVVKLIEEVLKKDEKVLRDIVDRLKT

SEQ ID NO: 13118 - protein, 57 aa, Artificial Sequence
  Synthetic sequence.
SEVEEVVRVLEKVLRLLRRLVEELHRLSERVLELITRLLKELKDLSREVIKRLEDAN

SEQ ID NO: 13119 - protein, 59 aa, Artificial Sequence
  Synthetic sequence.
KEKIDELRRVLERVEREHRRVIKKIRDVVEKVKRDHERVLREVEKVVREVRTELEKLRE

SEQ ID NO: 13120 - protein, 61 aa, Artificial Sequence
  Synthetic sequence.
SVEEELRELVKRVEKLVERLRRIVKEIIERSRDLVRKSREVVDRLKKELDELVKEVVREEG

SEQ ID NO: 13121 - protein, 59 aa, Artificial Sequence
  Synthetic sequence.
DEVIRRIAEVVKRLIDKLKELSDDNRKAVEDHERLVRKAIEELVREVEDILRRIDETAR

SEQ ID NO: 13122 - protein, 56 aa, Artificial Sequence
  Synthetic sequence.
SEKELLKEILDRIRELLEDDNRLLKRIVDEIRKLLEEWLRVHKEILERIKELLDRI

SEQ ID NO: 13123 - protein, 62 aa, Artificial Sequence
  Synthetic sequence.
EDMVRKIRKIIEELKRLLEDLRRDTRRVIEEAKRLLKEWRDRNKEVADTLKKLLEDLIRKIR

SEQ ID NO: 13124 - protein, 56 aa, Artificial Sequence
  Synthetic sequence.
REDEIVEDWRRLLEEAKRRSEEVAKEIRDRAREVTKESKRVADEWRRLLEEVKKRA

SEQ ID NO: 13125 - protein, 59 aa, Artificial Sequence
  Synthetic sequence.
EELVRVARDLVRLNEEVLRKSNRSVEELLKALARVLDRSNKSLEDLVELNKRVLDKLRT

SEQ ID NO: 13126 - protein, 59 aa, Artificial Sequence
  Synthetic sequence.
RKEDLVREWRELLRKILEDLEDLVRKWRKLLKKILDDLRELVRRVREELDKALRTVEKG

SEQ ID NO: 13127 - protein, 57 aa, Artificial Sequence
  Synthetic sequence.
LRDLVRKIIEIIEDILRLLEEVLRKNVKAVEEVLRLAIRVLEENIEAVEKVLEDVRR

SEQ ID NO: 13128 - protein, 58 aa, Artificial Sequence
  Synthetic sequence.
SEEELLREIEKILDEVRKLVEKLLEDNRRLADELIKLIKELLDRNLRLIERLLELLER

SEQ ID NO: 13129 - protein, 59 aa, Artificial Sequence
  Synthetic sequence.
EELREVLERALRKAKKIHEDLKRIVEDVRRRNDEILKDLERVLKEVEDKIRKILDELRK

SEQ ID NO: 13130 - protein, 59 aa, Artificial Sequence
  Synthetic sequence.
RDEDIKRELVRLVEEILRTSARLLDESIKSNKKTLDDIERVAREIVREIEELLKRIADG

SEQ ID NO: 13131 - protein, 55 aa, Artificial Sequence
  Synthetic sequence.
DELKKDIRDVLERVKRIAEELRELVERDIREDKRLLDELAKLWRDLLKMIEDLRR

SEQ ID NO: 13132 - protein, 61 aa, Artificial Sequence
  Synthetic sequence.
SEDELLEKIVRKLREAVKRIEEELRKSKREIERLVKEIKEKLEDSLRRVKETLDRIRETRK

SEQ ID NO: 13133 - protein, 56 aa, Artificial Sequence
  Synthetic sequence.
LEELLRLLKEVIERSIESLERLLELILRVLEYSVRSLEELLRRLLEVIKRIVDTTK

SEQ ID NO: 13134 - protein, 59 aa, Artificial Sequence
  Synthetic sequence.
DEDEIAEELKRLLREVEEKSKEIVRRMRELAREANKKSEDILRTLEKLLEELRRRVEEN

SEQ ID NO: 13135 - protein, 56 aa, Artificial Sequence
  Synthetic sequence.
IDEVVRRIERVIREVIKILARANKRLHDVVEEIIRLLEEVTDELRRVVEEVIRRTK

SEQ ID NO: 13136 - protein, 56 aa, Artificial Sequence
  Synthetic sequence.
DKEEEVRRLIEENLKKIEEVIRELEKIIRDNLRKLEEVVREIEEELETTLRLIETD

SEQ ID NO: 13137 - protein, 59 aa, Artificial Sequence
  Synthetic sequence.
EDLLRKLKELLETLKRRIDEIEKKLEEILKETKDLIRRLLEKLKRIDEELRKTLEDLRR

SEQ ID NO: 13138 - protein, 61 aa, Artificial Sequence
  Synthetic sequence.
DDIDEILRRLREEIEDARRKLEKILRELRERIKDYKRKTDELLKESRKRIREAEDRVRRDG

SEQ ID NO: 13139 - protein, 59 aa, Artificial Sequence
  Synthetic sequence.
DKVLEALLEKLLRSNEELVKIDRDLLRDLLRVLEELIKTVRDLLRELLRVLEEVAREIK

SEQ ID NO: 13140 - protein, 60 aa, Artificial Sequence
  Synthetic sequence.
REEETLRDIERLLRKLLEELKRTADELIDSHRKLIKKLKEILDRLRRSHEKLIETLRRRL

SEQ ID NO: 13141 - protein, 59 aa, Artificial Sequence
  Synthetic sequence.
EDVKRELREVVKEHKEDLDRIKKELKELLDRHTETLKRIVKKLRDLLEEIRKALEDLKK

SEQ ID NO: 13142 - protein, 59 aa, Artificial Sequence
  Synthetic sequence.
DEERVVEEAIRVLKEVLDLHRELIKRSIDVLKESLKVHERAVESLERVLKEILDLVRRG

SEQ ID NO: 13143 - protein, 56 aa, Artificial Sequence
  Synthetic sequence.
EEEVAERVKRIIEEVRKLAEDSRRKTEELIRRVKELAERTDETVRRVIEELRRRTK

SEQ ID NO: 13144 - protein, 59 aa, Artificial Sequence
  Synthetic sequence.
DEEDVARKLIEVLKELLKLVEDLIRTNIRVLEESLELHRRLIEEIEKVLKRILELLEEG

SEQ ID NO: 13145 - protein, 56 aa, Artificial Sequence
  Synthetic sequence.
REELAKEVKRVIEELKKLARESAEESKRIIRTIEELLREARKRAREVIEELKERTR

SEQ ID NO: 13146 - protein, 60 aa, Artificial Sequence
  Synthetic sequence.
DAEEVLRLLAEVLERIIELIKKVNEILIRVLREVIRLIEEVNELVREVLKRIIELIRRDI

SEQ ID NO: 13147 - protein, 55 aa, Artificial Sequence
  Synthetic sequence.
ERILEEIERLVREVEEIHERVLRRLKELLKKVREVHEEVLRRIERLAERVREALK

SEQ ID NO: 13148 - protein, 56 aa, Artificial Sequence
  Synthetic sequence.
SVREELEKVIREVIEEVERVLERIRDELRKSLERLKEVIKRIEDVHRDLIRRIREI

SEQ ID NO: 13149 - protein, 56 aa, Artificial Sequence
  Synthetic sequence.
IEEVLKTVEDISRRHRELLKRILDTSKRSIEETLKLAREILETLKRLLKELLDAAK

SEQ ID NO: 13150 - protein, 59 aa, Artificial Sequence
  Synthetic sequence.
DAEDEARRVIDEAVDRLRKAVEEIAEVARRHLEEVEEVVRKLEEIIRESLERVRRASEA

SEQ ID NO: 13151 - protein, 59 aa, Artificial Sequence
  Synthetic sequence.
DKEAEEVVRRVERLHEDVLRRLKEVVKRVKELHEEILDRLREILDRVRELARKVREDLR

SEQ ID NO: 13152 - protein, 56 aa, Artificial Sequence
  Synthetic sequence.
SEKERLSKIAEDLIRRLEEELERVERTHERLLRKLEELLKKIEKEYRDAMRKLETL

SEQ ID NO: 13153 - protein, 57 aa, Artificial Sequence
  Synthetic sequence.
IKEVLDDLKRVLERDLRAIKKIVKELKRILKENLDVLREIVERIKRVLEKILREVEK

SEQ ID NO: 13154 - protein, 60 aa, Artificial Sequence
  Synthetic sequence.
SREERLERVLERVKRAIDRYRDMLRRLLKTVEDLIRKYEEDLKRLLKEAKELIDKVKEEN

SEQ ID NO: 13155 - protein, 59 aa, Artificial Sequence
  Synthetic sequence.
EEIKKIIDRLREEIERILDELRRLNEELVETLRRVLETLRELNERLVKLLRDLLREEKK

SEQ ID NO: 13156 - protein, 60 aa, Artificial Sequence
  Synthetic sequence.
DEEEKMKKIEDVARRYKEEVKRVLDDLERLLRESEEEVERIVRKLEKLARDLEERVRELT

SEQ ID NO: 13157 - protein, 59 aa, Artificial Sequence
  Synthetic sequence.
KEVIDALKELLKVLEDLLREIKEALTRNLEKIDELLKLLHELSRRVIEELRKLLEDLKR

SEQ ID NO: 13158 - protein, 57 aa, Artificial Sequence
  Synthetic sequence.
REDEELARKAKEVLKETEDLLRKLEEEVKRVLEEIKRMNREVREKVKEVIKELRKRL

SEQ ID NO: 13159 - protein, 59 aa, Artificial Sequence
  Synthetic sequence.
KRLLDLLRDLLRLLKELLETLEKLNERTLKLLRDLLRKLKEALRRNLKLLRELVDEAAT

SEQ ID NO: 13160 - protein, 60 aa, Artificial Sequence
  Synthetic sequence.
SKDEIIKRIKDELEKLVRDVERLLRESERRIADLVRRVREILEESKRRVDELVKRVKETG

SEQ ID NO: 13161 - protein, 56 aa, Artificial Sequence
  Synthetic sequence.
VETILRVATEVVKESATVLKRILETLEEALKRNVRIIEEMLEILREVIERIARKLK

SEQ ID NO: 13162 - protein, 55 aa, Artificial Sequence
  Synthetic sequence.
SEEEILREIKRLLEEHLELNERILREIKKDNKRTLKELRDIVRELKEILERIKRR

SEQ ID NO: 13163 - protein, 55 aa, Artificial Sequence
  Synthetic sequence.
EELRKLLEDARRALERILRRLAKIVKEIKEKHEEVLRRLEKSVREIDERLRRARE

SEQ ID NO: 13164 - protein, 57 aa, Artificial Sequence
  Synthetic sequence.
SELERLERLLKEIVEVNRKALEDLRRVLEETVRRDREVLDRTRRKLEEIAEEILREL

SEQ ID NO: 13165 - protein, 59 aa, Artificial Sequence
  Synthetic sequence.
REDLKRLEDLVKRIEEELRRKLEKYERELRDLKRKLEELLKRYEEKVKELKRKLDEALK

SEQ ID NO: 13166 - protein, 57 aa, Artificial Sequence
  Synthetic sequence.
SEEEILRRIAEEIKRLIDEDLRLIEELVRKIKTVAKRDLELIARLVEKIEEVIRRSI

SEQ ID NO: 13167 - protein, 59 aa, Artificial Sequence
  Synthetic sequence.
EEELKTAEKIIEDIKKEIDDVHREVRRLLEEIKEDIDRVNEEVKKRLEDIIEKIRRAAK

SEQ ID NO: 13168 - protein, 59 aa, Artificial Sequence
  Synthetic sequence.
SIEELAEDIKKILDDALELLERLAKRAKEINDEILDELRKLVEKNKRDLDRALEKLRRE

SEQ ID NO: 13169 - protein, 58 aa, Artificial Sequence
  Synthetic sequence.
ERVRKLIRELEEELKDNRRLIEELVRRARKVNKRLRELVEEVIDRLRELLERIEEKIR

SEQ ID NO: 13170 - protein, 56 aa, Artificial Sequence
  Synthetic sequence.
SKEETLRKEAEDLLRRLEELTRRLEKKARELLERAKKLSRDLAEELKRLLKELREK

SEQ ID NO: 13171 - protein, 59 aa, Artificial Sequence
  Synthetic sequence.
ERLKRLVEELLKAVTDLSRKNKRILEELLKAIETLSDENKKILTEILDALRRLVEKIEK

SEQ ID NO: 13172 - protein, 60 aa, Artificial Sequence
  Synthetic sequence.
DEERKIVETLHRTSREVIKTLEKIVRDLKEVLKKNLELTERLIKRVHEVSREILRLTREN

SEQ ID NO: 13173 - protein, 59 aa, Artificial Sequence
  Synthetic sequence.
DRVKKELEDANREVNKKLEEVLREIRELHKRVLDRLDEVLRRVEEINKRVNERLDRTAK

SEQ ID NO: 13174 - protein, 57 aa, Artificial Sequence
  Synthetic sequence.
SEVEDLKRKLEEDLERHKKDVKRLKDEAERRLEEHKRLVEELERRIKKLLDELKDRN

SEQ ID NO: 13175 - protein, 55 aa, Artificial Sequence
  Synthetic sequence.
KDVLRDLERILTELAKALKDLIDNSRRTLEKLLKALRDLIRESKETLEEVLRRTD

SEQ ID NO: 13176 - protein, 56 aa, Artificial Sequence
  Synthetic sequence.
KEREEVKEKLDRLLEEVEKTVRELKREHDELLKEVEKLVRDLKKEHDELLKKVKDD

SEQ ID NO: 13177 - protein, 59 aa, Artificial Sequence
  Synthetic sequence.
KDRLDKVEELVKKLLEDTKRTVDRVRELVRKILKKSRETLEELERLIEKILRELEKDAR

SEQ ID NO: 13178 - protein, 56 aa, Artificial Sequence
  Synthetic sequence.
SERETVKRRLEELLKEVKRTLDKLKEEHDRLLEDVRRVVEELKREHDKLLKEVKDS

SEQ ID NO: 13179 - protein, 59 aa, Artificial Sequence
  Synthetic sequence.
DKRLEDISRLVKRLLDESRRVLRELEETIRKRAEESKRVLEEVKRLVEKLIRELRKEAE

SEQ ID NO: 13180 - protein, 59 aa, Artificial Sequence
  Synthetic sequence.
SEDEIIKKIIEDLRRVLKEVEEIHKEVEERLDKVLKEAEEMHKEVLKELDRVLDEVKRI

SEQ ID NO: 13181 - protein, 56 aa, Artificial Sequence
  Synthetic sequence.
ERLLEELIEELKDLIRRHIELLRRLIERLKELLKKHIEDLRRLLEEIEKLLEEARK

SEQ ID NO: 13182 - protein, 60 aa, Artificial Sequence
  Synthetic sequence.
SREDEVRKVVEKVLRDSKRSMKELRDVVTEVLKKSKEVLRELKEAVDRVLKKLKDISRDV

SEQ ID NO: 13183 - protein, 56 aa, Artificial Sequence
  Synthetic sequence.
EELVKELLEFLKRVLEKAERLVRKNLEDNKELLERLERLIEENLKLLEDLLRRTEK

SEQ ID NO: 13184 - protein, 59 aa, Artificial Sequence
  Synthetic sequence.
SEEEKLRELKEILDRTLKKIEDLIEESKRLNEEHVRLTREILDEIRRLLEELLRKLREA

SEQ ID NO: 13185 - protein, 59 aa, Artificial Sequence
  Synthetic sequence.
EEILKRIEDTLKRLKEELKRLVDEVRKHIEELLERSERLIRELRRTLEEILKRLKEKTD

SEQ ID NO: 13186 - protein, 63 aa, Artificial Sequence
  Synthetic sequence.
SAAELVLELLARVVKLLEEVLKRLIDLHRDVLKKIKDVLDRDHELHERVLRELVKVLREAERR

SEQ ID NO: 13187 - protein, 56 aa, Artificial Sequence
  Synthetic sequence.
REELEKRLRETLDEHRDLLRKLKEFLDRSLEDLERRVDEVRKELERVLEELKRKLK

SEQ ID NO: 13188 - protein, 57 aa, Artificial Sequence
  Synthetic sequence.
KEVEDIERVLRKALELSKKVSDDLERVLRELLKLSKEVIEKLVRVLEEILELLKREN

SEQ ID NO: 13189 - protein, 59 aa, Artificial Sequence
  Synthetic sequence.
EEDLRRVRELIKKVLKDLERVLKEAEDLHREVLEKLKDVVRRAAEMHEEVIRALKEVSR

SEQ ID NO: 13190 - protein, 59 aa, Artificial Sequence
  Synthetic sequence.
DEEELLREIKTILDESLKALEELIRKIMRILDKSLKDLEEIVREIKKTIDELLEKVRRS

SEQ ID NO: 13191 - protein, 55 aa, Artificial Sequence
  Synthetic sequence.
EEALDDLRRLVKELKDKLRKLLKDYKDLLKELKDEAKKLLDDYRRLIEELEKKAR

SEQ ID NO: 13192 - protein, 59 aa, Artificial Sequence
  Synthetic sequence.
SEKEKLDELRKLIEEIERELDRLLEDNKRAVEKVLRDLDRLLKKSEDDVRRVEEELDKD

SEQ ID NO: 13193 - protein, 59 aa, Artificial Sequence
  Synthetic sequence.
KDLAERIRKILDDLLEVHERVARAIEELLRELLEKNEEIVRTIKKLLKRLLDTLRKAAE

SEQ ID NO: 13194 - protein, 58 aa, Artificial Sequence
  Synthetic sequence.
SKLETVIRILEELVKVHEELLRIVKKILEELVRVHRRVSEENLRLWKELLDALREDKG

SEQ ID NO: 13195 - protein, 55 aa, Artificial Sequence
  Synthetic sequence.
EELLKRVEDVNRESRKVLEESLRRVEEALEKIERALRKSEEDIRRLMEDIKRVLK

SEQ ID NO: 13196 - protein, 60 aa, Artificial Sequence
  Synthetic sequence.
SREEKIEKLIRLVEELLERLRELLERNAELIKRLLDRLRELLKELERLNEELLKKLLEKV

SEQ ID NO: 13197 - protein, 55 aa, Artificial Sequence
  Synthetic sequence.
RELEELIKKVERDHERVIKEVEKLVKELLDRSEEIHKRAKELIKEVLDRVREAAR

SEQ ID NO: 13198 - protein, 60 aa, Artificial Sequence
  Synthetic sequence.
SREELLDRILEAIAKILEDLKRLIDENLRRLEEVVRELERIIDRNLKLIREILDELKKRG

SEQ ID NO: 13199 - protein, 59 aa, Artificial Sequence
  Synthetic sequence.
DEIIRKLDELLKEVEKVHKEVKDRIRKLLEDHKRSLDEVKKKLERLLERAKEVVEREKK

SEQ ID NO: 13200 - protein, 61 aa, Artificial Sequence
  Synthetic sequence.
SEREELLERIKEILKRVKDKLDEDLKRLKEILEKLKEKADRDLEELRRRIEEVREKLERTG

SEQ ID NO: 13201 - protein, 60 aa, Artificial Sequence
  Synthetic sequence.
SETAVRAIIRVLEKHLEAVRRVLEELLKVLAEHLETVRELIERLKRVLEEAIEVVERVAR

SEQ ID NO: 13202 - protein, 60 aa, Artificial Sequence
  Synthetic sequence.
DEERKLKELLDRLRENIRALRELIKDNLRLLKTLVDALEELLKDNLRLLRELAEEAARRL

SEQ ID NO: 13203 - protein, 59 aa, Artificial Sequence
  Synthetic sequence.
EKDVRELIKRVETALRESEEKLRRVAEELKKALDRSRKDLEEVVRRTEDLLRRLEEKLR

SEQ ID NO: 13204 - protein, 60 aa, Artificial Sequence
  Synthetic sequence.
SEEETVRRLLELLKENIEELRELLKRNLDLLRKLAEELKKLIEELARITERLAEKLAKDL

SEQ ID NO: 13205 - protein, 59 aa, Artificial Sequence
  Synthetic sequence.
EEEVRKLVEELRRAVKRVRDLLDELRRRLEEALRKSKRELETIEERTRRLLEDIKRDLD

SEQ ID NO: 13206 - protein, 60 aa, Artificial Sequence
  Synthetic sequence.
SEEEEIVKRLKELIKRNLELLDKTLKELKKTLEDIIRTLTELVKRAKEINKELIDRLREK

SEQ ID NO: 13207 - protein, 56 aa, Artificial Sequence
  Synthetic sequence.
REDIRRYEEKLRKLVEEVKKKLRDLEERLRRLVEKIRKLLEDSERRLRTMLDEIRR

SEQ ID NO: 13208 - protein, 61 aa, Artificial Sequence
  Synthetic sequence.
REKEEKVKKVREVVTELKRELDDMLRRVKEAHERLKKKHDDLLKEVREVHKRLKDRLDERG

SEQ ID NO: 13209 - protein, 59 aa, Artificial Sequence
  Synthetic sequence.
EEIKKTIEEIIKVLRELNDKLRRLSEDTIRVLEELNKEIARLLEKLVRDTKRLLDELTK

SEQ ID NO: 13210 - protein, 59 aa, Artificial Sequence
  Synthetic sequence.
SVKEVIKEVLDRVVKLIKDVIDALKTVLDRHLRLNRENIRALLEVLERILELLEELVRK

SEQ ID NO: 13211 - protein, 57 aa, Artificial Sequence
  Synthetic sequence.
LEKLLRKVRKIAKELADELRKLHREVKETHEDLKRKLDKLLKDIRKVVEDIKREVDR

SEQ ID NO: 13212 - protein, 60 aa, Artificial Sequence
  Synthetic sequence.
EKEELVEEILRRLKKMSERFSRVVEEILKLLEDSSRKVEEAIRRTIRELEKTLKRVEKDG

SEQ ID NO: 13213 - protein, 56 aa, Artificial Sequence
  Synthetic sequence.
SRELREAVKKVIADLEKILKDLRKLDKESLDKLREILKTLRDLDRKSLEELEEIRR

SEQ ID NO: 13214 - protein, 58 aa, Artificial Sequence
  Synthetic sequence.
SREEKLREDLDRVFRKNEEELKRVEKEVKKLLDDSKRKLDEVKKELEDLLEKIKRLLD

SEQ ID NO: 13215 - protein, 60 aa, Artificial Sequence
  Synthetic sequence.
DEELLRALKEVVRKVIEIVRRLLELHRETVKELARVIKEILRLHLESIKKLLDVVREVLR

SEQ ID NO: 13216 - protein, 59 aa, Artificial Sequence
  Synthetic sequence.
DEEEKVRRLKELLDRTLKKLKELVEEHDKILDELLKKLEELVRRHNKLLDDLLRRVEER

SEQ ID NO: 13217 - protein, 55 aa, Artificial Sequence
  Synthetic sequence.
EELEDTVRKLLETSKKLLDEAREVLERLHRRSEELLRRVEETLRRLEDEVRKITK

SEQ ID NO: 13218 - protein, 59 aa, Artificial Sequence
  Synthetic sequence.
DKEDKLRKIKELIRKLLETIKRLVEEHDKELDETLKKLEDLVREHDRLLDETLKRLEER

SEQ ID NO: 13219 - protein, 55 aa, Artificial Sequence
  Synthetic sequence.
EELERDLERLEKTSEDLLRRVKEEIDRLHERSKKLLDEARKKLEELLKTVKDIAK

SEQ ID NO: 13220 - protein, 60 aa, Artificial Sequence
  Synthetic sequence.
SEREELARDLDDLRRRLREAAEELKKKHEKLRRELEELAKELRKRHEELKKELDDAARRG

SEQ ID NO: 13221 - protein, 56 aa, Artificial Sequence
  Synthetic sequence.
EEVLKRILDKLMKVSEDVLRKLEDLLREVIELTKKVLDLLDELLKRVKKVLEEVMK

SEQ ID NO: 13222 - protein, 60 aa, Artificial Sequence
  Synthetic sequence.
DREKKVRDIEEDLKRVLDKLRRRVETSKEELKKVLKRDKENADELEKTLRDVVRELDRKI

SEQ ID NO: 13223 - protein, 56 aa, Artificial Sequence
  Synthetic sequence.
SEVAKELDEVIKRLLDNLKENTDRLKEVIDRNLKDLRDLAEELRRVIERLLEDARR

SEQ ID NO: 13224 - protein, 58 aa, Artificial Sequence
  Synthetic sequence.
DKEEVLKDIKRKLDDHRRRTDEIVERLERLLKEHEEKTRRLLEDVRKKLEELKEIIKR

SEQ ID NO: 13225 - protein, 56 aa, Artificial Sequence
  Synthetic sequence.
EEVLKRILDRIEELLRRLVKVNTDSLRELKRVVDELVKVDRESLRELERVLRELTK

SEQ ID NO: 13226 - protein, 60 aa, Artificial Sequence
  Synthetic sequence.
SKEEEIVRELEKILRDHLRKVERIVEDLEKLLDDHLKKIEELAKRLEEIIREAARKLEEK

SEQ ID NO: 13227 - protein, 59 aa, Artificial Sequence
  Synthetic sequence.
EEVKELLKRVEKLIDDVRKKVEDLHRELEKALRDIDRKVKRLNEELERLVEEVEEKVKT

SEQ ID NO: 13228 - protein, 57 aa, Artificial Sequence
  Synthetic sequence.
SESEELRRKLEELEKELRDVLTKDRKMLEDLKRRLDKLVKDSERRIRELKRRLDEKI

SEQ ID NO: 13229 - protein, 55 aa, Artificial Sequence
  Synthetic sequence.
REIVEELRKVIEDHERLVREILELLRKAIDDNHKLVRDLLERLKRALDETREDRR

SEQ ID NO: 13230 - protein, 58 aa, Artificial Sequence
  Synthetic sequence.
RETEETLKKLEKLLRKMLEVSKRLNEEDEKLLRTKRKLIEDLLRRVEELLEETRRVVS

SEQ ID NO: 13231 - protein, 56 aa, Artificial Sequence
  Synthetic sequence.
KDLVETLKRKLDKLLRDIRELAKDYKRKLDRLLEDVERLHRELKKELDELLKEVKD

SEQ ID NO: 13232 - protein, 59 aa, Artificial Sequence
  Synthetic sequence.
SELEKLLTDLERVIRKVVEDLRRLLEEHKKALDEDKKRDEDSNEELADAIRKVIEKLKR

SEQ ID NO: 13233 - protein, 56 aa, Artificial Sequence
  Synthetic sequence.
EEDTKRLLEKIHDDHRKLVEENERLLREDHKTLEDLIRKIKKLAEEILELTARETK

SEQ ID NO: 13234 - protein, 62 aa, Artificial Sequence
  Synthetic sequence.
DEREVLKEILDLVRRLLELALEILKRSLELLRRLAEEAKKVLDRSVELLRRLVREAKEAAKN

SEQ ID NO: 13235 - protein, 56 aa, Artificial Sequence
  Synthetic sequence.
DELVKEVEDRLRESEKKLERLLEDVERLLRENEERLRRLLEEVERLLRELAETLER

SEQ ID NO: 13236 - protein, 56 aa, Artificial Sequence
  Synthetic sequence.
SEKEEVEKRLKKVDEDTKRAVEEVKKAIEEVLRRHEEASKRVEEAIRRVLKELEDL

SEQ ID NO: 13237 - protein, 57 aa, Artificial Sequence
  Synthetic sequence.
REELLERLKELIKRLLEALKRLDEEVSKLIDELLKRLEKLAKEVLDLNRELLERTRR

SEQ ID NO: 13238 - protein, 60 aa, Artificial Sequence
  Synthetic sequence.
SDEERLDKVLKEAEDIIRELERLLRESLETLKRLIERLEKLLRDSLEELRRLIEDLARKR

SEQ ID NO: 13239 - protein, 59 aa, Artificial Sequence
  Synthetic sequence.
EDVVRMLKEVSRRDEELTRRLLRMAKKLLEDNEELSRRLVKKLDEVLKRVEEIIKRETD

SEQ ID NO: 13240 - protein, 60 aa, Artificial Sequence
  Synthetic sequence.
SREERIRKLAEDLKRKIEELLRRVRKLAEEHKRLIEKILEESERLAEELKRRAEELKKRL

SEQ ID NO: 13241 - protein, 59 aa, Artificial Sequence
  Synthetic sequence.
KEVLDELRRLLELLKKLVDRLLELNKRLNDHAKKLVEDLLRLLKKLLEEIKKLVDDARR

SEQ ID NO: 13242 - protein, 61 aa, Artificial Sequence
  Synthetic sequence.
SEEERLEEEVRRELERYRRTVRRLAEEVKEELERYEREVKKEEEKLEKTLEDLERELTRDG

SEQ ID NO: 13243 - protein, 57 aa, Artificial Sequence
  Synthetic sequence.
KKTIAEELKRVLRELTRILRELVKLNSDVVRRLLEVLTRLAKLSEDVVREILEIERE

SEQ ID NO: 13244 - protein, 59 aa, Artificial Sequence
  Synthetic sequence.
SEEEKLETVREELRRALERIEELITKNEKKIEDTLRDIRREIEENARTVKEALERIKKD

SEQ ID NO: 13245 - protein, 59 aa, Artificial Sequence
  Synthetic sequence.
KEKVDRTKEELERLKKEHRERVEETKRKLDELKKEHEREIRKTETDLRRLLKELADRAK

SEQ ID NO: 13246 - protein, 59 aa, Artificial Sequence
  Synthetic sequence.
SEDEKLRKLVEEVERTLKKLIDYLRENVEDVDRILRRLKELIDRHLKKVRELIEKLLRG

SEQ ID NO: 13247 - protein, 59 aa, Artificial Sequence
  Synthetic sequence.
KDTVREIEKDLEDSKRELERIKEEIEELLKRLEDKNERAIEEIEEDLKRLEERLREAAK

SEQ ID NO: 13248 - protein, 59 aa, Artificial Sequence
  Synthetic sequence.
SEEEKLRKTEEDLKRTLEELKKILDDHLRIIERLLREIKRVLEENKRNARRLLEEIKRS

SEQ ID NO: 13249 - protein, 59 aa, Artificial Sequence
  Synthetic sequence.
ERVLKRLEKELRDHLKRLEEIIKRLEEDLKKTLDELKRTIEDAERKLRDLERKVKEDAK

SEQ ID NO: 13250 - protein, 59 aa, Artificial Sequence
  Synthetic sequence.
SILERLVRELIRLLRELLRIHKELVERVIRVLERLLEVHKKLVETIERLLDKLAELVRR

SEQ ID NO: 13251 - protein, 56 aa, Artificial Sequence
  Synthetic sequence.
KREIEKVLREIKEELRRSLRELKRVLDEVKERLKESLERLRKLIEEIKERLDRIRK

SEQ ID NO: 13252 - protein, 59 aa, Artificial Sequence
  Synthetic sequence.
SLEEITKRLLELVEENLRRHEEILRELLELAKRLAKEDRDILEEVLKLIEELLKLLEDN

SEQ ID NO: 13253 - protein, 60 aa, Artificial Sequence
  Synthetic sequence.
ERTLREVVRKVLEEAKRLLDELEEVHKRVKKELEDIIEENRRVVKRVRDELREIKRELDE

SEQ ID NO: 13254 - protein, 60 aa, Artificial Sequence
  Synthetic sequence.
SKIEEVLERAKEVLDRLLDLHRRLVKEIEDVLDRSNELLDRLLKELEKVLDELLDIVRRR

SEQ ID NO: 13255 - protein, 59 aa, Artificial Sequence
  Synthetic sequence.
EEALKELKERIEEIKKTLRELLKELKKLNREIKETIKELSERLARAVEKIKRELEKLRK

SEQ ID NO: 13256 - protein, 60 aa, Artificial Sequence
  Synthetic sequence.
KAEEAVEKLVRIARAIVKINEDLSREVVRILREIVRLNEETTRLLVEIAREVVKVVEDAG

SEQ ID NO: 13257 - protein, 59 aa, Artificial Sequence
  Synthetic sequence.
EELLRRLEELRKRLEKVLDDSRKELEKLKRELERLLEESRRKLEKLKRDLERVLEETRR

SEQ ID NO: 13258 - protein, 59 aa, Artificial Sequence
  Synthetic sequence.
DDRRILKLLIDIIRKLVKLNEETADKLIRVIDELLKMAEESLKKVIDLVRTLVEIIRRE

SEQ ID NO: 13259 - protein, 56 aa, Artificial Sequence
  Synthetic sequence.
RKVVEELLRKVEKLIKDIRERYERLVKKVRDLVERWKELVRRLLKKAEDVIREIEK

SEQ ID NO: 13260 - protein, 58 aa, Artificial Sequence
  Synthetic sequence.
DEEDALRTIEELVKRVNEENKKILDESEDLVRRLNEKNERINKESRDLVKKLREDAED

SEQ ID NO: 13261 - protein, 55 aa, Artificial Sequence
  Synthetic sequence.
ERVLKLVEDAAREDERLNRELDRATREVAEEDKKLNEDIDKTLNDVIRELLEAAR

SEQ ID NO: 13262 - protein, 58 aa, Artificial Sequence
  Synthetic sequence.
SSVETIKKLVEDARKKLEDSIRKIEKLVRDVEKTLRDSLKRIRDLVEKVVRTLRELLR

SEQ ID NO: 13263 - protein, 57 aa, Artificial Sequence
  Synthetic sequence.
LEELVKRITDILREHVKMHEDLIRAIAKVLRDHVEAHKRLIKRITEILEEVVKAVTD

SEQ ID NO: 13264 - protein, 59 aa, Artificial Sequence
  Synthetic sequence.
DTKEEIKKLVEELLRLIEELIKRTEELNKEDNEIAERVVETHSRILRDLLRSLEEVART

SEQ ID NO: 13265 - protein, 59 aa, Artificial Sequence
  Synthetic sequence.
DDELREVLDRIRERVKRSEDKLREVLERLKRDSKRIHKDLRKALEEAKKDVDEIRKETE

SEQ ID NO: 13266 - protein, 56 aa, Artificial Sequence
  Synthetic sequence.
RREEELKRIIREIERILEELRRRSREIEEKLKKVLEEHERVSRRIKERVEDLKRKV

SEQ ID NO: 13267 - protein, 56 aa, Artificial Sequence
  Synthetic sequence.
EKDIERIVEEALKLHEDVHDENRRILEEAIRTHREVIKRLEEIVKEAIKLIEDVTR

SEQ ID NO: 13268 - protein, 56 aa, Artificial Sequence
  Synthetic sequence.
SEKELLEEIEKRAEEVLREHDKRSEEIKRELERVLKELRDLSRKIEEDLERLVREV

SEQ ID NO: 13269 - protein, 56 aa, Artificial Sequence
  Synthetic sequence.
KKDIERIVRELIKVHRDVLRKLEKVVREALELHDRVNKELREVVERALRLLREVTR

SEQ ID NO: 13270 - protein, 58 aa, Artificial Sequence
  Synthetic sequence.
SEEEILKKIEDRLRAITEKHERMLREIKKELKKVMDEHEDLLRKIEKELRDVLERLRR

SEQ ID NO: 13271 - protein, 56 aa, Artificial Sequence
  Synthetic sequence.
ATLLERIVERARRELTKNHDKLRKILERLERILRELNEDLRRILTTAVDILRKLRK

SEQ ID NO: 13272 - protein, 60 aa, Artificial Sequence
  Synthetic sequence.
REDEVLRDIERLLREIEEKIRRILEESTRELRKVEEEVKRIIERTKRELKKIKEDVERKG

SEQ ID NO: 13273 - protein, 56 aa, Artificial Sequence
  Synthetic sequence.
RDLLEKIKRVIREHIKALEKLARDLKEILRRHIEALKELARDLAEVIRKLLEDVKR

SEQ ID NO: 13274 - protein, 59 aa, Artificial Sequence
  Synthetic sequence.
DLERLVELLKRIDDEAVKLVRKLVEVLKRIDEELVRLVEELLRALRRINEEVVRLVKRV

SEQ ID NO: 13275 - protein, 56 aa, Artificial Sequence
  Synthetic sequence.
EELLKRLRRIVEESKRRVDELLKELRKISEDVAREVERLLRELERISREVKRRVEE

SEQ ID NO: 13276 - protein, 59 aa, Artificial Sequence
  Synthetic sequence.
SDEEVARELSDIVRKLVERNKESIEDAMRIVKELVDRNKKVTEDVLRLLEKLLEDVRDT

SEQ ID NO: 13277 - protein, 56 aa, Artificial Sequence
  Synthetic sequence.
EEFLRRLKEEVRKIVEKVKRDLERSLKELERILEEVKRMLERSLRELERVLKEIKD

SEQ ID NO: 13278 - protein, 56 aa, Artificial Sequence
  Synthetic sequence.
SKEEILRELEELSRRLVEKLKDLLRKLEKLSDEVVKELRKSLEELKDLADKMVKKL

SEQ ID NO: 13279 - protein, 55 aa, Artificial Sequence
  Synthetic sequence.
RLLEEIVKLLRDVAKRNLDLLEKHRELLERALEEVKRLLDEHLKLLRDALRRLKK

SEQ ID NO: 13280 - protein, 58 aa, Artificial Sequence
  Synthetic sequence.
SREDLLRKLKELIETILRKSSELLDRLLKLVREHSETSERLIRELKKILEDILKLIKG

SEQ ID NO: 13281 - protein, 56 aa, Artificial Sequence
  Synthetic sequence.
EKELRRIKEAVERVLRDHKRKNDKILRDVEEVLRRHLEELRRILKDVKKVLDEARK

SEQ ID NO: 13282 - protein, 58 aa, Artificial Sequence
  Synthetic sequence.
DDEELLKRLEDLDERLLRFSKENLEELRRRTRELIETSETLLERLREIIETILKVIRD

SEQ ID NO: 13283 - protein, 56 aa, Artificial Sequence
  Synthetic sequence.
ERFLEEIAERVERILKEHRELLKRIEDEVRRVLTEHKKKLEKLKREVERVAEETKT

SEQ ID NO: 13284 - protein, 57 aa, Artificial Sequence
  Synthetic sequence.
KETDEVVKRAKELVDTLLKVIKEHVERLKRLVEELLKVIRDHVRILRELAKRLREKV

SEQ ID NO: 13285 - protein, 59 aa, Artificial Sequence
  Synthetic sequence.
SDVERVLEELRRRLEKSVEEVERVLKRLKEELDKSVEEVKDVLRRLLEDLKRVVEELRR

SEQ ID NO: 13286 - protein, 59 aa, Artificial Sequence
  Synthetic sequence.
SEEERVLEEIKREIDRIVKRARELLEKYRELVERIKRRNEEILKKYEKLLEEIERLADA

SEQ ID NO: 13287 - protein, 56 aa, Artificial Sequence
  Synthetic sequence.
ERDLKRALRRHAEELTRLNKELNELLKEHEDELRRLLAELDRIVRKLLRTLKELTE

SEQ ID NO: 13288 - protein, 60 aa, Artificial Sequence
  Synthetic sequence.
SKEEEAKRVIDELREELRRILRENTELVKESERRITELLKENSDLVEEVRRRLEEVLEKE

SEQ ID NO: 13289 - protein, 55 aa, Artificial Sequence
  Synthetic sequence.
EDLKRLVDDVLRLAEESHRKIEELNRRTLKLMEDSHRKLKELVRKALELITELTR

SEQ ID NO: 13290 - protein, 59 aa, Artificial Sequence
  Synthetic sequence.
DSIERLAEELDKIVTDVLRVNEDSVRTWTRILEEVLRLNRELARILIDIARRVLELVKR

SEQ ID NO: 13291 - protein, 60 aa, Artificial Sequence
  Synthetic sequence.
EKELLDEVRRLLKRVKELLKRSIDLVEKILRDVKRLLDESIELVKRVLDKIRRLLEELAR

SEQ ID NO: 13292 - protein, 60 aa, Artificial Sequence
  Synthetic sequence.
SEEDEVLKTLDRKHKEAKKELDKVLRELEEEHKKVKRELDEVLKRLEDIHRRITELLRRG

SEQ ID NO: 13293 - protein, 56 aa, Artificial Sequence
  Synthetic sequence.
EEAVERVLKENKELIEEIVRLIRKILDENIELIRRIVRLLERLLRENLRLIEEARK

SEQ ID NO: 13294 - protein, 61 aa, Artificial Sequence
  Synthetic sequence.
SKEEDVRRLIEELVRELRRILEENRRMLKELVEKLEEVLRRSEEVWRRLAKELDELLKELN

SEQ ID NO: 13295 - protein, 59 aa, Artificial Sequence
  Synthetic sequence.
EEVIKKIEDLVRKTERELREVHKELRRLVEEAKEVVDRSVEILRDLVRKIVRILEESAR

SEQ ID NO: 13296 - protein, 58 aa, Artificial Sequence
  Synthetic sequence.
STEDELRKIKEELEDIRRRIEELDKKDNEDLDRIDEEIKRRLDKNIRDLDEIAKEVRK

SEQ ID NO: 13297 - protein, 60 aa, Artificial Sequence
  Synthetic sequence.
KEELAEITERLLKKYREVAEENMRSLKELLREYREVNTRTHKALERIIDRIREILEKVRK

SEQ ID NO: 13298 - protein, 59 aa, Artificial Sequence
  Synthetic sequence.
KEKEAIKEVAELLKRLIDDLLRLLKEDVDTARRVLDEIKKLLEENERIAREVLRRLRED

SEQ ID NO: 13299 - protein, 56 aa, Artificial Sequence
  Synthetic sequence.
ETDLDRIVKEMEKVLEDSIRELEKLVKRLEDILRESEKALRDLLRELRKVLEEVRT

SEQ ID NO: 13300 - protein, 56 aa, Artificial Sequence
  Synthetic sequence.
SSMETAVKLVKDLLREDIRSNEEHVRLAKKLLEEDIESNERLLRILKKLLDLVEKT

SEQ ID NO: 13301 - protein, 56 aa, Artificial Sequence
  Synthetic sequence.
REELRRVAEEIKRRAEELLRRTEELVRDILRRHEDALRRTEELVRRIEKRLRDATR

SEQ ID NO: 13302 - protein, 61 aa, Artificial Sequence
  Synthetic sequence.
RELEDVLRMIEELARRLVEILERHNKLSKRVIELLVRILEEHLKLVAELIKKAVEILRRIL

SEQ ID NO: 13303 - protein, 59 aa, Artificial Sequence
  Synthetic sequence.
DDIRKLLKELLDDVKKIIDDSRRLLDELRKELEKILKESEKLVDELREAVDRLIRKVRE

SEQ ID NO: 13304 - protein, 58 aa, Artificial Sequence
  Synthetic sequence.
SREELLKELRKLVEEIKRRSEELLRRLEKLLEDNERRTRELLERLKELLREIEERIRG

SEQ ID NO: 13305 - protein, 56 aa, Artificial Sequence
  Synthetic sequence.
RDIVRELTELVRRLLKRVEELLKRSLEILRELIKAIADAIKESLDILDRLLREVAR

SEQ ID NO: 13306 - protein, 59 aa, Artificial Sequence
  Synthetic sequence.
EEEEVLRRLRELIERLVRETEEKLKEIERRIEEVLERHRRALEELKKEIDEILEEAERR

SEQ ID NO: 13307 - protein, 60 aa, Artificial Sequence
  Synthetic sequence.
EEALRRLVEKVKRVLEEILKVSEEVLEKVKKVLTDILKRLKELVERNVRLLERILDEARR

SEQ ID NO: 13308 - protein, 57 aa, Artificial Sequence
  Synthetic sequence.
SKIEKLLRVIKKIIDKLEELLKRLLEVVRESIELLKRILDELLKVVERTADELRRIV

SEQ ID NO: 13309 - protein, 59 aa, Artificial Sequence
  Synthetic sequence.
KDLERLLRKVKEDNDRVKKEVERLLKEIEDRNRKVVEEIKRRLEEIKRELDKVVEEIRR

SEQ ID NO: 13310 - protein, 57 aa, Artificial Sequence; identical to SEQ ID NO: 13308
  Synthetic sequence.

SEQ ID NO: 13311 - protein, 59 aa, Artificial Sequence; identical to SEQ ID NO: 13309
  Synthetic sequence.

SEQ ID NO: 13312 - protein, 59 aa, Artificial Sequence
  Synthetic sequence.
KDEDKLRRIVAVLEDLIRLTEELAKILKRVTERLKELTEELKRRNEKVVEEILKLLRDS

SEQ ID NO: 13313 - protein, 56 aa, Artificial Sequence
  Synthetic sequence.
EEVVRRIRELATKNLDDNRKALEESRRIIEEIVKRIKDVIRTSREIIKELRKEIRT

SEQ ID NO: 13314 - protein, 56 aa, Artificial Sequence
  Synthetic sequence.
KEAEELVEVVRKHIKTLAEIWKKLVDALRKHVEILRRLLKELVEVIRRAIERVRRD

SEQ ID NO: 13315 - protein, 55 aa, Artificial Sequence
  Synthetic sequence.
ERLDTVLEELRRVLKELERKLRESIKELRDVLREVEERLKESIEELERVLDRLRR

SEQ ID NO: 13316 - protein, 57 aa, Artificial Sequence
  Synthetic sequence.
SEEEIAERVKDLIRRVLEEHERSVKKVEDLIERVLREHRRVLEEVRRLAEELERRLG

SEQ ID NO: 13317 - protein, 59 aa, Artificial Sequence
  Synthetic sequence.
DRRKDDLRRVLEELLKRLKELLEELKRINEELLKTLEKLARDNLEINKELIKRLDEETR

SEQ ID NO: 13318 - protein, 59 aa, Artificial Sequence
  Synthetic sequence.
SEEDVLRKLEEIVEELERSNRDAVRRLEEVVKRVEDLWEEVVRRLRELVREVEERLRDV

SEQ ID NO: 13319 - protein, 55 aa, Artificial Sequence
  Synthetic sequence.
KEIEEIIERVLRLLAELLKRVKRISEDLKRLLDELIEENADILRKLDELVTRDET

SEQ ID NO: 13320 - protein, 60 aa, Artificial Sequence
  Synthetic sequence.
DKERIIKRVLDELKEALKKAEKLHEDVLRELRRLLDEALKLHEDVLRELEELLRKIESTL

SEQ ID NO: 13321 - protein, 59 aa, Artificial Sequence
  Synthetic sequence.
REKVEELADEIRRVVKRIEERHDKLRKDIERLVRRIEELHKRLLEELEELVKRITEELK

SEQ ID NO: 13322 - protein, 57 aa, Artificial Sequence
  Synthetic sequence.
SVLETIVDIVRKLIELIEKLLRDLLELDKRNVDAVARNADKILKIAEDIVRTIASKG

SEQ ID NO: 13323 - protein, 55 aa, Artificial Sequence
  Synthetic sequence.
EDLKRELDRLIKEIEESNRRLKKTTKDLVDEVERILRKIKDDIEDVKRKIEEDKR

SEQ ID NO: 13324 - protein, 59 aa, Artificial Sequence
  Synthetic sequence.
SEDELLDRLDESVKEVLDRHRKLLEDLADTIRRVIKKVKDLLDEHKKTLEDVIEKVLRR

SEQ ID NO: 13325 - protein, 59 aa, Artificial Sequence
  Synthetic sequence.
ETVVRDLRRLLEELRRISEEIVRDLRRLLEELKKIVEDVVRESKKLLDDLRRIIDETVR

SEQ ID NO: 13326 - protein, 59 aa, Artificial Sequence
  Synthetic sequence.
SRAERLADEVRKAVKKSEEDNETLVREVEKAVRELKKNNKTWVDEVRKLMKRLVDLLRD

SEQ ID NO: 13327 - protein, 60 aa, Artificial Sequence
  Synthetic sequence.
SEELVRIAIEVLKRLLEIIEELVRLNNEILERLLKIVRELHKDNIKILEDLLRIIEEVLR

SEQ ID NO: 13328 - protein, 57 aa, Artificial Sequence
  Synthetic sequence.
SEVETLIRLIEENLRLLKEVADLSLEVIERLLRILKEIVKRSLDVIRRLLKLIEEVL

SEQ ID NO: 13329 - protein, 55 aa, Artificial Sequence
  Synthetic sequence.
ERAKKRLEDLLREHREILKEVVKRLKELLDRHRKLLDEARRESKRVLDEIDEKTK

SEQ ID NO: 13330 - protein, 57 aa, Artificial Sequence
  Synthetic sequence.
SRVETLIRVVEKNLELLREIVERSLRVIKKNLRLLEEVARLSLKVIKELLEEIKRRV

SEQ ID NO: 13331 - protein, 55 aa, Artificial Sequence
  Synthetic sequence.
RRVKEELKRLLEKHRELLKEAVKRSEDVLKEHKEVLDDVRRESEKVLEELRRAET

SEQ ID NO: 13332 - protein, 61 aa, Artificial Sequence
  Synthetic sequence.
SEKDEVTRRIRELLKEAEETNREAIERIKRLLDRVREKVEEVAKRSEELLRRLKKVLDRDL

SEQ ID NO: 13333 - protein, 57 aa, Artificial Sequence
  Synthetic sequence.
KEDLLREIARILRESLRLIRELLKEIEKIVKEIIELLERLNDELRKIIEKILETTKK

SEQ ID NO: 13334 - protein, 59 aa, Artificial Sequence
  Synthetic sequence.
SRKELLKKLREVLETNLKLIEDLVRDIERALEEDRKLIEDLLRRIEEVARRILELRERG

SEQ ID NO: 13335 - protein, 56 aa, Artificial Sequence
  Synthetic sequence.
DKRLREVIKRLIEELRRLLKEYEDVLRKVREDLKKLLEEYKRVLERVDEELRKRDK

SEQ ID NO: 13336 - protein, 59 aa, Artificial Sequence
  Synthetic sequence.
DEEKRVEDVLRRVEDLLRKLEEEHRRIVKRIRDELRESERKIEELVDRLRKEIDRIRKT

SEQ ID NO: 13337 - protein, 57 aa, Artificial Sequence
  Synthetic sequence.
KEDLLRRTEKVEREIRKTLDDLHERTRRVVEETLRKNEELLKEIKRVVETILDEIRK

SEQ ID NO: 13338 - protein, 57 aa, Artificial Sequence
  Synthetic sequence.
SKKETLVKLAEEIIADIHRVNRESLELIKRLIERVEKLTKESLDSIRKLIERILRDI

SEQ ID NO: 13339 - protein, 55 aa, Artificial Sequence
  Synthetic sequence.
DEVREIKEKVRELIDKDRRLVKEIEDLAREILDTDRKLVKRLEEVVRELIERARR

SEQ ID NO: 13340 - protein, 59 aa, Artificial Sequence
  Synthetic sequence.
DEERVLTEIEKLVKRLKDRNDEIRRELEKTSKRLEEELERIERELDRLVEELKKELERT

SEQ ID NO: 13341 - protein, 56 aa, Artificial Sequence
  Synthetic sequence.
DKDLEDLIRRVLTRVKELARRLDRKNKELLKEIERLIREDKETADRVKTEIKKKTD

SEQ ID NO: 13342 - protein, 62 aa, Artificial Sequence
  Synthetic sequence.
DEEELVRRVEKLARDIEETLERLVKELERLYREIEKELKRLVKELEDANRRIVKRLKDLFDK

SEQ ID NO: 13343 - protein, 60 aa, Artificial Sequence
  Synthetic sequence.
DEEVLRRIEKLNKELEDVLREVEERIRKLLRELEEVSRRVTERIKRLEDELRKAFEEVTR

SEQ ID NO: 13344 - protein, 64 aa, Artificial Sequence
  Synthetic sequence.
SKKEDAIRKARKLLERIRRLADKAIKRSRRLLERVRELVKESLDILRKLLERLRDLVRKIKKDG

SEQ ID NO: 13345 - protein, 55 aa, Artificial Sequence
  Synthetic sequence.
DELRRLTEEILKLHEESVKKLEDLTKEALEASEDVHRKLEKLTEEILRRTEEAEK

SEQ ID NO: 13346 - protein, 59 aa, Artificial Sequence
  Synthetic sequence.
KEKEEADRELRELKREMEDILREVEKELRELLKKSEELLEEIERLSKELTDEAREVERN

SEQ ID NO: 13347 - protein, 56 aa, Artificial Sequence
  Synthetic sequence.
RELARKLLKRLKELNDRILETLRRLNEETARLVKEVLDTARRLLEELIRVLDETRT

SEQ ID NO: 13348 - protein, 64 aa, Artificial Sequence
  Synthetic sequence.
SKEDRLREILTELKEVIDTILRKLEEDARRLKKAHEESNEKLKRIVEDLERVLRELLRKLKERV

SEQ ID NO: 13349 - protein, 56 aa, Artificial Sequence
  Synthetic sequence.
KELLDKAKEIVDRVTEEVERILEENERLWRESIKDVKRILDEAREIVRRLLEEVRK

SEQ ID NO: 13350 - protein, 56 aa, Artificial Sequence
  Synthetic sequence.
DESEKVKEILERIERSLREVKRRVDEVLKRIKELLEELKRRHDESVKELKRILEEI

SEQ ID NO: 13351 - protein, 60 aa, Artificial Sequence
  Synthetic sequence.
GEELAKTLEKLAKELLDANRRLVDTSVKLVKRLLEIVAELVERHKESNRRLLKLIEDRDR

SEQ ID NO: 13352 - protein, 56 aa, Artificial Sequence
  Synthetic sequence.
SEEDILRRVVEELERLIKEAKEIIEEIRRLHEELDRKSEELLDRLLELLRDLLRRL

SEQ ID NO: 13353 - protein, 59 aa, Artificial Sequence
  Synthetic sequence.
KDKVRRLDELVKELLERLRRLHEENTEEVERVLRESARLLDDLLRKVEEVVEKIKEELR

SEQ ID NO: 13354 - protein, 56 aa, Artificial Sequence
  Synthetic sequence.
SREELVKDILRLLTESNDEHKKLSDKLVDLVRKLIELAEKLTEEVVDLVRRLLEEL

SEQ ID NO: 13355 - protein, 59 aa, Artificial Sequence
  Synthetic sequence.
EDAKELLKKVKEIVDELVRRHKKLVDEVREVVERVVREHRELVKKDRRLVDEVLKRLRT

SEQ ID NO: 13356 - protein, 56 aa, Artificial Sequence
  Synthetic sequence.
SREDLTRETERLLRESNEKHKELTKEIIRLVDRLIKLLEELTERLKELVKELLKRL

SEQ ID NO: 13357 - protein, 59 aa, Artificial Sequence
  Synthetic sequence.
EDAKKLVKEVRDVVERVRREHDKLVKEIEKIVRDIEKKLRDLVREDRELVKKIEKKLRD

SEQ ID NO: 13358 - protein, 59 aa, Artificial Sequence
  Synthetic sequence.
SAEDLVRRVKDLVDKLEDKLRKVVRTNERLWEEIRKRLEELVRRNKELWDRLVEKLKAG

SEQ ID NO: 13359 - protein, 56 aa, Artificial Sequence
  Synthetic sequence.
IRVLVELVRRHNKVLKELVEELEKLVRDHNRVVEEVVRELVELLRRAVEVIKEVVK

SEQ ID NO: 13360 - protein, 62 aa, Artificial Sequence
  Synthetic sequence.
REKEVIDDVRRMLEDLLRTIRRVIEENKRIVKESSDHIREVLKRVLEVLRRLLEEVKRLTER

SEQ ID NO: 13361 - protein, 60 aa, Artificial Sequence
  Synthetic sequence.
RKDVERELEKIIREVEERLRRVKEKLDDIDRRAKELHEEVMKRLEELVERIRRLLEDVER

SEQ ID NO: 13362 - protein, 62 aa, Artificial Sequence
  Synthetic sequence.
SDEEILREILKTLEDVVRRLEELLKENEKLIRESTKLIKDVLDELLEIIKRVAKLIRDLKRN

SEQ ID NO: 13363 - protein, 60 aa, Artificial Sequence
  Synthetic sequence.
EETVERKLKKLLDKARTELEKIKRRLDKLNEDYERKLRELEKRLRDLLERLRKTLEDIRK

SEQ ID NO: 13364 - protein, 60 aa, Artificial Sequence
  Synthetic sequence.
SEIEKILEELKRLVERVLKLNEDIARRIAELVKKDLKLIEDLLRELEDLVRKILDALRKK

SEQ ID NO: 13365 - protein, 56 aa, Artificial Sequence
  Synthetic sequence.
KDKVVEEIRRLLKRLKEEAEKVARESEELLRRIREASKELAERAKDLLRKLDEAVR

SEQ ID NO: 13366 - protein, 62 aa, Artificial Sequence
  Synthetic sequence.
SDEERILDTLRRIIEDLLRLLREALRRHEELLRRNIELIRRVLETIKEVLRRLLKLLLEVAK

SEQ ID NO: 13367 - protein, 60 aa, Artificial Sequence
  Synthetic sequence.
REELDRLLEDVRRVIEELKKLVREVLERSERMVKEVRDLWRDLKRRIEEAAERIKDELRR

SEQ ID NO: 13368 - protein, 61 aa, Artificial Sequence
  Synthetic sequence.
SERELLEKVRKVAEENIRILEEVLRKIAEVVKEDLKLLKELLEATERVVEELLKRIVEKKK

SEQ ID NO: 13369 - protein, 55 aa, Artificial Sequence
  Synthetic sequence.
ETLERLLEELERLVKEVVERSERLLKKLLEDVRRVAEELVKSVEDLLKDIEREVT

SEQ ID NO: 13370 - protein, 59 aa, Artificial Sequence
  Synthetic sequence.
REKELVDDIRRILEEILRLLRRLLEEVIRLLEENEKLVRRHLKTVIDILRRVAKLLDEN

SEQ ID NO: 13371 - protein, 56 aa, Artificial Sequence
  Synthetic sequence.
DSLVREVEELIKRLEKHIDDLLKTSRDLVKRVLDLVDEVVKRVEDLVERVKEKIDT

SEQ ID NO: 13372 - protein, 62 aa, Artificial Sequence
  Synthetic sequence.
DEERLAEELERVLDRNRKLLEEALRELRRVIEENRKSVKRLLDELKRVLDELLKVLRELSRD

SEQ ID NO: 13373 - protein, 56 aa, Artificial Sequence
  Synthetic sequence.
EEDVERAVKEIRDRLRKLLEDYERAVRRLEDKLRRVRERYEKVLKRIKDKLEETKR

SEQ ID NO: 13374 - protein, 62 aa, Artificial Sequence
  Synthetic sequence.
SREEVLRELEEVIEDNRRLLEELIEKSKKVLDESLKLIDELLRRLEEVLERVLRLLEELSKL

SEQ ID NO: 13375 - protein, 56 aa, Artificial Sequence
  Synthetic sequence.
EDDLKRVVDEVEKKLRELKRRYKEALERIKEKIKELKDRYERAVREVVAELRKTTK

SEQ ID NO: 13376 - protein, 56 aa, Artificial Sequence
  Synthetic sequence.
KKDEEIREKLDRLLEENRRALEEITTRLDDLLRRNKDALRKVMEKLKRLLDDLRRA

SEQ ID NO: 13377 - protein, 55 aa, Artificial Sequence
  Synthetic sequence.
ERVKEILERILRVVEEAVRLNEESLRRILDVVRKAVKLDRESLKKILDVVEEAVR

SEQ ID NO: 13378 - protein, 61 aa, Artificial Sequence
  Synthetic sequence.
SRVEELKKLIEDILRISREVVERIKRVAEDIHRINRRVLDDLRKLIEDILRTVEEILARKV

SEQ ID NO: 13379 - protein, 55 aa, Artificial Sequence; identical to SEQ ID NO: 1262
  Synthetic sequence.

SEQ ID NO: 13380 - protein, 60 aa, Artificial Sequence
  Synthetic sequence.
SRVEKVLELLKRIIEILRELVKVHLDVLRHNDELLKRIVEDLKRLVKKLVDILKEIVEKR

SEQ ID NO: 13381 - protein, 55 aa, Artificial Sequence
  Synthetic sequence.
EEALERLKRLLEEIRERLEELKKRLEESLKRHEEEVRKLLDKLRRLLRRAEEEAR

SEQ ID NO: 13382 - protein, 58 aa, Artificial Sequence
  Synthetic sequence.
SKEDELRKVLETLERLARELEELNKKILDDLKKLIEELRRHTEEVMRRLKELADELRK

SEQ ID NO: 13383 - protein, 54 aa, Artificial Sequence
  Synthetic sequence.
EVVRVLEELLRLVRDNVRRLDEILKELLRLVEESVRTAEEILKELLRLIKELAR

SEQ ID NO: 13384 - protein, 59 aa, Artificial Sequence
  Synthetic sequence.
SIEELVDELLKVLKEVVEETAKLLEENNRRLKKITDDVRRLNEDTIRRLREVVKELETK

SEQ ID NO: 13385 - protein, 56 aa, Artificial Sequence
  Synthetic sequence.
DDKARKALEDLERELRDVDRRSDEEATRLHEEHKKALDRYVKELKRVLDKMKEDTR

SEQ ID NO: 13386 - protein, 59 aa, Artificial Sequence
  Synthetic sequence.
SEKELVDKLIKLLEDVVKKLEDIARDNNRILKEIADRVKELNERTVEEIKRVIEELRRK

SEQ ID NO: 13387 - protein, 56 aa, Artificial Sequence
  Synthetic sequence.
EEKLTRAAEDLLRKLRRVDEESDKKLREVHRKHKEALEEVKRRLKEITEEADRATR

SEQ ID NO: 13388 - protein, 62 aa, Artificial Sequence
  Synthetic sequence.
SESELIRELEKLVKEIVDELERLLRNNIRLLEEVAKTLIRLLENNIELLDEILRELERLSKE

SEQ ID NO: 13389 - protein, 56 aa, Artificial Sequence
  Synthetic sequence.
EEEVRRTIERLKEEHEDALRRLKEILEELKDEHRRVLKRVKDKLRELKRRLEEREK

SEQ ID NO: 13390 - protein, 57 aa, Artificial Sequence
  Synthetic sequence.
SEREELERLLKELEDVTREVVERLKKLLRDNEKLTDEVRKRLRDLLRRLEEMVRRRG

SEQ ID NO: 13391 - protein, 56 aa, Artificial Sequence
  Synthetic sequence.
EEEIEEIVKRLVEVLEKVLRELERASRKLVKVVEEVLRALEEISKELVDVVREVLR

SEQ ID NO: 13392 - protein, 60 aa, Artificial Sequence
  Synthetic sequence.
DEDRRLEDAVRKLRKEHKDIMKKLDDIMRELDEDHRRIKERLDRILEELKKLLTRVLRET

SEQ ID NO: 13393 - protein, 54 aa, Artificial Sequence
  Synthetic sequence.
EIERIIRRVIEVIREILDLVRKVNKKALRVIEEILEDLARVNKKAVDAIDELRK

SEQ ID NO: 13394 - protein, 58 aa, Artificial Sequence
  Synthetic sequence.
DEERLLKTILDVIRKVLKESKDILRRVEEILRRVIETAKEIHKEVKEIIEDVLRLLRE

SEQ ID NO: 13395 - protein, 60 aa, Artificial Sequence
  Synthetic sequence.
EEEIEKRVREIKKEVEDLLRRSEELLKELLDRIRKLLEELKKRHEDLLREVKKDLDEIRR

SEQ ID NO: 13396 - protein, 61 aa, Artificial Sequence
  Synthetic sequence.
DEVEELLKRVRELLKRSEELVRKILEDVKRLLERSIEEVEDLLRKVEELLKRLLDLVERRK

SEQ ID NO: 13397 - protein, 56 aa, Artificial Sequence
  Synthetic sequence.
EDLDRDVDRVLKEIMDLLRDLVRRTKELLEELLRLLEELVRRHKELVRKILDEIRK

SEQ ID NO: 13398 - protein, 59 aa, Artificial Sequence
  Synthetic sequence.
REAEELLRELEELLKKSEKVLEDLLRKNRELIKDSKRRLDEVRRKVEKLAEEVEEVIRR

SEQ ID NO: 13399 - protein, 56 aa, Artificial Sequence
  Synthetic sequence.
KDAVRKLIEELKKLLEDLVEHHERLLKEDHERLKRLLDHHRELLKTVLTILRETAK

SEQ ID NO: 13400 - protein, 59 aa, Artificial Sequence
  Synthetic sequence.
ELDEILRKVVEDSRRLVKELEDILREVIERTERILEEHRDLTRKADEDIRRILEEATRT

SEQ ID NO: 13401 - protein, 57 aa, Artificial Sequence
  Synthetic sequence.
KEEVLKDIVRVLRDVLKKANDLLKTHLDLNRESVKKVVEIARRHVKMNEDSVRKVEK

SEQ ID NO: 13402 - protein, 59 aa, Artificial Sequence
  Synthetic sequence.
DVEDVLREVVERSRRLVEEHKRISEKVIRDTKRILDEHRELTERVIRRAKKLVDDARRT

SEQ ID NO: 13403 - protein, 57 aa, Artificial Sequence
  Synthetic sequence.
KEEVLKDAVRVLEEILRKLNELLERHLKLNEESLERMNRILTRHVKLNKESADDARR

SEQ ID NO: 13404 - protein, 59 aa, Artificial Sequence
  Synthetic sequence.
DEEELLRRVTEELKRLLDEARKLHEDVKRELEKLLKENDDLLRDVKRKLERLLEALKRG

SEQ ID NO: 13405 - protein, 57 aa, Artificial Sequence
  Synthetic sequence.
KDKLLERIRRLLETLLEVLKRDNEEIKRILEELLRVAEENLRRIKEIIDRLLDATRR

SEQ ID NO: 13406 - protein, 59 aa, Artificial Sequence
  Synthetic sequence.
DEEEVVKRLADVLRENDETIRKVVEDLVRIAEENDRLWKKLVEDIAEILRRIVELLRRG

SEQ ID NO: 13407 - protein, 59 aa, Artificial Sequence
  Synthetic sequence.
EDVKRALEELVKRLRKLLEDVKKKSEDIVREVERIVRELKKRSDEILKKLEDIVEKLRE

SEQ ID NO: 13408 - protein, 56 aa, Artificial Sequence
  Synthetic sequence.
KEREEIRERVKRILETSRKLLEELAKAVEDVLRRSKELIDELRDAVRRVLEELERG

SEQ ID NO: 13409 - protein, 59 aa, Artificial Sequence
  Synthetic sequence.
DRTKKIVERIIELIEELLRLLVKVVEDSVRLIEELLKLAEEVAKRSLKLIEDLLRAIEK

SEQ ID NO: 13410 - protein, 58 aa, Artificial Sequence
  Synthetic sequence.
SDDEVIEKVKEDLRRLIKEAEDVVREYEKRLREVEKKLDEVVKESERLLRELLKKLEA

SEQ ID NO: 13411 - protein, 60 aa, Artificial Sequence
  Synthetic sequence.
KKELIKILRDLARKHRELLKRLKELTREHLKRVREILEELLRVTRELVEEIDKILKDLKK

SEQ ID NO: 13412 - protein, 58 aa, Artificial Sequence
  Synthetic sequence.
SEDEVLERIRRALERVEDEHRKVLEKIVEDLKDVLEKHKRVLEEAKRDLERIKEDADK

SEQ ID NO: 13413 - protein, 60 aa, Artificial Sequence
  Synthetic sequence.
EKSLKDLLREVLERSKKLLEEHHKHLEEIVRRTKELLERHHRHLKEIIRRIEEILKRERD

SEQ ID NO: 13414 - protein, 59 aa, Artificial Sequence
  Synthetic sequence.
SKEDELREVLERVKRLIETVKRALDEALDRTRRLIEELDKTSKRVLTTVKKLIEDARRE

SEQ ID NO: 13415 - protein, 57 aa, Artificial Sequence
  Synthetic sequence.
ERDLLRELLRIVKEHVDEVRKLLDELRKVNEKIVDAVRKILEKLLKIATDAIEETRK

SEQ ID NO: 13416 - protein, 61 aa, Artificial Sequence
  Synthetic sequence.
SEKERLMEEIKRVAEELRKTVDRLRERNEKVVRDIRETVREVEREHEDVVKELADRVRELR

SEQ ID NO: 13417 - protein, 62 aa, Artificial Sequence
  Synthetic sequence.
EEVREVLRRLTKILRDLLKRNKEIMEKLLRDLKELLKENKKALEDLLRKLEELLRRIAEAEK

SEQ ID NO: 13418 - protein, 57 aa, Artificial Sequence
  Synthetic sequence.
SKEETTKRLLDRHLERDRELLDRAARTNEEILRRNREVLKELFELLKRILDRVREAN

SEQ ID NO: 13419 - protein, 59 aa, Artificial Sequence
  Synthetic sequence.
EEVLRELRELLKRLKKRLEELLREHEKLLEDYKDRLRKSDDDLRRSVEEIKKALDRLRK

SEQ ID NO: 13420 - protein, 57 aa, Artificial Sequence
  Synthetic sequence.
SKLEDSAEKLKEHLKRDRELLKRAEDLLREILRRNREVLDELRRTLDDILRRIREEN

SEQ ID NO: 13421 - protein, 59 aa, Artificial Sequence
  Synthetic sequence.
KEVLDRLEKLLRDARKRLKELLDEHEKVLEDMERRLRESLDDLRRSLDRIRKDLKRKTD

SEQ ID NO: 13422 - protein, 62 aa, Artificial Sequence
  Synthetic sequence.
SEKERTKELLERLLKLIRELLKKLEDLNRDLLRRVKEVLDRLAELNEELLRRVEEVTRLRDE

SEQ ID NO: 13423 - protein, 60 aa, Artificial Sequence
  Synthetic sequence.
KEKLTKLIKEIKERSKRLLEEVKRALEEVMKKNEKILRDVRDDLRRAREELREILREADD

SEQ ID NO: 13424 - protein, 60 aa, Artificial Sequence
  Synthetic sequence.
REEEKLKETLERILRELEKLAKENKELLERILKRDEDLTRENKETLDRLLKRVEEVTRRK

SEQ ID NO: 13425 - protein, 60 aa, Artificial Sequence
  Synthetic sequence.
DREVEKVLRDIKRKIKEIVDEHRDMNRKIKEEIDRIDTEYKKSLKDIKKEIEEVLDEARQ

SEQ ID NO: 13426 - protein, 59 aa, Artificial Sequence
  Synthetic sequence.
RKEEAIERIRREIEKVRRRLREVHKESEERIRRLEDEYRRALETSAELIRRILDELRKN

SEQ ID NO: 13427 - protein, 59 aa, Artificial Sequence
  Synthetic sequence.
KRVKDIVRKILRVIEENLKFVAEAVKKLKEIIERNLRLLEEIAKLLLDILEEVLKRLTT

SEQ ID NO: 13428 - protein, 59 aa, Artificial Sequence
  Synthetic sequence.
REKEVIEDIKRLLDEILKRLEEANKETEERLEKLRKEYRELLEDSKRKIKDIEAELRRL

SEQ ID NO: 13429 - protein, 59 aa, Artificial Sequence
  Synthetic sequence.
EAVKEIVKRLKEVIKDNLRVVEELVRKLKEIIEDNLRVLREIAKLLKDVLEKLLRDVRK

SEQ ID NO: 13430 - protein, 56 aa, Artificial Sequence
  Synthetic sequence.
DKDKRLEELLKRLKELNDKTFEELERILEELKRANERSLREAERILEELRRRIEER

SEQ ID NO: 13431 - protein, 59 aa, Artificial Sequence
  Synthetic sequence.
KDVKDIIRTILEVARDLLRLLEEDSRTNSEVVKRLLDLLREDSKANSEVVKRLLDVLRE

SEQ ID NO: 13432 - protein, 56 aa, Artificial Sequence
  Synthetic sequence.
SKEETLKRLLDELEKRNRETVERLERLLKELEDRNRRSLEELERVLEELERKIEES

SEQ ID NO: 13433 - protein, 59 aa, Artificial Sequence
  Synthetic sequence.
REVKDIVRKMEEVIRRLIEILRRDVELNLDVAKKLLELLKEDSKLNLDVARELLELLDR

SEQ ID NO: 13434 - protein, 57 aa, Artificial Sequence
  Synthetic sequence.
RELELLDELLRRTERLVKEYLRVSKELLEETLKLLTELLKLSKRLLEETERLLRRDK

SEQ ID NO: 13435 - protein, 60 aa, Artificial Sequence
  Synthetic sequence.
KTELLEEAVKRLETLLRRYKEEIRRVAKRLEELLRELNELSKRLEETLKKLLEDLREDAR

SEQ ID NO: 13436 - protein, 57 aa, Artificial Sequence
  Synthetic sequence.
DEEETLRRLLERKVELAKEYLDVSKEVIDRTTKLLDEYLKTSKRIVDKTVELLERDD

SEQ ID NO: 13437 - protein, 60 aa, Artificial Sequence
  Synthetic sequence.
LRERLEEARRRLEELLRELNEITKDLERKLEKLLRDLNELTKRLEEELKRLLDELKKRTD

SEQ ID NO: 13438 - protein, 61 aa, Artificial Sequence
  Synthetic sequence.
SEEDELVKRLRELVKELIDAIREHLRRLEELLRELLKALEDHLRKLAELVRRIIEELRRTN

SEQ ID NO: 13439 - protein, 59 aa, Artificial Sequence
  Synthetic sequence.
EELKERIRRIVETIRRSLERLKEEADRIVKEIEKSLRELEERLERIVDTIRKLLEDAKR

SEQ ID NO: 13440 - protein, 61 aa, Artificial Sequence
  Synthetic sequence.
SEDDVLRKLLEAIKKLLKETKEILDRYLRESDRHNKALREILERLLELIKTLLEDLVRRTG

SEQ ID NO: 13441 - protein, 59 aa, Artificial Sequence
  Synthetic sequence.
EEALKEIKRKLRELEKEIRKVVEDSRRISEESLRRLEKALEDIERILKKLSDEIRTDAT

SEQ ID NO: 13442 - protein, 58 aa, Artificial Sequence
  Synthetic sequence.
DEEEVTKEVERLNRELLKRLREIVEETKDLNRRLLEILEELVRRTEKLLKDVLEIRKR

SEQ ID NO: 13443 - protein, 56 aa, Artificial Sequence
  Synthetic sequence.
KDRLREELKKLLEELRRVLEDAKRKSEELSRRLEEVLRRAEEKNKEIMDRIRKARE

SEQ ID NO: 13444 - protein, 57 aa, Artificial Sequence
  Synthetic sequence.
KEKEELLEEVERKVTELKKRSEDLVRKLDEEVKRLEREHEELLKKLRDAVEELRRAK

SEQ ID NO: 13445 - protein, 60 aa, Artificial Sequence
  Synthetic sequence.
RETVLRKIIRLVEELLKILARINEEVKKLIRKLLEILTRINKKMIEVIDELVKIIREAAT

SEQ ID NO: 13446 - protein, 56 aa, Artificial Sequence
  Synthetic sequence.
SEEERTKESLKKVLKALVDLNRELLRKLEENMRELTKLNEEVKRKLKEVLDKVREN

SEQ ID NO: 13447 - protein, 59 aa, Artificial Sequence
  Synthetic sequence.
EEIRKIVEEILKEIKELADRYREEVRKSKDKLRRILEDYKRKVDELKERLRELIEEVET

SEQ ID NO: 13448 - protein, 59 aa, Artificial Sequence
  Synthetic sequence.
SLKELAEEVLRRILELLRRIIEIHERSLERSNRTLKKLIDEIERVMREILETLKRALSI

SEQ ID NO: 13449 - protein, 56 aa, Artificial Sequence
  Synthetic sequence.
RTLLEEIRRRVEKVIREARETLREHRERVERSIEELRRMLEDVERIVREAIERLRR

SEQ ID NO: 13450 - protein, 61 aa, Artificial Sequence
  Synthetic sequence.
SEVEDILRRLAELNKRLIDKLRELIDRIRRLNEELLRVVEDILRRLKRLADELIRVVRERG

SEQ ID NO: 13451 - protein, 56 aa, Artificial Sequence
  Synthetic sequence.
DEDLKRLLEKLKEDVERVLKEVRDRTRESLKHLEDVIRELEKKTEDSLRHMEERRK

SEQ ID NO: 13452 - protein, 57 aa, Artificial Sequence
  Synthetic sequence.
SKEELVKEALEENVRSVEEVIKLLKDALDENLKVVERVIRELKRALERVKDVIRKLI

SEQ ID NO: 13453 - protein, 59 aa, Artificial Sequence
  Synthetic sequence.
KKVADELKKLLDELKKILEEIRRMLEEANRKHDDIVRDIRRVLEENDRKLEKIADDIRR

SEQ ID NO: 13454 - protein, 57 aa, Artificial Sequence
  Synthetic sequence.
SKKEELEKLLDTNLTEIRRLLKRVKDVLDRNLEVVRRVIEELARLLDEVTEVVRRLI

SEQ ID NO: 13455 - protein, 59 aa, Artificial Sequence
  Synthetic sequence.
EKVKRELEKLIKRVKDILDDIRRRLKKVNEEHEREADRLRRELERLDRELKKRMDDIRR

SEQ ID NO: 13456 - protein, 56 aa, Artificial Sequence
  Synthetic sequence.
DEDEELKERTKKSLEKLRRLLERLEKIIRESLDKLRDLLRLLEEALKRILDELRRN

SEQ ID NO: 13457 - protein, 56 aa, Artificial Sequence
  Synthetic sequence.
RDKLEKIERDIRKIIRDLEEIARRLKEDHERVIKELRETVKKHKEDLEEVIRELRR

SEQ ID NO: 13458 - protein, 55 aa, Artificial Sequence
  Synthetic sequence.
REKEDVARRIKRIHDELETRIRKLARDLERIHRKLKEDIERLVREAEKKLRELEK

SEQ ID NO: 13459 - protein, 55 aa, Artificial Sequence
  Synthetic sequence.
EEIERLVEELKKILETILKLIAELNEEVVRLLEDILRLVRELNERVAELLERAEK

SEQ ID NO: 13460 - protein, 60 aa, Artificial Sequence
  Synthetic sequence.
DEERIIKTLEDINKKLVEDIKRILDKVRELNERLADAIRKILEETKRILERTTRKVRKDG

SEQ ID NO: 13461 - protein, 56 aa, Artificial Sequence
  Synthetic sequence.
KDTLRTVEKLVEDVKRRLDKLLEDYKRLIEEVKKELDKLLKEYEDRLREIKKRIDE

SEQ ID NO: 13462 - protein, 59 aa, Artificial Sequence
  Synthetic sequence.
DLEDAIRELLRRLTELIEELVRILEELNKRLNDLVRRLVEILRRINELLKKLVDRLRKD

SEQ ID NO: 13463 - protein, 59 aa, Artificial Sequence
  Synthetic sequence.
ERELKKVLDDIREKVKKTIKEIDEVLEKITRENERTRKEIEEMLRTLRELIKRLLEETK

SEQ ID NO: 13464 - protein, 56 aa, Artificial Sequence
  Synthetic sequence.
SEEDEVAKTLEDILRRLEELLREHHELHRRILEELEKLLRDHIKLHKDILDEATKS

SEQ ID NO: 13465 - protein, 56 aa, Artificial Sequence
  Synthetic sequence.
KETLKRLKDRSKELNDRVRETLKRLAERSKRLNEKVEEDVRRAVEELRRLLEEIRK

SEQ ID NO: 13466 - protein, 56 aa, Artificial Sequence
  Synthetic sequence.
DERKVIEDLVEVLRDLLRVIKEVLDRNVKLIKDLLRLNLKVAEELIRVLKELLDRL

SEQ ID NO: 13467 - protein, 55 aa, Artificial Sequence
  Synthetic sequence.
EELDRIRKELKRLLDELTKLHEDVRKKSEELVREAERTLEDVKRKLDELLERAKK

SEQ ID NO: 13468 - protein, 60 aa, Artificial Sequence
  Synthetic sequence.
DEERELERLLEDVRRRHEELLRRLEKLLEDIRKLYEDVRRKLKRLLERVDRLVREILRRD

SEQ ID NO: 13469 - protein, 58 aa, Artificial Sequence
  Synthetic sequence.
ELIKELADIVKEILRLAEELAKELEKINRELDRVTRELIKDLLRISRELIKRLEDTTR

SEQ ID NO: 13470 - protein, 58 aa, Artificial Sequence
  Synthetic sequence.
SDKELLDDTIRKMRKLHRDSVELLDDIRRKLEELLRKVRELLDRNVKKIRELIELRKK

SEQ ID NO: 13471 - protein, 56 aa, Artificial Sequence
  Synthetic sequence.
DSDLEDLIRRDIEELKKVIEKLEELVRRIEELLREAKERDKESLDRIEDELRKAKK

SEQ ID NO: 13472 - protein, 58 aa, Artificial Sequence
  Synthetic sequence.
EEDDLLKANLDTLRELHKESEKLLRDIEETAKELHKKSEELLKRITDELDRLVKLSRK

SEQ ID NO: 13473 - protein, 56 aa, Artificial Sequence
  Synthetic sequence.
DSDIKRILDDLRRRLEDALRRDRETLKRLKEEIERVKKEDRRSLERDKEELEKARK

SEQ ID NO: 13474 - protein, 56 aa, Artificial Sequence
  Synthetic sequence.
SAAELILKAAKEAAEANREAAELALKAAEESARAAREAAELALKAAKEAAEAARRG

SEQ ID NO: 13475 - protein, 56 aa, Artificial Sequence
  Synthetic sequence.
KDDLTRAADELLKKAKKLADDYKRAADRLLKEAEDLAREWKKLADKALEDAKRDAD

SEQ ID NO: 13476 - protein, 56 aa, Artificial Sequence
  Synthetic sequence.
KAEEAAKEAARLAKEDADLAKKAAEDAAELHERHAKLLEDSARTAAELAKRLAEAA

SEQ ID NO: 13477 - protein, 59 aa, Artificial Sequence
  Synthetic sequence.
KEDLDRLAKIAKEAADALEELLERSKESAERAARALEKLLKEWADSAKKAADALEELDR

SEQ ID NO: 13478 - protein, 60 aa, Artificial Sequence
  Synthetic sequence.
DELETLKKEAEDVLRELRDILRKLEDLSRKTIEDMRRIVEEVLKLNEDSIRELKRIIEEL

SEQ ID NO: 13479 - protein, 55 aa, Artificial Sequence
  Synthetic sequence.
DEVVKKLEDVSRKSIDDLRKIIETLREVVERSIEEIERIIRDLERVIREIIEREK

SEQ ID NO: 13480 - protein, 57 aa, Artificial Sequence
  Synthetic sequence.
SKIEELAKIAEEHAELNRRAARKNNEIAKEAAELWKRAAEKHVRIAERAADAIRKAA

SEQ ID NO: 13481 - protein, 59 aa, Artificial Sequence
  Synthetic sequence.
EKALREAKELAERAARENREALKEAKELAKRNSEKAKESAKEHKKLAEDANKRAEEATR

SEQ ID NO: 13482 - protein, 59 aa, Artificial Sequence
  Synthetic sequence.
DEEEVIEEILKTLEEINRRVLKLIKDILEKVKRVDDEIKTLVKEVLRENERVLREVREK

SEQ ID NO: 13483 - protein, 59 aa, Artificial Sequence
  Synthetic sequence.
EKMLEDILRRLEEINRTSLRLVDEVSKKTREVLERILKLVKEVLDESRRVAKKVKDDLK

SEQ ID NO: 13484 - protein, 57 aa, Artificial Sequence
  Synthetic sequence.
SAVDIAREAARRVIELLKRSAEAAEEAARRSIKLAKESADAAREAAKKVIEILKRAA

SEQ ID NO: 13485 - protein, 56 aa, Artificial Sequence
  Synthetic sequence.
EDAARKAAEIAARAAKRSADTAKRWAEVAKEAAEESAKSAKKAAKIAEDAAREIEK

SEQ ID NO: 13486 - protein, 57 aa, Artificial Sequence
  Synthetic sequence.
DLREAAKEAIDAAEEAARRTEEAAKENIRALEEAAKRTRDAVRRAIKAIEDAVRDAG

SEQ ID NO: 13487 - protein, 56 aa, Artificial Sequence
  Synthetic sequence.
REDLERIAREAAERAKELADRLEEIYRRAAEESKRLAEELKRIYKRAAEEAKKAAD

SEQ ID NO: 13488 - protein, 57 aa, Artificial Sequence
  Synthetic sequence.
SKIEELMKLVEKIIRKTLDLVRKHAEVSKEVLKEYIRISKEHLDVSKRVAEELKKEI

SEQ ID NO: 13489 - protein, 59 aa, Artificial Sequence
  Synthetic sequence.
KEDLDRIRDTLRRVIERSKRIHDRLREMLEEVKRRSEEIVERIERELRDVARKLEETLR

SEQ ID NO: 13490 - protein, 59 aa, Artificial Sequence
  Synthetic sequence.
SLTEELRRVVKEIEEVVRRDVRTLEEVVKKITEVVRRDDKSLREVVKRNEELVRLLARG

SEQ ID NO: 13491 - protein, 60 aa, Artificial Sequence
  Synthetic sequence.
EKDRREILRELVELTERSVEEIARVNKELVDIVRELVKELKRLNERLVELVKRLVEETAT

SEQ ID NO: 13492 - protein, 56 aa, Artificial Sequence
  Synthetic sequence.
RAIETLVDVVREAIEINKRLVDRNVESNKELAKLNRDLVRRNRESNTELADLVRRD

SEQ ID NO: 13493 - protein, 60 aa, Artificial Sequence
  Synthetic sequence.
EEELKRVVDEIVELLKRVLETTEKVVRDNVRLLEKALRSSKKVLDENVKKLEDVLRDLKR

SEQ ID NO: 13494 - protein, 56 aa, Artificial Sequence
  Synthetic sequence.
SAAEALAKLAKENAELNRELAERNARSNKELAELNEEAARRNAKSNKELAELARRE

SEQ ID NO: 13495 - protein, 60 aa, Artificial Sequence
  Synthetic sequence.
EEELKRAIEEAAKLLKRAADETRRAAKENAEALEKAARESKEAAKDNAEALKKAAEEAKK

SEQ ID NO: 13496 - protein, 58 aa, Artificial Sequence
  Synthetic sequence.
TEEEVVEDVKRVLDESHDDLRRLIETLTRVLRESLKRIKEALEELERVLKKLLDLLEG

SEQ ID NO: 13497 - protein, 56 aa, Artificial Sequence
  Synthetic sequence.
REEVKRVLEEARDELRRLLEEYKKIIEELERELERLLREHREVIRRIKEEIDKSSK

SEQ ID NO: 13498 - protein, 59 aa, Artificial Sequence
  Synthetic sequence.
SEVERAVEDVKRALEENVRLSKELVDRVTKMAEDNVKLTKDIVDKVRRILEELVEVIER

SEQ ID NO: 13499 - protein, 56 aa, Artificial Sequence
  Synthetic sequence.
KDEVRKIVRELVEEAKKVVEYDTENAKRVVEELKRVVKRDADVVRKLVELLDRKAR

SEQ ID NO: 13500 - protein, 59 aa, Artificial Sequence
  Synthetic sequence.
SELEEAVKRVRDALRENLDSIRRLVEKIRRVLEEHNKLSKELVDRIEEVLRRTVEAVKK

SEQ ID NO: 13501 - protein, 56 aa, Artificial Sequence
  Synthetic sequence.
KRDVARVVRELIELVKRVLERDKRIVDELVKLVDEVLKRNKEIVDELVRLVDEARR

SEQ ID NO: 13502 - protein, 56 aa, Artificial Sequence
  Synthetic sequence.
SELEDLIRLLREVIKRLEESVKELVDIVEEAIERLRKIVKELIDLSRKVIDELLEL

SEQ ID NO: 13503 - protein, 59 aa, Artificial Sequence
  Synthetic sequence.
EELLDRIRRLIEESIKKLARIADRLRKLIEDLRRLLEELLRRNEELIERLERMLDEKAR

SEQ ID NO: 13504 - protein, 60 aa, Artificial Sequence
  Synthetic sequence.
SEKEEAAKAAEEAAEIAERADEKAARSSKEAAKIAEKADKEAAESTRKALDDARRALEEA

SEQ ID NO: 13505 - protein, 59 aa, Artificial Sequence
  Synthetic sequence.
EDAARRAEKAARENADSIRRAAEKSRKAAEDNARSIEKAARESEEAAERAARILKRAKD

SEQ ID NO: 13506 - protein, 57 aa, Artificial Sequence
  Synthetic sequence.
KEVEDVVEKLRELIDRALDRNRKVVEEVRDVVRRALEENRKVVEEVRKVIKEILDRV

SEQ ID NO: 13507 - protein, 55 aa, Artificial Sequence
  Synthetic sequence.
KEATDLIRELIERLRKVLEKSRRLIDRLVKLSRDVLEETKRLVEELIREVKRAET

SEQ ID NO: 13508 - protein, 60 aa, Artificial Sequence
  Synthetic sequence.
KLEEIVKKLEDLNKKAVEILRRVLEEHEKLVEKVKKVLRDVLRLLEKVVREVIETLKKKD

SEQ ID NO: 13509 - protein, 56 aa, Artificial Sequence
  Synthetic sequence.
EEVLRKLKEIIKELKDRLKKLLDDYERIIDELRRELERVLREYEKILEDLRKELED

SEQ ID NO: 13510 - protein, 60 aa, Artificial Sequence
  Synthetic sequence.
SELEEAAKALERIAKKAAKAARDWAEEDRRLAEEAIRAAEEWAKENKKLADELAKAAKDN

SEQ ID NO: 13511 - protein, 56 aa, Artificial Sequence
  Synthetic sequence.
SDEAVRALEEAAKRSEDAARKAAKLARDAAEKSRRAAEKAIRLLEEAAKEAKDAAR

SEQ ID NO: 13512 - protein, 57 aa, Artificial Sequence
  Synthetic sequence.
KEAEEIAEAVKRLAEASAKTAEELARAVRKAAEDLVKLAKEHADALRTAADRIAKLI

SEQ ID NO: 13513 - protein, 59 aa, Artificial Sequence
  Synthetic sequence.
EDIRREIKRIADELKEITKRLEDEVEKIIRRLEKIAKEAEDRHRKLAEELRRIAEEAKR

SEQ ID NO: 13514 - protein, 59 aa, Artificial Sequence
  Synthetic sequence.
SVDEALEELVRRLLEVLKTVLERTKELSRDDLRVVKEVLRIIEELVKRLLKVIRDGLDD

SEQ ID NO: 13515 - protein, 59 aa, Artificial Sequence
  Synthetic sequence.
EDVRRDIERLLEELKRRVERLLEDIERLLRELEKLNEDVLRENKKLLEDLERRVRERKK

SEQ ID NO: 13516 - protein, 60 aa, Artificial Sequence
  Synthetic sequence.
DEERIVREIVKIIEEAVKELVRLVREDIELVKDVVRRHNRLNEEIVKLWKELVDEVLKSR

SEQ ID NO: 13517 - protein, 56 aa, Artificial Sequence
  Synthetic sequence.
KDLLRRAEEEIRRLLKENEDILKRVEEEVKKSNEELRRILDRVRRELEKALKRLRD

SEQ ID NO: 13518 - protein, 60 aa, Artificial Sequence
  Synthetic sequence.
SKEEEVKRLIDELKRVNERVNKTIKELVKLLEESHEEVLKEIERLIREVLRVIKEVIEAV

SEQ ID NO: 13519 - protein, 59 aa, Artificial Sequence
  Synthetic sequence.
KEALDKLVDAARRVLEAVRDVLRKDERSVERVLDEVRRVAEELERTHREVVKRVEDAAR

SEQ ID NO: 13520 - protein, 60 aa, Artificial Sequence
  Synthetic sequence.
DKEKTVADLIEKVERSHERVLKRLAELIEELKRVNERVNREIERLIRELEEVIDRVIKAV

SEQ ID NO: 13521 - protein, 59 aa, Artificial Sequence
  Synthetic sequence.
REMLEELVRVARRVLEAIKTVADELRKRHEEVSREIERVAEEDKRTVEEVLKRIEDAAR

SEQ ID NO: 13522 - protein, 60 aa, Artificial Sequence
  Synthetic sequence.
KDEEIIKRLEDLLKENVDRLREILERVERTHRKVIEELKRILEELEEILRRVIEKLRRKN

SEQ ID NO: 13523 - protein, 55 aa, Artificial Sequence
  Synthetic sequence.
RDVERLLKELKRIVEEILRLVRELVTRDIDALRRLLESVRRLVDKLIRIVEERRR

SEQ ID NO: 13524 - protein, 60 aa, Artificial Sequence
  Synthetic sequence.
SDKDRLLEEIKRLIDESRRKAEEILKRSTELLEDSKRDLREILRRSEKILDELLDLIRRN

SEQ ID NO: 13525 - protein, 60 aa, Artificial Sequence
  Synthetic sequence.
SKEIKDALRRVLEKHKKVLREAIKKHEESLEEHRKVLEEIIELHKRSLKKLEDVIDTVRK

SEQ ID NO: 13526 - protein, 60 aa, Artificial Sequence
  Synthetic sequence.
SKEELIKELKETVKRIIKLLEELSKKMEEIIKRIAELLRELSKKLVDIIKRIIELLRREG

SEQ ID NO: 13527 - protein, 55 aa, Artificial Sequence
  Synthetic sequence.
EEILKEIKRLLDESKERLDRVLREIEELLRRYEEEVRRVLEEIKKILDELRERIR

SEQ ID NO: 13528 - protein, 56 aa, Artificial Sequence
  Synthetic sequence.
DTERAADEARRRLEKLARDHKEKLKKAAEDLRRLLEEAERAHRKIEKELEELTRKV

SEQ ID NO: 13529 - protein, 57 aa, Artificial Sequence
  Synthetic sequence.
AERALKEAADRAREALRRNLRALREAVREAEEAIEKDARAIDEALKKAREAIEEAER

SEQ ID NO: 13530 - protein, 56 aa, Artificial Sequence
  Synthetic sequence.
SKVEELAERAARSHKELADAIRELAREAAESHKEAAEVVKRLADEAARAAKEVAKA

SEQ ID NO: 13531 - protein, 56 aa, Artificial Sequence
  Synthetic sequence.
RKVLEDAKKILEDLRKKAEDALRKHKKILDELEEKAKKAAEKHERILRKLDEDAKR

SEQ ID NO: 13532 - protein, 59 aa, Artificial Sequence
  Synthetic sequence.
SEDEEVLKDIKRLLEEVKKTLEEVAKRHEKALREIEERVKEIVKEHEDLLKEVEDKARS

SEQ ID NO: 13533 - protein, 60 aa, Artificial Sequence
  Synthetic sequence.
KEDLDRLLKEVLDISRKVLEEVLKIIKRVLEISKRVLEEILRRIEKVLRDIDRVLKKLRE

SEQ ID NO: 13534 - protein, 57 aa, Artificial Sequence
  Synthetic sequence.
SREEDLARKIAEAVKELLDADRRLLREIEKLAEELLRINEELLRRLEELARELLEAV

SEQ ID NO: 13535 - protein, 56 aa, Artificial Sequence
  Synthetic sequence.
ERLLRKLEEILRRLKDESRKVLKKVKEILDRLKRETEEILDKVRKILERLEEEVRR

SEQ ID NO: 13536 - protein, 59 aa, Artificial Sequence
  Synthetic sequence.
SAEEAAEEALRRAAEAAKESIKAAREALEEVRKAAEKSIRAAEKALRDVKKAAEEAKSA

SEQ ID NO: 13537 - protein, 57 aa, Artificial Sequence
  Synthetic sequence.
IEEAAKKAIDLARDHARLVKKIAKDLIDLAKEHADLVREIAKRIIEAAKRIAEIVRK

SEQ ID NO: 13538 - protein, 60 aa, Artificial Sequence
  Synthetic sequence.
SDEELLEEIKKILDEVLKKNADAVRSLEKVLDKVLEDNARAVEELKTVLDKVLRDLERRG

SEQ ID NO: 13539 - protein, 55 aa, Artificial Sequence
  Synthetic sequence.
KDVEEVVKEVRDVLRESVDKVRRVIEEVKRVLDRSSEEVERAVEEVKRVLDKVRK

SEQ ID NO: 13540 - protein, 61 aa, Artificial Sequence
  Synthetic sequence.
SDEELLERVERLLRELLDTNRRMLEEVEKELRRLLETNKKTLDDVRRLLKELLDVLETRGV

SEQ ID NO: 13541 - protein, 55 aa, Artificial Sequence
  Synthetic sequence.
DDLRELKKRIEDLLKEDKERLEKIARDIERDLERYARDLKRLEDELREDIERARR

SEQ ID NO: 13542 - protein, 61 aa, Artificial Sequence; identical to SEQ ID NO: 13540
  Synthetic sequence.

SEQ ID NO: 13543 - protein, 55 aa, Artificial Sequence; identical to SEQ ID NO: 13541
  Synthetic sequence.

SEQ ID NO: 13544 - protein, 56 aa, Artificial Sequence
  Synthetic sequence.
EEDERLTKRVEEIKRENRELLRRLEEEVKELERKSEKIVRDLKEKVDRAKEKLDSG

SEQ ID NO: 13545 - protein, 57 aa, Artificial Sequence; identical to SEQ ID NO: 12601
  Synthetic sequence.

SEQ ID NO: 13546 - protein, 56 aa, Artificial Sequence; identical to SEQ ID NO: 13544
  Synthetic sequence.

SEQ ID NO: 13547 - protein, 57 aa, Artificial Sequence; identical to SEQ ID NO: 12601
  Synthetic sequence.

SEQ ID NO: 13548 - protein, 58 aa, Artificial Sequence
  Synthetic sequence.
TEEEVLRKVEKLIKDLLDVLRDLLRASEEVVREALRVLEELIEENKRVIEELSRALSG

SEQ ID NO: 13549 - protein, 60 aa, Artificial Sequence
  Synthetic sequence.
EEKLRRDLTETKKELEKRHEDLRRELEKLLRDYKRELEEIERALEEIEKTLKRRADETRR

SEQ ID NO: 13550 - protein, 58 aa, Artificial Sequence; identical to SEQ ID NO: 13548
  Synthetic sequence.

SEQ ID NO: 13551 - protein, 60 aa, Artificial Sequence; identical to SEQ ID NO: 13549
  Synthetic sequence.

SEQ ID NO: 13552 - protein, 60 aa, Artificial Sequence
  Synthetic sequence.
SAKETIRKLIEENKDIIRKLAEKLKRLLEESERIAEEALRLIKELLERIERALRRVGSGI

SEQ ID NO: 13553 - protein, 55 aa, Artificial Sequence
  Synthetic sequence.
KELEKLLEDLEREIRRLAKRLKELSDRLEEKIRKIKRELDDLSARLREKIERTRK

SEQ ID NO: 13554 - protein, 60 aa, Artificial Sequence; identical to SEQ ID NO: 13552
  Synthetic sequence.

SEQ ID NO: 13555 - protein, 55 aa, Artificial Sequence; identical to SEQ ID NO: 13553
  Synthetic sequence.

SEQ ID NO: 13556 - protein, 59 aa, Artificial Sequence; identical to SEQ ID NO: 12644
  Synthetic sequence.

SEQ ID NO: 13557 - protein, 56 aa, Artificial Sequence; identical to SEQ ID NO: 12645
  Synthetic sequence.

SEQ ID NO: 13558 - protein, 59 aa, Artificial Sequence; identical to SEQ ID NO: 12644
  Synthetic sequence.

SEQ ID NO: 13559 - protein, 56 aa, Artificial Sequence; identical to SEQ ID NO: 12645
  Synthetic sequence.

SEQ ID NO: 13560 - protein, 60 aa, Artificial Sequence; identical to SEQ ID NO: 12646
  Synthetic sequence.

SEQ ID NO: 13561 - protein, 58 aa, Artificial Sequence
  Synthetic sequence.
EEIKRLKEELERRHRRLEEEVERVARELEKAHRDLERDIRRVAEELKKLLKKLRDDRR

SEQ ID NO: 13562 - protein, 60 aa, Artificial Sequence; identical to SEQ ID NO: 12646
  Synthetic sequence.

SEQ ID NO: 13563 - protein, 58 aa, Artificial Sequence; identical to SEQ ID NO: 13561
  Synthetic sequence.

SEQ ID NO: 13564 - protein, 60 aa, Artificial Sequence
  Synthetic sequence.
SAEETVERLLEEARKRHEEIIKKAKELLDRAREEHERIIREAEKLLEEIKKRVDELVRDG

SEQ ID NO: 13565 - protein, 56 aa, Artificial Sequence; identical to SEQ ID NO: 12651
  Synthetic sequence.

SEQ ID NO: 13566 - protein, 60 aa, Artificial Sequence; identical to SEQ ID NO: 13564
  Synthetic sequence.

SEQ ID NO: 13567 - protein, 56 aa, Artificial Sequence; identical to SEQ ID NO: 12651
  Synthetic sequence.

SEQ ID NO: 13568 - protein, 56 aa, Artificial Sequence
  Synthetic sequence.
SEKEELKRLLDKLLKELKRLSDELKATIDKILKILKEVSEEVKRTADELLDAIRRG

SEQ ID NO: 13569 - protein, 59 aa, Artificial Sequence
  Synthetic sequence.
EDELRKVEEDLKRLEDKLKKLLEDYEKKVRELEETLDDLLRKYEETLRRLEKELEEAER

SEQ ID NO: 13570 - protein, 56 aa, Artificial Sequence; identical to SEQ ID NO: 13568
  Synthetic sequence.

SEQ ID NO: 13571 - protein, 59 aa, Artificial Sequence; identical to SEQ ID NO: 13569
  Synthetic sequence.

SEQ ID NO: 13572 - protein, 60 aa, Artificial Sequence
  Synthetic sequence.
SDAERLVKKIADSLRAYEDLLRKLVERIRDLLRAYEEELRKLLTEIEKTLEDVRDVLRRG

SEQ ID NO: 13573 - protein, 58 aa, Artificial Sequence
  Synthetic sequence.
DLLEALRRLVERLKRLIERVLKLNRELVKKLLELLEEALRANRRLVEDILKIADEARK

SEQ ID NO: 13574 - protein, 60 aa, Artificial Sequence; identical to SEQ ID NO: 13572
  Synthetic sequence.

SEQ ID NO: 13575 - protein, 58 aa, Artificial Sequence; identical to SEQ ID NO: 13573
  Synthetic sequence.

SEQ ID NO: 13576 - protein, 59 aa, Artificial Sequence
  Synthetic sequence.
SATERVLDLARDLIRILLEIHKRALKLIAELVSKLLKIHEDVLKLSEELVEELLEIVKR

SEQ ID NO: 13577 - protein, 60 aa, Artificial Sequence
  Synthetic sequence.
EDTLRRVLERIREEVERVKEKHRRLLEELKKLLEELRARSADLLEDIKRKVRELEEKTRR

SEQ ID NO: 13578 - protein, 59 aa, Artificial Sequence; identical to SEQ ID NO: 13576
  Synthetic sequence.

SEQ ID NO: 13579 - protein, 60 aa, Artificial Sequence; identical to SEQ ID NO: 13577
  Synthetic sequence.

SEQ ID NO: 13580 - protein, 56 aa, Artificial Sequence; identical to SEQ ID NO: 12674
  Synthetic sequence.

SEQ ID NO: 13581 - protein, 60 aa, Artificial Sequence
  Synthetic sequence.
RERLARLLKALADKLIRVLEEILKINEELNRKIIKFARENLERNRRVNKKVIEVLREAAR

SEQ ID NO: 13582 - protein, 56 aa, Artificial Sequence; identical to SEQ ID NO: 12674
  Synthetic sequence.

SEQ ID NO: 13583 - protein, 60 aa, Artificial Sequence; identical to SEQ ID NO: 13581
  Synthetic sequence.

SEQ ID NO: 13584 - protein, 61 aa, Artificial Sequence
  Synthetic sequence.
STEEILKRVKEILDELAKELRDIIRESLRTIEELLDELRRILEESERTLEELVKTIKDGVK

SEQ ID NO: 13585 - protein, 59 aa, Artificial Sequence; identical to SEQ ID NO: 12683
  Synthetic sequence.

SEQ ID NO: 13586 - protein, 61 aa, Artificial Sequence; identical to SEQ ID NO: 13584
  Synthetic sequence.

SEQ ID NO: 13587 - protein, 59 aa, Artificial Sequence; identical to SEQ ID NO: 12683
  Synthetic sequence.

SEQ ID NO: 13588 - protein, 60 aa, Artificial Sequence
  Synthetic sequence.
SEKEELLKLIKRVIELLKRVLEEHLRLVEDVIRRLKELLDSNEKIVREVIEDLKRLLDEV

SEQ ID NO: 13589 - protein, 59 aa, Artificial Sequence
  Synthetic sequence.
EDLLRKAKKVITEVREKLKRNLEDVRRVIEDVKRKSARILEEARRLIEEVERELEKIRK

SEQ ID NO: 13590 - protein, 60 aa, Artificial Sequence; identical to SEQ ID NO: 13588
  Synthetic sequence.

SEQ ID NO: 13591 - protein, 59 aa, Artificial Sequence; identical to SEQ ID NO: 13589
  Synthetic sequence.

SEQ ID NO: 13592 - protein, 57 aa, Artificial Sequence
  Synthetic sequence.
SRAERIKRALEEHIRKLKEITDEVRKTNEELLELTRRILEEAKKANEELVKKIREAG

SEQ ID NO: 13593 - protein, 56 aa, Artificial Sequence; identical to SEQ ID NO: 12693
  Synthetic sequence.

SEQ ID NO: 13594 - protein, 57 aa, Artificial Sequence; identical to SEQ ID NO: 13592
  Synthetic sequence.

SEQ ID NO: 13595 - protein, 56 aa, Artificial Sequence; identical to SEQ ID NO: 12693
  Synthetic sequence.

SEQ ID NO: 13596 - protein, 57 aa, Artificial Sequence
  Synthetic sequence.
SEAEKIREALETNLRLLEELIKRLKEILDTHNELLRRVIETLERLLKELLELLEEGG

SEQ ID NO: 13597 - protein, 56 aa, Artificial Sequence
  Synthetic sequence.
KEDLERLRRKVEELEDRLRRLLEKLARDSAELMRELERILDRYARESEELDRRLAE

SEQ ID NO: 13598 - protein, 57 aa, Artificial Sequence; identical to SEQ ID NO: 13596
  Synthetic sequence.

SEQ ID NO: 13599 - protein, 56 aa, Artificial Sequence; identical to SEQ ID NO: 13597
  Synthetic sequence.

SEQ ID NO: 13600 - protein, 62 aa, Artificial Sequence
  Synthetic sequence.
SAEEELEKLVRKVEEDLKRLEEESERIKKEIKDTLRAIRKRSEDLKRKVKELLRRLEEEGRR

SEQ ID NO: 13601 - protein, 60 aa, Artificial Sequence
  Synthetic sequence.
ADEALEMLKRLLDKALKVHEDVLRKLVELVDEVLKVHEESLRKLLTLAAKVLEVLRKITK

SEQ ID NO: 13602 - protein, 62 aa, Artificial Sequence; identical to SEQ ID NO: 13600
  Synthetic sequence.

SEQ ID NO: 13603 - protein, 60 aa, Artificial Sequence; identical to SEQ ID NO: 13601
  Synthetic sequence.

SEQ ID NO: 13604 - protein, 60 aa, Artificial Sequence
  Synthetic sequence.
DDERRKLEDLERMVEELKRKSDKLLKEIREEVERLERETRKLLEELKAKVDELREDLRRN

SEQ ID NO: 13605 - protein, 55 aa, Artificial Sequence
  Synthetic sequence.
EDLEKAERLVKDILRLNEEHTAELEDVVRDLLRALEKHTRDLEKLVKDALDKVKT

SEQ ID NO: 13606 - protein, 60 aa, Artificial Sequence; identical to SEQ ID NO: 13604
  Synthetic sequence.

SEQ ID NO: 13607 - protein, 55 aa, Artificial Sequence; identical to SEQ ID NO: 13605
  Synthetic sequence.

SEQ ID NO: 13608 - protein, 62 aa, Artificial Sequence
  Synthetic sequence.
SKIDEALKKLAKILEDAIKLNKELNDTTAEILKEIIKLNAEVLEKIRRILKELVDLILKGLK

SEQ ID NO: 13609 - protein, 55 aa, Artificial Sequence; identical to SEQ ID NO: 12719
  Synthetic sequence.

SEQ ID NO: 13610 - protein, 62 aa, Artificial Sequence; identical to SEQ ID NO: 13608
  Synthetic sequence.

SEQ ID NO: 13611 - protein, 55 aa, Artificial Sequence; identical to SEQ ID NO: 12719
  Synthetic sequence.

SEQ ID NO: 13612 - protein, 59 aa, Artificial Sequence; identical to SEQ ID NO: 12724
  Synthetic sequence.

SEQ ID NO: 13613 - protein, 60 aa, Artificial Sequence
  Synthetic sequence.
KETLARDLKEALKTLIKLIREILEDNLRVLRRIIELIETLLEDNRRVLEEIIKLIEEATT

SEQ ID NO: 13614 - protein, 60 aa, Artificial Sequence
  Synthetic sequence.
DEEEKIREDLERTLREYERELRRAKEELKETLKRYEEELREVKEDLDRTLEEVDDLLRRG

SEQ ID NO: 13615 - protein, 60 aa, Artificial Sequence; identical to SEQ ID NO: 13613
  Synthetic sequence.

SEQ ID NO: 13616 - protein, 58 aa, Artificial Sequence
  Synthetic sequence.
DELEKVERLLEEIEKIIEDLIRRVEELVRRILEFNKTTLKRNEELVRELEKLVKETTG

SEQ ID NO: 13617 - protein, 59 aa, Artificial Sequence; identical to SEQ ID NO: 12729
  Synthetic sequence.

SEQ ID NO: 13618 - protein, 58 aa, Artificial Sequence; identical to SEQ ID NO: 13616
  Synthetic sequence.

SEQ ID NO: 13619 - protein, 59 aa, Artificial Sequence; identical to SEQ ID NO: 12729
  Synthetic sequence.

SEQ ID NO: 13620 - protein, 56 aa, Artificial Sequence
  Synthetic sequence.
SEKERLMRLLDKLKDLNRRLVERIKELLDKALELHKKLVKELRELLERLKELVERG

SEQ ID NO: 13621 - protein, 59 aa, Artificial Sequence
  Synthetic sequence.
EETVRRLREALKKLEDDLRKIERDAEREYKKLKDELEELTERYRREIRKLKEELKADRK

SEQ ID NO: 13622 - protein, 56 aa, Artificial Sequence; identical to SEQ ID NO: 13620
  Synthetic sequence.

SEQ ID NO: 13623 - protein, 59 aa, Artificial Sequence; identical to SEQ ID NO: 13621
  Synthetic sequence.

SEQ ID NO: 13624 - protein, 56 aa, Artificial Sequence
  Synthetic sequence.
SEAEDLEELIKELAELLKDVIRKLEKINRRLVKILEDIIRRLKEISKEAEEELRKG

SEQ ID NO: 13625 - protein, 59 aa, Artificial Sequence; identical to SEQ ID NO: 12737
  Synthetic sequence.

SEQ ID NO: 13626 - protein, 56 aa, Artificial Sequence; identical to SEQ ID NO: 13624
  Synthetic sequence.

SEQ ID NO: 13627 - protein, 59 aa, Artificial Sequence; identical to SEQ ID NO: 12737
  Synthetic sequence.

SEQ ID NO: 13628 - protein, 60 aa, Artificial Sequence; identical to SEQ ID NO: 12742
  Synthetic sequence.

SEQ ID NO: 13629 - protein, 60 aa, Artificial Sequence; identical to SEQ ID NO: 12743
  Synthetic sequence.

SEQ ID NO: 13630 - protein, 60 aa, Artificial Sequence; identical to SEQ ID NO: 12742
  Synthetic sequence.

SEQ ID NO: 13631 - protein, 60 aa, Artificial Sequence; identical to SEQ ID NO: 12743
  Synthetic sequence.

SEQ ID NO: 13632 - protein, 60 aa, Artificial Sequence; identical to SEQ ID NO: 12744
  Synthetic sequence.

SEQ ID NO: 13633 - protein, 59 aa, Artificial Sequence; identical to SEQ ID NO: 12745
  Synthetic sequence.

SEQ ID NO: 13634 - protein, 60 aa, Artificial Sequence; identical to SEQ ID NO: 12744
  Synthetic sequence.

SEQ ID NO: 13635 - protein, 59 aa, Artificial Sequence; identical to SEQ ID NO: 12745
  Synthetic sequence.

SEQ ID NO: 13636 - protein, 60 aa, Artificial Sequence
  Synthetic sequence.
DEDRIIEEIARLLEELLRELLELIKKLIETNRRLNEEHERAVRELARLLEELLDRLVKKG

SEQ ID NO: 13637 - protein, 59 aa, Artificial Sequence
  Synthetic sequence.
EKIAEEIERELEELRRMIKRLHEDLERKLKESEDELREIEARLEEKIRRLEEKLERKRR

SEQ ID NO: 13638 - protein, 60 aa, Artificial Sequence; identical to SEQ ID NO: 13636
  Synthetic sequence.

SEQ ID NO: 13639 - protein, 59 aa, Artificial Sequence; identical to SEQ ID NO: 13637
  Synthetic sequence.

SEQ ID NO: 13640 - protein, 59 aa, Artificial Sequence
  Synthetic sequence.
DEEEKIRTTLDLLRKLLKVLREILEELIRSNKELNERLLRLVEDSDRLLEELLKKLADD

SEQ ID NO: 13641 - protein, 59 aa, Artificial Sequence
  Synthetic sequence.
EEKVRDTEKKLRDLREKHAEIAKELERLLRENRRRLEELAREAKKVLDELRKRLEDERR

SEQ ID NO: 13642 - protein, 59 aa, Artificial Sequence; identical to SEQ ID NO: 13640
  Synthetic sequence.

SEQ ID NO: 13643 - protein, 59 aa, Artificial Sequence; identical to SEQ ID NO: 13641
  Synthetic sequence.

SEQ ID NO: 13644 - protein, 59 aa, Artificial Sequence
  Synthetic sequence.
SEKEKLLKESEEEVRRLRRTLEELLRKYREVLERLRKELREIEERVRDVVRRLKEVLDR

SEQ ID NO: 13645 - protein, 56 aa, Artificial Sequence
  Synthetic sequence.
ERLVKTLIEDVEAVIKRILELITRVAEDNERVLERIIRELTDNLERHLKIVREIVK

SEQ ID NO: 13646 - protein, 59 aa, Artificial Sequence; identical to SEQ ID NO: 13644
  Synthetic sequence.

SEQ ID NO: 13647 - protein, 56 aa, Artificial Sequence; identical to SEQ ID NO: 13645
  Synthetic sequence.

SEQ ID NO: 13648 - protein, 60 aa, Artificial Sequence
  Synthetic sequence.
SELERAEELIKKLLKLHEDVLRRLTEVDDELLEIHDRVLKRLKEVDDELLKLIRDMLRRG

SEQ ID NO: 13649 - protein, 58 aa, Artificial Sequence; identical to SEQ ID NO: 12791
  Synthetic sequence.

SEQ ID NO: 13650 - protein, 60 aa, Artificial Sequence; identical to SEQ ID NO: 13648
  Synthetic sequence.

SEQ ID NO: 13651 - protein, 58 aa, Artificial Sequence; identical to SEQ ID NO: 12791
  Synthetic sequence.

SEQ ID NO: 13652 - protein, 59 aa, Artificial Sequence; identical to SEQ ID NO: 12798
  Synthetic sequence.

SEQ ID NO: 13653 - protein, 55 aa, Artificial Sequence
  Synthetic sequence.
REIEKEIRRILEELKAKHDEIEKKIRELEREIKRAHEELEDRIRKIERDLDRRTK

SEQ ID NO: 13654 - protein, 59 aa, Artificial Sequence; identical to SEQ ID NO: 12798
  Synthetic sequence.

SEQ ID NO: 13655 - protein, 55 aa, Artificial Sequence; identical to SEQ ID NO: 13653
  Synthetic sequence.

SEQ ID NO: 13656 - protein, 60 aa, Artificial Sequence
  Synthetic sequence.
SSEELLKRIVDEDERVLEEWARVLEEIKDLSKAVVDLLDKVLKEIEAIVDEVTRRLERDG

SEQ ID NO: 13657 - protein, 55 aa, Artificial Sequence
  Synthetic sequence.
KDLLETIKKRVEEIRRTLEKIKRDYDKAIEEIRAKLERKLEEYKEVIDDLRRKTK

SEQ ID NO: 13658 - protein, 60 aa, Artificial Sequence; identical to SEQ ID NO: 13656
  Synthetic sequence.

SEQ ID NO: 13659 - protein, 55 aa, Artificial Sequence; identical to SEQ ID NO: 13657
  Synthetic sequence.

SEQ ID NO: 13660 - protein, 59 aa, Artificial Sequence; identical to SEQ ID NO: 12820
  Synthetic sequence.

SEQ ID NO: 13661 - protein, 56 aa, Artificial Sequence; identical to SEQ ID NO: 12821
  Synthetic sequence.

SEQ ID NO: 13662 - protein, 59 aa, Artificial Sequence; identical to SEQ ID NO: 12820
  Synthetic sequence.

SEQ ID NO: 13663 - protein, 56 aa, Artificial Sequence; identical to SEQ ID NO: 12821
  Synthetic sequence.

SEQ ID NO: 13664 - protein, 56 aa, Artificial Sequence
  Synthetic sequence.
DKAEVLREALKLLKDLLEELIKIHEESLKRILDLIDTLVKVHEDALRALKELLERS

SEQ ID NO: 13665 - protein, 55 aa, Artificial Sequence; identical to SEQ ID NO: 12827
  Synthetic sequence.

SEQ ID NO: 13666 - protein, 56 aa, Artificial Sequence; identical to SEQ ID NO: 13664
  Synthetic sequence.

SEQ ID NO: 13667 - protein, 55 aa, Artificial Sequence; identical to SEQ ID NO: 12827
  Synthetic sequence.

SEQ ID NO: 13668 - protein, 56 aa, Artificial Sequence
  Synthetic sequence.
STREKAKKVLDTLRADNEDMKRVVEKILRALKRTNERAEKLAREITEEIKRILKEV

SEQ ID NO: 13669 - protein, 56 aa, Artificial Sequence; identical to SEQ ID NO: 12831
  Synthetic sequence.

SEQ ID NO: 13670 - protein, 56 aa, Artificial Sequence; identical to SEQ ID NO: 13668
  Synthetic sequence.

SEQ ID NO: 13671 - protein, 56 aa, Artificial Sequence; identical to SEQ ID NO: 12831
  Synthetic sequence.

SEQ ID NO: 13672 - protein, 56 aa, Artificial Sequence
  Synthetic sequence.
SKAEKLLKDLREALEKVKRRYEELERRLDEVLKEHEEIVKRLLEELEKVLKRIEEG

SEQ ID NO: 13673 - protein, 59 aa, Artificial Sequence; identical to SEQ ID NO: 12845
  Synthetic sequence.

SEQ ID NO: 13674 - protein, 56 aa, Artificial Sequence; identical to SEQ ID NO: 13672
  Synthetic sequence.

SEQ ID NO: 13675 - protein, 59 aa, Artificial Sequence; identical to SEQ ID NO: 12845
  Synthetic sequence.

SEQ ID NO: 13676 - protein, 57 aa, Artificial Sequence; identical to SEQ ID NO: 12846
  Synthetic sequence.

SEQ ID NO: 13677 - protein, 59 aa, Artificial Sequence
  Synthetic sequence.
EDLLTELEKKLRKLKRDSEKVVDDLKKELERIKREVKRLIEENARTLADIKRAVDEARK

SEQ ID NO: 13678 - protein, 57 aa, Artificial Sequence; identical to SEQ ID NO: 12846
  Synthetic sequence.

SEQ ID NO: 13679 - protein, 59 aa, Artificial Sequence; identical to SEQ ID NO: 13677
  Synthetic sequence.

SEQ ID NO: 13680 - protein, 56 aa, Artificial Sequence; identical to SEQ ID NO: 12854
  Synthetic sequence.

SEQ ID NO: 13681 - protein, 59 aa, Artificial Sequence
  Synthetic sequence.
DDERRTLTELLKRMEDILEKVERTLKKLLDDSARMAEEVKKTLKELLERSEKVAEDVRK

SEQ ID NO: 13682 - protein, 56 aa, Artificial Sequence; identical to SEQ ID NO: 12854
  Synthetic sequence.

SEQ ID NO: 13683 - protein, 59 aa, Artificial Sequence; identical to SEQ ID NO: 13681
  Synthetic sequence.

SEQ ID NO: 13684 - protein, 56 aa, Artificial Sequence; identical to SEQ ID NO: 12858
  Synthetic sequence.

SEQ ID NO: 13685 - protein, 59 aa, Artificial Sequence; identical to SEQ ID NO: 12859
  Synthetic sequence.

SEQ ID NO: 13686 - protein, 56 aa, Artificial Sequence; identical to SEQ ID NO: 12858
  Synthetic sequence.

SEQ ID NO: 13687 - protein, 59 aa, Artificial Sequence; identical to SEQ ID NO: 12859
  Synthetic sequence.

SEQ ID NO: 13688 - protein, 60 aa, Artificial Sequence
  Synthetic sequence.
SKKELLEEVVRRAIELLKRHLEKLKRILEEIVRLLEEHLEKVERVLEAILSLLDDLLRRG

SEQ ID NO: 13689 - protein, 56 aa, Artificial Sequence
  Synthetic sequence.
EDKLKEIEDELRRLLEELRRLDKAIKDRLRELKKDLDEANRRIKETLKKLLREVEK

SEQ ID NO: 13690 - protein, 60 aa, Artificial Sequence; identical to SEQ ID NO: 13688
  Synthetic sequence.

SEQ ID NO: 13691 - protein, 56 aa, Artificial Sequence; identical to SEQ ID NO: 13689
  Synthetic sequence.

SEQ ID NO: 13692 - protein, 56 aa, Artificial Sequence
  Synthetic sequence.
SDLEELEALIRRLLKINEDLIRIIEDLIRKSLTLLKRIVDLIRELIREIEEIIRRT

SEQ ID NO: 13693 - protein, 55 aa, Artificial Sequence; identical to SEQ ID NO: 12883
  Synthetic sequence.

SEQ ID NO: 13694 - protein, 56 aa, Artificial Sequence; identical to SEQ ID NO: 13692
  Synthetic sequence.

SEQ ID NO: 13695 - protein, 55 aa, Artificial Sequence; identical to SEQ ID NO: 12883
  Synthetic sequence.

SEQ ID NO: 13696 - protein, 60 aa, Artificial Sequence
  Synthetic sequence.
SERDVLRELLERIKKLLETLIRIVEELVRRSEETIKRLAELNRRLIEEIRRIVEEVKKGV

SEQ ID NO: 13697 - protein, 55 aa, Artificial Sequence; identical to SEQ ID NO: 12909
  Synthetic sequence.

SEQ ID NO: 13698 - protein, 60 aa, Artificial Sequence; identical to SEQ ID NO: 13696
  Synthetic sequence.

SEQ ID NO: 13699 - protein, 55 aa, Artificial Sequence; identical to SEQ ID NO: 12909
  Synthetic sequence.

SEQ ID NO: 13700 - protein, 58 aa, Artificial Sequence
  Synthetic sequence.
SKEELVKEIDELNKRVNDLLEELLRKSEKLHKEILELLERLLREIISLLRRILEIVER

SEQ ID NO: 13701 - protein, 56 aa, Artificial Sequence
  Synthetic sequence.
EDELRRLLEDIERKIEALLRELKKESEEIRKRIRELLEDNRDKSRKIKKAIEELKK

SEQ ID NO: 13702 - protein, 58 aa, Artificial Sequence; identical to SEQ ID NO: 13700
  Synthetic sequence.

SEQ ID NO: 13703 - protein, 56 aa, Artificial Sequence; identical to SEQ ID NO: 13701
  Synthetic sequence.

SEQ ID NO: 13704 - protein, 60 aa, Artificial Sequence
  Synthetic sequence.
KEIEETLKELEDLNREMVETNRRVLEETRRLNKETVDRVKATLDELAKMLKKLVDDVRKG

SEQ ID NO: 13705 - protein, 55 aa, Artificial Sequence
  Synthetic sequence.
KAVEELEKALEEIKRRLKEVIDRYEDELRKLRKEYKEKIDKYERKLEEIERRERT

SEQ ID NO: 13706 - protein, 60 aa, Artificial Sequence; identical to SEQ ID NO: 13704
  Synthetic sequence.

SEQ ID NO: 13707 - protein, 55 aa, Artificial Sequence; identical to SEQ ID NO: 13705
  Synthetic sequence.

SEQ ID NO: 13708 - protein, 56 aa, Artificial Sequence; identical to SEQ ID NO: 12994
  Synthetic sequence.

SEQ ID NO: 13709 - protein, 56 aa, Artificial Sequence
  Synthetic sequence.
EDVVRALIEVIERLLRVAEEVIRRILKVNTELMRVDERSIRESLKAISEVLKVLDT

SEQ ID NO: 13710 - protein, 56 aa, Artificial Sequence; identical to SEQ ID NO: 12994
  Synthetic sequence.

SEQ ID NO: 13711 - protein, 56 aa, Artificial Sequence; identical to SEQ ID NO: 13709
  Synthetic sequence.

SEQ ID NO: 13712 - protein, 60 aa, Artificial Sequence
  Synthetic sequence.
DEDELIRKLLEDLKDIVRKILELIERDLRDIERVVRRIVKVIRDDLKKIKEVVDDIARGV

SEQ ID NO: 13713 - protein, 59 aa, Artificial Sequence
  Synthetic sequence.
SELADRIRKLIEDLERHTAKVLEDVKRAITELRKNSKDILEEVRKLIDELRKRIKEVED

SEQ ID NO: 13714 - protein, 60 aa, Artificial Sequence; identical to SEQ ID NO: 13712
  Synthetic sequence.

SEQ ID NO: 13715 - protein, 59 aa, Artificial Sequence; identical to SEQ ID NO: 13713
  Synthetic sequence.

SEQ ID NO: 13716 - protein, 59 aa, Artificial Sequence
  Synthetic sequence.
RDRDVLRKVKAEIEELVARIEKVSRDALSEVKRLLDENRKIAEDVLRLIESLLRKIRDT

SEQ ID NO: 13717 - protein, 59 aa, Artificial Sequence
  Synthetic sequence.
EEVVEELLRMLKRVAEEMKRVHDDLSRAVEKVVRDVVRVDKELLDELARILRRLEEVIT

SEQ ID NO: 13718 - protein, 59 aa, Artificial Sequence; identical to SEQ ID NO: 13716
  Synthetic sequence.

SEQ ID NO: 13719 - protein, 59 aa, Artificial Sequence; identical to SEQ ID NO: 13717
  Synthetic sequence.

SEQ ID NO: 13720 - protein, 56 aa, Artificial Sequence
  Synthetic sequence.
SKDEELARLLEELVERWRKIVEDLERDHRRLVKEIRELVERIRKKLEELVDRIRKN

SEQ ID NO: 13721 - protein, 58 aa, Artificial Sequence
  Synthetic sequence.
EEIRRILEELKRIVDDVLRIIARILKLLRDLTRRLAEVAKAVHKLLEELLRKLKEDTR

SEQ ID NO: 13722 - protein, 56 aa, Artificial Sequence; identical to SEQ ID NO: 13720
  Synthetic sequence.

SEQ ID NO: 13723 - protein, 58 aa, Artificial Sequence; identical to SEQ ID NO: 13721
  Synthetic sequence.

SEQ ID NO: 13724 - protein, 56 aa, Artificial Sequence
  Synthetic sequence.
SAAETVKRLAEESSERIRKIVEDDKRVADDSSRKIKELIEEIKRRVKELLDRIKGL

SEQ ID NO: 13725 - protein, 56 aa, Artificial Sequence
  Synthetic sequence.
KEAVIRLIEELVKLLEDVLRRLLEVNETLVELNKRVWDRLVRINEELAEVALRVAT

SEQ ID NO: 13726 - protein, 56 aa, Artificial Sequence; identical to SEQ ID NO: 13724
  Synthetic sequence.

SEQ ID NO: 13727 - protein, 56 aa, Artificial Sequence; identical to SEQ ID NO: 13725
  Synthetic sequence.

SEQ ID NO: 13728 - protein, 56 aa, Artificial Sequence
  Synthetic sequence.
SALETVKKLLEDSSEKIERIVEEDERVAKESSDRIRRLVEEDKRVADEILDLIEKI

SEQ ID NO: 13729 - protein, 56 aa, Artificial Sequence
  Synthetic sequence.
AEAVIKVIEKLIRANKRVWDALLKINEDLVRVNKTVWKELLRVNEKLARDLERVVK

SEQ ID NO: 13730 - protein, 56 aa, Artificial Sequence; identical to SEQ ID NO: 13728
  Synthetic sequence.

SEQ ID NO: 13731 - protein, 56 aa, Artificial Sequence; identical to SEQ ID NO: 13729
  Synthetic sequence.

SEQ ID NO: 13732 - protein, 60 aa, Artificial Sequence
  Synthetic sequence.
DEIETVLKRLAELIKESLDLLRETLDELRKIIEESKKSLEDVLRRLKELIDRLRRLAKEG

SEQ ID NO: 13733 - protein, 60 aa, Artificial Sequence
  Synthetic sequence.
ADELLRRVEEILKRLLELIRRIIEEHRKILERLLETHEDLIRKHEEILRRLLKAADEERQ

SEQ ID NO: 13734 - protein, 60 aa, Artificial Sequence; identical to SEQ ID NO: 13732
  Synthetic sequence.

SEQ ID NO: 13735 - protein, 60 aa, Artificial Sequence; identical to SEQ ID NO: 13733
  Synthetic sequence.

SEQ ID NO: 13736 - protein, 57 aa, Artificial Sequence
  Synthetic sequence.
SKEEKLKDDVRAVLEDLDRVLKELEKLSEDNLRELKRVLDRITDLHRRILDELRKGI

SEQ ID NO: 13737 - protein, 59 aa, Artificial Sequence
  Synthetic sequence.
SKAAEDILRVLEKLVKVSREAIKLILELSEHHVRVSTRIARLLLDVARKLAEVIKEAER

SEQ ID NO: 13738 - protein, 57 aa, Artificial Sequence; identical to SEQ ID NO: 13736
  Synthetic sequence.

SEQ ID NO: 13739 - protein, 59 aa, Artificial Sequence; identical to SEQ ID NO: 13737
  Synthetic sequence.

SEQ ID NO: 13740 - protein, 61 aa, Artificial Sequence
  Synthetic sequence.
SEIEDVIRRLRKILEDLERVSEKLLREIKKILDEARRLNEEVIKEIKRVLEDAVRVFRDGS

SEQ ID NO: 13741 - protein, 56 aa, Artificial Sequence; identical to SEQ ID NO: 13083
  Synthetic sequence.

SEQ ID NO: 13742 - protein, 60 aa, Artificial Sequence
  Synthetic sequence.
SEIEDVIRRLRKILEDLERVSEKLLREIKKILDEARRLNEEVIKEIKRVLEDAVRVFRDG

SEQ ID NO: 13743 - protein, 56 aa, Artificial Sequence; identical to SEQ ID NO: 13083
  Synthetic sequence.

SEQ ID NO: 13744 - protein, 60 aa, Artificial Sequence
  Synthetic sequence.
SREEIVATLEDLARKILEVVKKLAKEIEDAWREIERAVREILKRLEELWREIEDVVRKKV

SEQ ID NO: 13745 - protein, 59 aa, Artificial Sequence
  Synthetic sequence.
EEAVKELVELLEEILERNTRVIKEIIDLLRTVIRIHEKIVEDLIKLLEELLRRLEEATR

SEQ ID NO: 13746 - protein, 60 aa, Artificial Sequence; identical to SEQ ID NO: 13744
  Synthetic sequence.

SEQ ID NO: 13747 - protein, 59 aa, Artificial Sequence; identical to SEQ ID NO: 13745
  Synthetic sequence.

SEQ ID NO: 13748 - protein, 58 aa, Artificial Sequence; identical to SEQ ID NO: 13086
  Synthetic sequence.

SEQ ID NO: 13749 - protein, 59 aa, Artificial Sequence; identical to SEQ ID NO: 13087
  Synthetic sequence.

SEQ ID NO: 13750 - protein, 58 aa, Artificial Sequence; identical to SEQ ID NO: 13086
  Synthetic sequence.

SEQ ID NO: 13751 - protein, 59 aa, Artificial Sequence; identical to SEQ ID NO: 13087
  Synthetic sequence.

SEQ ID NO: 13752 - protein, 55 aa, Artificial Sequence
  Synthetic sequence.
SKEERLREVAEKHKKDLEDIVKRVDEAAKETARRLEEILKRLEEVLKKILDDLEK

SEQ ID NO: 13753 - protein, 55 aa, Artificial Sequence; identical to SEQ ID NO: 13097
  Synthetic sequence.

SEQ ID NO: 13754 - protein, 55 aa, Artificial Sequence; identical to SEQ ID NO: 13752
  Synthetic sequence.

SEQ ID NO: 13755 - protein, 55 aa, Artificial Sequence; identical to SEQ ID NO: 13097
  Synthetic sequence.

SEQ ID NO: 13756 - protein, 56 aa, Artificial Sequence; identical to SEQ ID NO: 13122
  Synthetic sequence.

SEQ ID NO: 13757 - protein, 62 aa, Artificial Sequence
  Synthetic sequence.
EDAVRKIAKIIEELKRLLEDLARDTRRVIEEAKRLLKEWRDRNKEVADTLKKLLEDLIRKIR

SEQ ID NO: 13758 - protein, 56 aa, Artificial Sequence; identical to SEQ ID NO: 13122
  Synthetic sequence.

SEQ ID NO: 13759 - protein, 62 aa, Artificial Sequence; identical to SEQ ID NO: 13757
  Synthetic sequence.

SEQ ID NO: 13760 - protein, 61 aa, Artificial Sequence
  Synthetic sequence.
SEDELLEKIVRKLAEAVKRIEEELRKSKREIERLVKEIKEKLEDSLARVKETLDRIRETRK

SEQ ID NO: 13761 - protein, 56 aa, Artificial Sequence
  Synthetic sequence.
LEELLRLLKEVIERSIESLERLLELILRVLEYSVASLEELLRRLLEVIKRIVDTTK

SEQ ID NO: 13762 - protein, 61 aa, Artificial Sequence; identical to SEQ ID NO: 13760
  Synthetic sequence.

SEQ ID NO: 13763 - protein, 56 aa, Artificial Sequence; identical to SEQ ID NO: 13761
  Synthetic sequence.

SEQ ID NO: 13764 - protein, 59 aa, Artificial Sequence
  Synthetic sequence.
DEDEIAEELKRLLREVEEASKEIVRRMRELAREANKASEDILRTLEKLLEELRRRVEES

SEQ ID NO: 13765 - protein, 56 aa, Artificial Sequence; identical to SEQ ID NO: 13135
  Synthetic sequence.

SEQ ID NO: 13766 - protein, 59 aa, Artificial Sequence; identical to SEQ ID NO: 13764
  Synthetic sequence.

SEQ ID NO: 13767 - protein, 56 aa, Artificial Sequence; identical to SEQ ID NO: 13135
  Synthetic sequence.

SEQ ID NO: 13768 - protein, 60 aa, Artificial Sequence
  Synthetic sequence.
DAEEKAKKIEDVARRYAEEVKRVLDDLERLLRESEEEVERIVRKLEKLARDLEERVREGT

SEQ ID NO: 13769 - protein, 59 aa, Artificial Sequence; identical to SEQ ID NO: 13157
  Synthetic sequence.

SEQ ID NO: 13770 - protein, 60 aa, Artificial Sequence; identical to SEQ ID NO: 13768
  Synthetic sequence.

SEQ ID NO: 13771 - protein, 59 aa, Artificial Sequence; identical to SEQ ID NO: 13157
  Synthetic sequence.

SEQ ID NO: 13772 - protein, 59 aa, Artificial Sequence; identical to SEQ ID NO: 13190
  Synthetic sequence.

SEQ ID NO: 13773 - protein, 55 aa, Artificial Sequence
  Synthetic sequence.
EEALDDLRRLVKELADKLRKLLKDYKDLLKELKDEAKKLLDDYARLIEELEKKAR

SEQ ID NO: 13774 - protein, 59 aa, Artificial Sequence; identical to SEQ ID NO: 13190
  Synthetic sequence.

SEQ ID NO: 13775 - protein, 55 aa, Artificial Sequence; identical to SEQ ID NO: 13773
  Synthetic sequence.

SEQ ID NO: 13776 - protein, 60 aa, Artificial Sequence
  Synthetic sequence.
SREELLDRILEAIAKILEDLKRLIDENLARLEEVVRELERIIDRNLKLIREILDELKKGS

SEQ ID NO: 13777 - protein, 59 aa, Artificial Sequence; identical to SEQ ID NO: 13199
  Synthetic sequence.

SEQ ID NO: 13778 - protein, 60 aa, Artificial Sequence; identical to SEQ ID NO: 13776
  Synthetic sequence.

SEQ ID NO: 13779 - protein, 59 aa, Artificial Sequence; identical to SEQ ID NO: 13199
  Synthetic sequence.

SEQ ID NO: 13780 - protein, 61 aa, Artificial Sequence; identical to SEQ ID NO: 13200
  Synthetic sequence.

SEQ ID NO: 13781 - protein, 60 aa, Artificial Sequence; identical to SEQ ID NO: 13201
  Synthetic sequence.

SEQ ID NO: 13782 - protein, 61 aa, Artificial Sequence; identical to SEQ ID NO: 13200
  Synthetic sequence.

SEQ ID NO: 13783 - protein, 60 aa, Artificial Sequence; identical to SEQ ID NO: 13201
  Synthetic sequence.

SEQ ID NO: 13784 - protein, 60 aa, Artificial Sequence
  Synthetic sequence.
DREKSVRDIEEDLKRVLDKLRRRVETSKEELKKVLKADKENADELEKTLRDVVRELDRGI

SEQ ID NO: 13785 - protein, 56 aa, Artificial Sequence
  Synthetic sequence.
SEVAKELDEVIKRLLDNLKENTDRLKEVIDRNLADLRDLAEELRAVIERLLEDARR

SEQ ID NO: 13786 - protein, 60 aa, Artificial Sequence; identical to SEQ ID NO: 13784
  Synthetic sequence.

SEQ ID NO: 13787 - protein, 56 aa, Artificial Sequence; identical to SEQ ID NO: 13785
  Synthetic sequence.

SEQ ID NO: 13788 - protein, 59 aa, Artificial Sequence
  Synthetic sequence.
SLEEITKRLLELVEENLARHEEILRELLELAKRLAKEDRDILEEVLKLIEELLKLLEDN

SEQ ID NO: 13789 - protein, 60 aa, Artificial Sequence; identical to SEQ ID NO: 13253
  Synthetic sequence.

SEQ ID NO: 13790 - protein, 59 aa, Artificial Sequence; identical to SEQ ID NO: 13788
  Synthetic sequence.

SEQ ID NO: 13791 - protein, 60 aa, Artificial Sequence; identical to SEQ ID NO: 13253
  Synthetic sequence.

SEQ ID NO: 13792 - protein, 60 aa, Artificial Sequence
  Synthetic sequence.
SAEEAVEKLVRIARAIVKINEDLSREVVRILREIVRLNEETTRLLVEIAREVVKVVEDGG

SEQ ID NO: 13793 - protein, 59 aa, Artificial Sequence
  Synthetic sequence.
EELLRRLEELRKRLEKVLDDSAKELEKLKRELERLLEESRRKLEKLKRDLERVLEETRR

SEQ ID NO: 13794 - protein, 60 aa, Artificial Sequence; identical to SEQ ID NO: 13792
  Synthetic sequence.

SEQ ID NO: 13795 - protein, 59 aa, Artificial Sequence; identical to SEQ ID NO: 13793
  Synthetic sequence.

SEQ ID NO: 13796 - protein, 60 aa, Artificial Sequence
  Synthetic sequence.
REDEVLRDIERLLREIEEKIRRILEESTAELRKVEEEVKRIIERTKRELKAIKEDVERKG

SEQ ID NO: 13797 - protein, 56 aa, Artificial Sequence
  Synthetic sequence.
EDLLEKIKRVIREHIKALEKLARDLKEILRRHIEALKELARDLAEVIRKLLEDVKR

SEQ ID NO: 13798 - protein, 60 aa, Artificial Sequence; identical to SEQ ID NO: 13796
  Synthetic sequence.

SEQ ID NO: 13799 - protein, 56 aa, Artificial Sequence; identical to SEQ ID NO: 13797
  Synthetic sequence.

SEQ ID NO: 13800 - protein, 58 aa, Artificial Sequence
  Synthetic sequence.
SREDLLRSLAELIETILRKSSELLDRLLKLVREHSETSERLIRELKKILEDILKLIKG

SEQ ID NO: 13801 - protein, 56 aa, Artificial Sequence
  Synthetic sequence.
EKELRRIAEAVERVLRDHKAKNDKILRDVEEVLRRHLEELARILKDVKKVLDEARK

SEQ ID NO: 13802 - protein, 58 aa, Artificial Sequence; identical to SEQ ID NO: 13800
  Synthetic sequence.

SEQ ID NO: 13803 - protein, 56 aa, Artificial Sequence; identical to SEQ ID NO: 13801
  Synthetic sequence.

SEQ ID NO: 13804 - protein, 60 aa, Artificial Sequence; identical to SEQ ID NO: 13292
  Synthetic sequence.

SEQ ID NO: 13805 - protein, 56 aa, Artificial Sequence; identical to SEQ ID NO: 13293
  Synthetic sequence.

SEQ ID NO: 13806 - protein, 60 aa, Artificial Sequence; identical to SEQ ID NO: 13292
  Synthetic sequence.

SEQ ID NO: 13807 - protein, 56 aa, Artificial Sequence; identical to SEQ ID NO: 13293
  Synthetic sequence.

SEQ ID NO: 13808 - protein, 61 aa, Artificial Sequence
  Synthetic sequence.
SKEEDVRRLIEELVRELRRILEENRRMLKELVEKLEEVLRRSEEVWRRLAKELDELLKEGN

SEQ ID NO: 13809 - protein, 59 aa, Artificial Sequence; identical to SEQ ID NO: 13295
  Synthetic sequence.

SEQ ID NO: 13810 - protein, 61 aa, Artificial Sequence; identical to SEQ ID NO: 13808
  Synthetic sequence.

SEQ ID NO: 13811 - protein, 59 aa, Artificial Sequence; identical to SEQ ID NO: 13295
  Synthetic sequence.

SEQ ID NO: 13812 - protein, 59 aa, Artificial Sequence
  Synthetic sequence.
SEKEAIKEVAELLKALIDDLLRLLKEDVDTARRVLDEIKKLLEENESIAREVLRRLREG

SEQ ID NO: 13813 - protein, 56 aa, Artificial Sequence
  Synthetic sequence.
ETDLDRIVKEMEKVLEDSIRELEKLVKRLEDILRESEKALRDLLSELAKVLEEVRT

SEQ ID NO: 13814 - protein, 59 aa, Artificial Sequence; identical to SEQ ID NO: 13812
  Synthetic sequence.

SEQ ID NO: 13815 - protein, 56 aa, Artificial Sequence; identical to SEQ ID NO: 13813
  Synthetic sequence.

SEQ ID NO: 13816 - protein, 58 aa, Artificial Sequence; identical to SEQ ID NO: 13304
  Synthetic sequence.

SEQ ID NO: 13817 - protein, 56 aa, Artificial Sequence
  Synthetic sequence.
EDTVRELTELVRRLLKRVEELLKRSLEILRELIKAIADAIKESLDILDRLLREVAR

SEQ ID NO: 13818 - protein, 58 aa, Artificial Sequence; identical to SEQ ID NO: 13304
  Synthetic sequence.

SEQ ID NO: 13819 - protein, 56 aa, Artificial Sequence; identical to SEQ ID NO: 13817
  Synthetic sequence.

SEQ ID NO: 13820 - protein, 59 aa, Artificial Sequence
  Synthetic sequence.
SEAERLADEVRKAVKKSEEDNETLVREVEKAVRELKKNNKTWVDEVRKLMKRLVDLLRD

SEQ ID NO: 13821 - protein, 60 aa, Artificial Sequence; identical to SEQ ID NO: 13327
  Synthetic sequence.

SEQ ID NO: 13822 - protein, 59 aa, Artificial Sequence; identical to SEQ ID NO: 13820
  Synthetic sequence.

SEQ ID NO: 13823 - protein, 60 aa, Artificial Sequence; identical to SEQ ID NO: 13327
  Synthetic sequence.

SEQ ID NO: 13824 - protein, 61 aa, Artificial Sequence
  Synthetic sequence.
SEKDEVTRRIRELLKEAEETNREAIERIKRLLDRVREAVEEVAKRSEELLRRLKKVLDRGL

SEQ ID NO: 13825 - protein, 57 aa, Artificial Sequence
  Synthetic sequence.
KEDLLREIARILAESLRLIRELLKEIEKIVKEIIELLERLNDELRKIIEAILETTKK

SEQ ID NO: 13826 - protein, 61 aa, Artificial Sequence; identical to SEQ ID NO: 13824
  Synthetic sequence.

SEQ ID NO: 13827 - protein, 57 aa, Artificial Sequence; identical to SEQ ID NO: 13825
  Synthetic sequence.

SEQ ID NO: 13828 - protein, 59 aa, Artificial Sequence
  Synthetic sequence.
SAEDLVRRVKDLVDKLEDKLRKVVRTNERLWEEIRKRLEELVRRNKELWDALVEKLKAG

SEQ ID NO: 13829 - protein, 56 aa, Artificial Sequence
  Synthetic sequence.
IRVLVELVRRHNKVLKELVEELEKLVRDHNRVVEEVVRELVELLSRAVEVIKEVVK

SEQ ID NO: 13830 - protein, 59 aa, Artificial Sequence; identical to SEQ ID NO: 13828
  Synthetic sequence.

SEQ ID NO: 13831 - protein, 56 aa, Artificial Sequence; identical to SEQ ID NO: 13829
  Synthetic sequence.

SEQ ID NO: 13832 - protein, 59 aa, Artificial Sequence
  Synthetic sequence.
SEKELVDDIRRILEEILRLLRSLLEEVIRLLEENEKLVRRHLKTVIDILRRVAKLLDEN

SEQ ID NO: 13833 - protein, 56 aa, Artificial Sequence; identical to SEQ ID NO: 13371
  Synthetic sequence.

SEQ ID NO: 13834 - protein, 59 aa, Artificial Sequence; identical to SEQ ID NO: 13832
  Synthetic sequence.

SEQ ID NO: 13835 - protein, 56 aa, Artificial Sequence; identical to SEQ ID NO: 13371
  Synthetic sequence.

SEQ ID NO: 13836 - protein, 62 aa, Artificial Sequence
  Synthetic sequence.
DEERLAEELERVLDRNRKLLEEALRELRRVIEENRKSVKRLLDELKRVLDELLKVLRELSRG

SEQ ID NO: 13837 - protein, 56 aa, Artificial Sequence
  Synthetic sequence.
EEDVERAVKEIRDRLRKLLEDYERAVRRLEDKLRRVRERYEAVLKRIKDKLEETKR

SEQ ID NO: 13838 - protein, 62 aa, Artificial Sequence; identical to SEQ ID NO: 13836
  Synthetic sequence.

SEQ ID NO: 13839 - protein, 56 aa, Artificial Sequence; identical to SEQ ID NO: 13837
  Synthetic sequence.

SEQ ID NO: 13840 - protein, 61 aa, Artificial Sequence
  Synthetic sequence.
SRVEELKKLIEDILRISREVVERIARVAEDIHRINRRVLDDLRKLIEDILRTVEEILARKV

SEQ ID NO: 13841 - protein, 55 aa, Artificial Sequence; identical to SEQ ID NO: 1262
  Synthetic sequence.

SEQ ID NO: 13842 - protein, 62 aa, Artificial Sequence
  Synthetic sequence.
SRVEELKKLIEDILRISREVVERIARVAEDIHRINRRVLDDLRKLIEDILRTVEEILARKVS

SEQ ID NO: 13843 - protein, 55 aa, Artificial Sequence; identical to SEQ ID NO: 1262
  Synthetic sequence.

SEQ ID NO: 13844 - protein, 60 aa, Artificial Sequence
  Synthetic sequence.
DEDRRLEDAVAKLRKEHADIMKKLDDIMRELDEDHARIKERLDRILEELKALLTRVLRET

SEQ ID NO: 13845 - protein, 54 aa, Artificial Sequence
  Synthetic sequence.
EIERIIRRVIEVIREILDLVRKVNKKALRVIEEILEDLARVNKKAVDAIDELAK

SEQ ID NO: 13846 - protein, 60 aa, Artificial Sequence; identical to SEQ ID NO: 13844
  Synthetic sequence.

SEQ ID NO: 13847 - protein, 54 aa, Artificial Sequence; identical to SEQ ID NO: 13845
  Synthetic sequence.

SEQ ID NO: 13848 - protein, 61 aa, Artificial Sequence
  Synthetic sequence.
DEVEELLKRVRELLKASEELVRKILEDVKRLLERSIEEVEDLLRKVEELLKRLLDLVERGG

SEQ ID NO: 13849 - protein, 56 aa, Artificial Sequence
  Synthetic sequence.
EDLIRDVDRVLKEIMDLLRDLVRRTKELLEELLRLLEELVRAHKELVRSILDEIRK

SEQ ID NO: 13850 - protein, 61 aa, Artificial Sequence; identical to SEQ ID NO: 13848
  Synthetic sequence.

SEQ ID NO: 13851 - protein, 56 aa, Artificial Sequence; identical to SEQ ID NO: 13849
  Synthetic sequence.

SEQ ID NO: 13852 - protein, 59 aa, Artificial Sequence
  Synthetic sequence.
SEAEELLRELEELLKKSEKVLEDLLRKNAELIKDSKARLDEVRRKVEKLAEEVEEVIRR

SEQ ID NO: 13853 - protein, 56 aa, Artificial Sequence
  Synthetic sequence.
KDAVRKLIEELKKLLEDLVEHHERLLKEDHERLKALLDHHRELLKTVLTILRETAK

SEQ ID NO: 13854 - protein, 59 aa, Artificial Sequence; identical to SEQ ID NO: 13852
  Synthetic sequence.

SEQ ID NO: 13855 - protein, 56 aa, Artificial Sequence; identical to SEQ ID NO: 13853
  Synthetic sequence.

SEQ ID NO: 13856 - protein, 59 aa, Artificial Sequence
  Synthetic sequence.
DEEELLRRVTEELKRLLDEARKLHEDVKRELEKLLKENDDLLADVKRKLESLLEALKRG

SEQ ID NO: 13857 - protein, 57 aa, Artificial Sequence
  Synthetic sequence.
ADKLLERIRALLETLLEVLKRDNEEIKRILEELLRVAEENLRRIKEIIDRLLDATRR

SEQ ID NO: 13858 - protein, 59 aa, Artificial Sequence; identical to SEQ ID NO: 13856
  Synthetic sequence.

SEQ ID NO: 13859 - protein, 57 aa, Artificial Sequence; identical to SEQ ID NO: 13857
  Synthetic sequence.

SEQ ID NO: 13860 - protein, 59 aa, Artificial Sequence
  Synthetic sequence.
DAEEVVKRLADVLRENDETIRKVVEDLVRIAEENDRLWKKLVEDIAEILRRIVELLRRG

SEQ ID NO: 13861 - protein, 59 aa, Artificial Sequence
  Synthetic sequence.
EDVKRALEELVSRLRKLLEDVKKASEDIVREVERIVRELAKRSDEILKKLEDIVEKLRE

SEQ ID NO: 13862 - protein, 59 aa, Artificial Sequence; identical to SEQ ID NO: 13860
  Synthetic sequence.

SEQ ID NO: 13863 - protein, 59 aa, Artificial Sequence; identical to SEQ ID NO: 13861
  Synthetic sequence.

SEQ ID NO: 13864 - protein, 56 aa, Artificial Sequence
  Synthetic sequence.
DKDKRLEELLKRLKELNDKTFEELERILEELKRANEASLREAERILEELRARIEGG

SEQ ID NO: 13865 - protein, 59 aa, Artificial Sequence; identical to SEQ ID NO: 13431
  Synthetic sequence.

SEQ ID NO: 13866 - protein, 56 aa, Artificial Sequence; identical to SEQ ID NO: 13864
  Synthetic sequence.

SEQ ID NO: 13867 - protein, 59 aa, Artificial Sequence; identical to SEQ ID NO: 13431
  Synthetic sequence.

SEQ ID NO: 13868 - protein, 56 aa, Artificial Sequence
  Synthetic sequence.
SKEETLKRLLDELEKRNRETVERLERLLKELEDRNRASLEELEAVLEELERKIEES

SEQ ID NO: 13869 - protein, 59 aa, Artificial Sequence
  Synthetic sequence.
EEVKDIVRAMEEVIRRLIEILRRDVELNLDVAKKLLELLKEDSKLNLDVARELLELLDR

SEQ ID NO: 13870 - protein, 56 aa, Artificial Sequence; identical to SEQ ID NO: 13868
  Synthetic sequence.

SEQ ID NO: 13871 - protein, 59 aa, Artificial Sequence; identical to SEQ ID NO: 13869
  Synthetic sequence.

SEQ ID NO: 13872 - protein, 57 aa, Artificial Sequence
  Synthetic sequence.
DEEETLRRLLERKVELAKEYLDVSKEVIDRTTKLLDEYLKTSKRIVDATVELLERGD

SEQ ID NO: 13873 - protein, 60 aa, Artificial Sequence
  Synthetic sequence.
SREALEEARRRLEELLRELNEITKDLEAKLEKLLRDLNELTKALEEELKRLLDELKKRTD

SEQ ID NO: 13874 - protein, 57 aa, Artificial Sequence; identical to SEQ ID NO: 13872
  Synthetic sequence.

SEQ ID NO: 13875 - protein, 60 aa, Artificial Sequence; identical to SEQ ID NO: 13873
  Synthetic sequence.

SEQ ID NO: 13876 - protein, 56 aa, Artificial Sequence
  Synthetic sequence.
SEAERTKESLKKVLKALVDLNRELLRKLEENMRELTKLNEEVKRALKEVLDKVREG

SEQ ID NO: 13877 - protein, 59 aa, Artificial Sequence
  Synthetic sequence.
EEIRKIVEEILKEIKELADRYREEVRKSKDKLRSILEDYKRKVDELKERLRELIEEVET

SEQ ID NO: 13878 - protein, 56 aa, Artificial Sequence; identical to SEQ ID NO: 13876
  Synthetic sequence.

SEQ ID NO: 13879 - protein, 59 aa, Artificial Sequence; identical to SEQ ID NO: 13877
  Synthetic sequence.

SEQ ID NO: 13880 - protein, 61 aa, Artificial Sequence
  Synthetic sequence.
SEVEDILRRLAELNKRLIDKLRELIDRIARLNEELLRVVEDILSRLKRLADELIRVVRERG

SEQ ID NO: 13881 - protein, 56 aa, Artificial Sequence
  Synthetic sequence.
DEDLKRLLEKLKEDVERVLKEVRDRTAESLKHLEDVIRELEKKTEDSLRHMEERRK

SEQ ID NO: 13882 - protein, 61 aa, Artificial Sequence; identical to SEQ ID NO: 13880
  Synthetic sequence.

SEQ ID NO: 13883 - protein, 56 aa, Artificial Sequence; identical to SEQ ID NO: 13881
  Synthetic sequence.

SEQ ID NO: 13884 - protein, 60 aa, Artificial Sequence
  Synthetic sequence.
DEERIIKTLEDINAKLVEDIKRILDKVAELNERLADAIRKILEETKRILEATTRKVRKDG

SEQ ID NO: 13885 - protein, 56 aa, Artificial Sequence
  Synthetic sequence.
KDTLRTVEKLVEDVKRRLDKLLEDYKRLIEEVKKELDKLLKEYEDALREIKKRIDE

SEQ ID NO: 13886 - protein, 60 aa, Artificial Sequence; identical to SEQ ID NO: 13884
  Synthetic sequence.

SEQ ID NO: 13887 - protein, 56 aa, Artificial Sequence; identical to SEQ ID NO: 13885
  Synthetic sequence.

SEQ ID NO: 13888 - protein, 58 aa, Artificial Sequence; identical to SEQ ID NO: 13496
  Synthetic sequence.

SEQ ID NO: 13889 - protein, 56 aa, Artificial Sequence
  Synthetic sequence.
REEVKRVLEEARDELRRLLEEYKAIIEELERELERLLREHREVIRRIKEEIDKSSK

SEQ ID NO: 13890 - protein, 58 aa, Artificial Sequence; identical to SEQ ID NO: 13496
  Synthetic sequence.

SEQ ID NO: 13891 - protein, 56 aa, Artificial Sequence; identical to SEQ ID NO: 13889
  Synthetic sequence.

SEQ ID NO: 13892 - protein, 59 aa, Artificial Sequence; identical to SEQ ID NO: 13498
  Synthetic sequence.

SEQ ID NO: 13893 - protein, 56 aa, Artificial Sequence; identical to SEQ ID NO: 13499
  Synthetic sequence.

SEQ ID NO: 13894 - protein, 59 aa, Artificial Sequence; identical to SEQ ID NO: 13498
  Synthetic sequence.

SEQ ID NO: 13895 - protein, 56 aa, Artificial Sequence; identical to SEQ ID NO: 13499
  Synthetic sequence.

SEQ ID NO: 13896 - protein, 60 aa, Artificial Sequence
  Synthetic sequence.
SLEEIVKKLEDLNKKAVEILRRVLEEHEKLVEKVKKVLRDVLRLLEKVVREVIETLKKGD

SEQ ID NO: 13897 - protein, 56 aa, Artificial Sequence
  Synthetic sequence.
EEVLRKLKEIIKELKDRLKKLLDDYERIIDELRAELERVLREYEKILEDLRKELED

SEQ ID NO: 13898 - protein, 60 aa, Artificial Sequence; identical to SEQ ID NO: 13896
  Synthetic sequence.

SEQ ID NO: 13899 - protein, 56 aa, Artificial Sequence; identical to SEQ ID NO: 13897
  Synthetic sequence.

SEQ ID NO: 13900 - protein, 59 aa, Artificial Sequence
  Synthetic sequence.
SADEALEELVRRLLEVLKTVLERTKELSRDDLRVVKEVLRIIEELVKRLLKVIRDGLDD

SEQ ID NO: 13901 - protein, 59 aa, Artificial Sequence
  Synthetic sequence.
EDVRRDIERLLEELKRRVERLLEDIERLLAELEKLNEDVLRENKALLEDLERRVRERKK

SEQ ID NO: 13902 - protein, 59 aa, Artificial Sequence; identical to SEQ ID NO: 13900
  Synthetic sequence.

SEQ ID NO: 13903 - protein, 59 aa, Artificial Sequence; identical to SEQ ID NO: 13901
  Synthetic sequence.

SEQ ID NO: 13904 - protein, 272 aa, Artificial Sequence
  Synthetic sequence.
MGSSHHHHHHSSGLVPRGSHMSKEAVTKLQALNIKLAEKLLEALARLQELNIALVYLAVELTDPKRIADEIKKVKDKSKEIVERAEEEIARAAAESKKILDEGSGSGSDAVAELQALNLKLAELLLEAIAKLQELNIKLVELLTKLTDPATIREAIRKVKEDSERIVAEAERLIAAAKAESERIIREGSGSGDPDVARLQELNIELARELLRAAAELQELNIKLVELASELTDPDEARKAIARVKRESKRIVEDAERLIREAAAASEKISRE

SEQ ID NO: 13905 - protein, 273 aa, Artificial Sequence
  Synthetic sequence.
MGSSHHHHHHSSGLVPRGSHMGSKEAVTKLMALNLKLAEKLLEAIARLQELNIALVYLATELTDPERIREEIRKVKEESARIVEEAEEEIRRAAARSEDILREGSGSGSDAVAELQRLNLELAELLLRAAAKLQELNIDLVRLLTELTDPKTIRDAIERVKAESERIVREAERLIREAKADSERILREGSGSGDPDVARLQELFIELARELLEALARLQELNIDLVRLASELTDPDTIRDAIRRVKEESARIVEDARRLIKEAAEEAEKISRE

SEQ ID NO: 13906 - protein, 273 aa, Artificial Sequence
  Synthetic sequence.
MGSSHHHHHHSSGLVPRGSHMGSKRAVTELQKLNIELARKLLRALAELMELNIALVYLAVELTDPRRIREEIRKVKEKSDEIVKRAEDEIRKAAAESEKILREGSGSGSDAVAELQRLNLELAKLLLEAIAKLQALNIDLVRLLTELTDPETIRRAIKRVKDESARIVEEAEKLIRAAKDKAREIIDKGSGSGDPDVARLQELNIELARELLEAAARLQELFIDLVRLASELTDPDEARKAIERVKREAERIVREAERLIREAKRASKEISDE

SEQ ID NO: 13907 - protein, 295 aa, Artificial Sequence
  Synthetic sequence.
MGSSHHHHHHSSGLVPRGSHMKLLEAVTKLQALNIKLAEKLLEALARLQELNIALVYLAVELTDPKRIADEIKKVKDKSKEIVERAEEEIARAAAESKKILDEAEEEGSGSGSELLLEAVAELQALNLKLAELLLEAIAKLQELNIKLVELLTKLTDPATIREAIRKVKEDSERIVAEAERLIAAAKAESERIIREAERLAGSGSGSRELLRDVARLQELNIELARELLRAAAELQELNIKLVELASELTDPDEARKAIARVKRESKRIVEDAERLIREAAAASEKISREAERLI

SEQ ID NO: 13908 - protein, 319 aa, Artificial Sequence
  Synthetic sequence.
MGSSHHHHHHSSGLVPRGSHMKLAEKLLEAVTKLQALNIKLAEKLLEALARLQELNIALVYLAVELTDPKRIADEIKKVKDKSKEIVERAEEEIARAAAESKKILDEAEEEIARAGSGSGSLKLAELLLEAVAELQALNLKLAELLLEAIAKLQELNIKLVELLTKLTDPATIREAIRKVKEDSERIVAEAERLIAAAKAESERIIREAERLIAAAAGSGSGSIELARELLRDVARLQELNIELARELLRAAAELQELNIKLVELASELTDPDEARKAIARVKRESKRIVEDAERLIREAAAASEKISREAERLIREAA

SEQ ID NO: 13909 - protein, 380 aa, Artificial Sequence
  Synthetic sequence.
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIARVKRESKRIVEDAERLIREAAAASEKISREAERLIREAAAASEKISRE

SEQ ID NO: 13910 - protein, 382 aa, Artificial Sequence
  Synthetic sequence.
MGSSHHHHHHSSGLVPRGSHMSHAAVIKLSDLNIRLLDKLLQAVIKLTELNAELNRKLIEALQRLFDLNVALVHLAAELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSNDPQVAQNQETFIELARDALRLVAENQEAFIEVARLTLRAAALAQEVAIKAVEAASEGGSGSGNKEEIEKLAKEAREKLKKAEKEHKEIHDKLRKKNKKAREDLKKKADELRETNKRVN

SEQ ID NO: 13911 - protein, 382 aa, Artificial Sequence
  Synthetic sequence.
MGSSHHHHHHSSGLVPRGSHMSLEAVLKLAELNLKLSDKLAEAVQKLAALLNKLLEKLSEALQRLFELNVALVTLAIELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSNDPLVARLQELLIEHARELLRLVATSQEIFIELARAFLANAAQLQEAAIKAVEAASENGSGSGSSEKVRRELKESLKENHKQNQKLLKDHKRAQEKLNRELEELKKKHKKTLDDIRRES

SEQ ID NO: 13912 - protein, 382 aa, Artificial Sequence
  Synthetic sequence.
MGSSHHHHHHSSGLVPRGSHMSLEAVLKLFELNHKLSEKLLEAVLKLHALNQKLSQKLLEALARLLELNVALVELAIELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPEVARLQEAFIEQAREILRNVAAAQEALIEQARRLLALAALAQEAAIKAVELASEHGSGSGDTVKRILEELRRRFEKLAKDLDDIARKLLEDHKKHNKELKDKQRKIKKEADDAARS

SEQ ID NO: 13913 - protein, 382 aa, Artificial Sequence
  Synthetic sequence.
MGSSHHHHHHSSGLVPRGSHMSLEAVLKLQDLNSKLSEKLSEAQLKLQALNNKLLRKLLEALLRLQDLNQALVNLALQLTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVAKSQEHLIEHARELLRQVAKSQELFIELARQLLRLAAKSQELAIKAVELASEAGSGSGDDVERRLRKANKESKKEAEELTEEAKKANEKTKEDSKELTKENRKTNKTIKDEARS

SEQ ID NO: 13914 - protein, 382 aa, Artificial Sequence
  Synthetic sequence.
MGSSHHHHHHSSGLVPRGSHMSREAVEKLAELNHKLSHKLQQAQQKLQALNLKLLQKLLEALDRLQDLNNALVKLAQRLTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARQQETLIEQARRLLRNVAESQELFIEAARTVLRLAAKLQEINIKQVELASEAGSGSGDDEERRSEKTVQDAKREIKKVEDDLQRLNEEQKKKVKKQEDENQKTLKKHKDDARS

SEQ ID NO: 13915 - protein, 258 aa, Artificial Sequence
  Synthetic sequence.
MGSSHHHHHHSSGLVPRGSHMNKEDATEAQKKAIRAAEELLKDVTRIQERAIREAEKALERLARVQEEAIRRVYEAVESKNKEELKKVKEEIEELLRRLKRELDELEREIRELLKEIKEKADRLEKEIRDLIERIRRDRNASDEVVTRLARLNEELIRELREDVRRLAELNKELLRELERAARELARLNEKLLELADRVETEEEARKAIARVKRESKRIVEDAERLIREAAAASEKISREAERLIREAAAASEKISRE

SEQ ID NO: 13916 - protein, 262 aa, Artificial Sequence
  Synthetic sequence.
MGSSHHHHHHSSGLVPRGSHMDERLKRLNERLADELDKDLERLLRLNEELARELTRAAEELRELNEKLVELAKKLQGGRSREVAERAEKEREKIRRKLEEIKKEIKEDADRIKKRADELRRRLEKTLEDAARELEKLKREPRTEELKRKATELQKEAIRRAEELLKEVTDVQRRAIERAEELLEKLARLQEEAIRTVYLLVELNKVDRARKAIARVKRESKRIVEDAERLIREAAAASEKISREAERLIREAAAASEKISRE

SEQ ID NO: 13917 - protein, 259 aa, Artificial Sequence
  Synthetic sequence.
MGSSHHHHHHSSGLVPRGSHMLIERLTRLEKEHVRELKRLLDTSLEILRRLVEAFETNLRQLKEALKRALEAANLHNEEVEEVLRKLEEDLRRLEEELRKTLDDVRKEVKRLKEELDKRIKEVEDELRKIKEKLKKGDKNEKRVLEEILRLAEDVLKKSDKLAKDVQERARELNEILEELSRKLQELFERVVEEVTRNVPTTERIEKVRRELKESLKENHKQNQKLLKDHKRAQEKLNRELEELKKKHKKTLDDIRRES

SEQ ID NO: 13918 - protein, 263 aa, Artificial Sequence
  Synthetic sequence.
MGSSHHHHHHSSGLVPRGSHMSEERVLELAEEALRLSDEAAKEIQELARRLNEELEKLSKELQDLFERIVETVTRLIDADEETLKRAAEEIKKRLEDARKKAKEAADKAREELDRARKKLKELVDEIRKKAKDALEKAGADEELVARLLRLLEEHARELERLLRTSARIIERLLDAFRRNLEQLKEAADKAVEAAEEAVRRVEDVRVWSEKVRRELKESLKENHKQNQKLLKDHKRAQEKLNRELEELKKKHKKTLDDIRRES

SEQ ID NO: 13919 - protein, 311 aa, Artificial Sequence
  Synthetic sequence.
MGSHHHHHHGSGSENLYFQGSGGSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARVKRESKRIVEDAERLIREAAAASEKISREAERLIR

SEQ ID NO: 13920 - protein, 311 aa, Artificial Sequence
  Synthetic sequence.
MGSHHHHHHGSGSENLYFQGSGGSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARVKRESNAYYADAERLIREAAAASEKISREAERLIR

SEQ ID NO: 13921 - protein, 280 aa, Artificial Sequence
  Synthetic sequence.
MGSSHHHHHHSSGLVPRGSHMGSKEAVTKLQALNIKLAEKLLEALARLQELNIALVYLAVELTDPKRIADEIKKVKDKSKEIVERAEEEIARAAAESKKILDEGSGSGSDAVAELQALNLKLAELLLEAIAKLQELNIKLVELLTKLTDPATIREAIRKVKEDSERIVAEAERLIAAAKAESERIIREGSGSGDPDVARLQELNIELARELLRAAAELQELNIKLVELASELTGSGSGSGDPKMAQELIDKVRAASLQINGDAFYAILRALAASEKLSKE

SEQ ID NO: 13922 - protein, 275 aa, Artificial Sequence
  Synthetic sequence.
MGSSHHHHHHSSGLVPRGSHMKEAVTKLQALNIKLAEKLLEALARLQELNIALVYLAVELTDPKRIADEIKKVKDKSKEIVERAEEEIARAAAESKKILDEGSGSGSDAVAELQALNLKLAELLLEAIAKLQELNIKLVELLTKLTDPATIREAIRKVKEDSERIVAEAERLIAAAKAESERIIREGSGSGDPDVARLQELNIELARELLRAAAELQELNIKLVELASEGSGSGSEIAEALRAIGDVFNESYRIVEDAERLIREAAAASEKISRE

SEQ ID NO: 13923 - protein, 295 aa, Artificial Sequence
  Synthetic sequence.
MGSSHHHHHHSSGLVPRGSHMKLLEAVTKLQALNIKLAEKLLEALARLQELNIALVYLAVELTDPKRIADEIKKVKDKSKEIVERAEEEIARAAAESKKILDEAEEEGSGSGSELLLEAVAELQALNLKLAELLLEAIAKLQELNIKLVELLTKLTDPATIREAIRKVKEDSERIVAEAERLIAAAKAESERIIREAERLAGSGSGSRELLRDVARLQELNIELARELLRAAAELQELNIKLVELASELTDEIWIAQELRRIGDEFNAYYADAERLIREAAAASEKISREAERLI

SEQ ID NO: 13924 - protein, 319 aa, Artificial Sequence
  Synthetic sequence.
MGSSHHHHHHSSGLVPRGSHMKLAEKLLEAVTKLQALNIKLAEKLLEALARLQELNIALVYLAVELTDPKRIADEIKKVKDKSKEIVERAEEEIARAAAESKKILDEAEEEIARAGSGSGSLKLAELLLEAVAELQALNLKLAELLLEAIAKLQELNIKLVELLTKLTDPATIREAIRKVKEDSERIVAEAERLIAAAKAESERIIREAERLIAAAAGSGSGSIELARELLRDVARLQELNIELARELLRAAAELQELNIKLVELASELTDEIWIAQELRRIGDEFNAYYADAERLIREAAAASEKISREAERLIREAA

SEQ ID NO: 13925 - protein, 380 aa, Artificial Sequence
  Synthetic sequence.
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDEIWIAQELRRIGDEFNAYYADAERLIREAAAASEKISREAERLIREAAAASEKISRE

SEQ ID NO: 13926 - protein, 382 aa, Artificial Sequence
  Synthetic sequence.
MGSSHHHHHHSSGLVPRGSHMSHAAVIKLSDLNIRLLDKLLQAVIKLTELNAELNRKLIEALQRLFDLNVALVHLAAELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSNDPQVAQNQETFIELARDALRLVAENQEAFIEVARLTLRAAALAQEVAIKAVEAASEGGSGSGNEIWIAQELRRIGDEFNAYYAEHKEIHDKLRKKNKKAREDLKKKADELRETNKRVN

SEQ ID NO: 13927 - protein, 382 aa, Artificial Sequence
  Synthetic sequence.
MGSSHHHHHHSSGLVPRGSHMSLEAVLKLAELNLKLSDKLAEAVQKLAALLNKLLEKLSEALQRLFELNVALVTLAIELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSNDPLVARLQELLIEHARELLRLVATSQEIFIELARAFLANAAQLQEAAIKAVEAASENGSGEIWIAQELRRIGDEFNAYYAQNQKLLKDHKRAQEKLNRELEELKKKHKKTLDDIRRES

SEQ ID NO: 13928 - protein, 381 aa, Artificial Sequence
  Synthetic sequence.
MGSSHHHHHHSSGLVPRGSHMSLEAVLKLFELNHKLSEKLLEAVLKLHALNQKLSQKLLEALARLLELNVALVELAIELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPEVARLQEAFIEQAREILRNVAAAQEALIEQARRLLALAALAQEAAIKAVELASEHGSGSEIWIAQELRRIGDEFNAYYADLDDIARKLLEDHKKHNKELKDKQRKIKTIKDEARS

SEQ ID NO: 13929 - protein, 382 aa, Artificial Sequence
  Synthetic sequence.
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASGGNWSHPQFEKKAIARVKRESKRIVEDAERLIREAAAASEKISREAERLIREAAAASEKISRE

SEQ ID NO: 13930 - protein, 380 aa, Artificial Sequence
  Synthetic sequence.
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDENWSHPQFEKRESKRIVEDAERLIREAAAASEKISREAERLIREAAAASEKISRE

SEQ ID NO: 13931 - protein, 380 aa, Artificial Sequence
  Synthetic sequence.
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKNWSHPQFEKKRIVEDAERLIREAAAASEKISREAERLIREAAAASEKISRE

SEQ ID NO: 13932 - protein, 380 aa, Artificial Sequence
  Synthetic sequence.
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIANWSHPQFEKVEDAERLIREAAAASEKISREAERLIREAAAASEKISRE

SEQ ID NO: 13933 - protein, 380 aa, Artificial Sequence
  Synthetic sequence.
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIARNWSHPQFEKEDAERLIREAAAASEKISREAERLIREAAAASEKISRE

SEQ ID NO: 13934 - protein, 380 aa, Artificial Sequence
  Synthetic sequence.
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIARVKRENWSHPQFEKRLIREAAAASEKISREAERLIREAAAASEKISRE

SEQ ID NO: 13935 - protein, 380 aa, Artificial Sequence
  Synthetic sequence.
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIARVKRESKRNWSHPQFEKREAAAASEKISREAERLIREAAAASEKISRE

SEQ ID NO: 13936 - protein, 380 aa, Artificial Sequence
  Synthetic sequence.
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIARVKRESKRIVENWSHPQFEKAAASEKISREAERLIREAAAASEKISRE

SEQ ID NO: 13937 - protein, 380 aa, Artificial Sequence
  Synthetic sequence.
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIARVKRESKRIVEDAERLINWSHPQFEKISREAERLIREAAAASEKISRE

SEQ ID NO: 13938 - protein, 309 aa, Artificial Sequence
  Synthetic sequence.
MGSSHHHHHHSSGLVPRGSHMGSKEAVTKLQALNIKLAEKLLEALARLQELNIALVYLAVELTDPKRIADEIKKVKDKSKEIVERAEEEIARAAAESKKILDEGSGSGSDAVAELQALNLKLAELLLEAIAKLQELNIKLVELLTKLTDPATIREAIRKVKEDSERIVAEAERLIAAAKAESERIIREGSGSGDPDVARLQELNIELARELLRAAAELQELNIKLVELASEGSGSGSGYELRRALEELEKALRELKKSLDELERSLEELEKNPSEDALVENNRLNVENNKIIVEVLRIIAEVLKINAKS

SEQ ID NO: 13939 - protein, 319 aa, Artificial Sequence
  Synthetic sequence.
MGSSHHHHHHSSGLVPRGSHMGSKEAVTKLQALNIKLAEKLLEALARLQELNIALVYLAVELTDPKRIADEIKKVKDKSKEIVERAEEEIARAAAESKKILDEGSGSGSDAVAELQALNLKLAELLLEAIAKLQELNIKLVELLTKLTDPATIREAIRKVKEDSERIVAEAERLIAAAKAESERIIREGSGSGDPDVARLQELNIELARELLRAAAELQELNIKLVELASEGSGSGSGKKLVEEVERALRELLKTSEDLVRKVEKALRELLELIRRGGTKDKIEEKIRRVLEEIKRELERQKRKIEDVLRQIKEELYRS

SEQ ID NO: 13940 - protein, 398 aa, Artificial Sequence
  Synthetic sequence.
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASEGSGSGSGYELRRALEELEKALRELKKSLDELERSLEELEKNPSEDALVENNRLNVENNKIIVEVLRIIAEVLKINAKS

SEQ ID NO: 13941 - protein, 408 aa, Artificial Sequence
  Synthetic sequence.
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASEGSGSGSGKKLVEEVERALRELLKTSEDLVRKVEKALRELLELIRRGGTKDKIEEKIRRVLEEIKRELERQKRKIEDVLRQIKEELYRS

SEQ ID NO: 13942 - protein, 856 aa, Artificial Sequence
  Synthetic sequence.
GHHHHHHHHHHGVSKGEELFTGVVPILVELDGDVNGHKFSVSGEGEGDATYGKLTLKFICTTGKLPVPWPTLVTTLSWGVQCFARYPDHMKQHDFFKSAMPEGYVQERTIFFKDDGNYKTRAEVKFEGDTLVNRIELKGIDFKEDGNILGHKLEYNYFSDNVYITADKQKNGIKANFKIRHNIEDGGVQLADHYQQNTPIGDGPVLLPDNHYLSTQSKLSKDPNEKRDHMVLLEFVTAAGITLGMDELYKGSGCSLQGMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIARVKRESKRIVEDAERLIREAAAASEKISREAERLIREAAAASEKISREVSKGEELFTGVVPILVELDGDVNGHKFSVSGEGEGDATYGKLTLKLICTTGKLPVPWPTLVTTLGYGVQCFARYPDHMKQHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSYQSKLSKDPNEKRDHMVLLEFVTAAGITLGMDELYK

SEQ ID NO: 13943 - protein, 859 aa, Artificial Sequence
  Synthetic sequence.
MGHHHHHHHHHHGVSKGEELFTGVVPILVELDGDVNGHKFSVSGEGEGDATYGKLTLKFICTTGKLPVPWPTLVTTLSWGVQCFARYPDHMKQHDFFKSAMPEGYVQERTIFFKDDGNYKTRAEVKFEGDTLVNRIELKGIDFKEDGNILGHKLEYNYFSDNVYITADKQKNGIKANFKIRHNIEDGGVQLADHYQQNTPIGDGPVLLPDNHYLSTQSKLSKDPNEKRDHMVLLEFVTAAGITLGMDELYKGSGCSLQGMSHAAVIKLSDLNIRLLDKLLQAVIKLTELNAELNRKLIEALQRLFDLNVALVHLAAELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSNDPQVAQNQETFIELARDALRLVAENQEAFIEVARLTLRAAALAQEVAIKAVEAASEGGSGSGNKEEIEKLAKEAREKLKKAEKEHKEIHDKLRKKNKKAREDLKKKADELRETNKRVNVSKGEELFTGVVPILVELDGDVNGHKFSVSGEGEGDATYGKLTLKLICTTGKLPVPWPTLVTTLGYGVQCFARYPDHMKQHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSYQSKLSKDPNEKRDHMVLLEFVTAAGITLGMDELYK

SEQ ID NO: 13944 - protein, 858 aa, Artificial Sequence
  Synthetic sequence.
GHHHHHHHHHHGVSKGEELFTGVVPILVELDGDVNGHKFSVSGEGEGDATYGKLTLKFICTTGKLPVPWPTLVTTLSWGVQCFARYPDHMKQHDFFKSAMPEGYVQERTIFFKDDGNYKTRAEVKFEGDTLVNRIELKGIDFKEDGNILGHKLEYNYFSDNVYITADKQKNGIKANFKIRHNIEDGGVQLADHYQQNTPIGDGPVLLPDNHYLSTQSKLSKDPNEKRDHMVLLEFVTAAGITLGMDELYKGSGCSLQGMSLEAVLKLAELNLKLSDKLAEAVQKLAALLNKLLEKLSEALQRLFELNVALVTLAIELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSNDPLVARLQELLIEHARELLRLVATSQEIFIELARAFLANAAQLQEAAIKAVEAASENGSGSGSSEKVRRELKESLKENHKQNQKLLKDHKRAQEKLNRELEELKKKHKKTLDDIRRESVSKGEELFTGVVPILVELDGDVNGHKFSVSGEGEGDATYGKLTLKLICTTGKLPVPWPTLVTTLGYGVQCFARYPDHMKQHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSYQSKLSKDPNEKRDHMVLLEFVTAAGITLGMDELYK

SEQ ID NO: 13945 - protein, 858 aa, Artificial Sequence
  Synthetic sequence.
GHHHHHHHHHHGVSKGEELFTGVVPILVELDGDVNGHKFSVSGEGEGDATYGKLTLKFICTTGKLPVPWPTLVTTLSWGVQCFARYPDHMKQHDFFKSAMPEGYVQERTIFFKDDGNYKTRAEVKFEGDTLVNRIELKGIDFKEDGNILGHKLEYNYFSDNVYITADKQKNGIKANFKIRHNIEDGGVQLADHYQQNTPIGDGPVLLPDNHYLSTQSKLSKDPNEKRDHMVLLEFVTAAGITLGMDELYKGSGCSLQGMSLEAVLKLFELNHKLSEKLLEAVLKLHALNQKLSQKLLEALARLLELNVALVELAIELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPEVARLQEAFIEQAREILRNVAAAQEALIEQARRLLALAALAQEAAIKAVELASEHGSGSGDTVKRILEELRRRFEKLAKDLDDIARKLLEDHKKHNKELKDKQRKIKKEADDAARSVSKGEELFTGVVPILVELDGDVNGHKFSVSGEGEGDATYGKLTLKLICTTGKLPVPWPTLVTTLGYGVQCFARYPDHMKQHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSYQSKLSKDPNEKRDHMVLLEFVTAAGITLGMDELYK

SEQ ID NO: 13946 - protein, 380 aa, Artificial Sequence
  Synthetic sequence.
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIARVKRESKRIVEDAEENLYFQGAASEKISREAERLIREAAAASEKISRE

SEQ ID NO: 13947 - protein, 380 aa, Artificial Sequence
  Synthetic sequence.
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARAHIVMVDAYKKRIVEDAERLIREAAAASEKISREAERLIREAAAASEKISRE

SEQ ID NO: 13948 - protein, 359 aa, Artificial Sequence
  Synthetic sequence.
SKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIARVKRESKRIVEDLALKLAGLDINSEKISREAERLIREAAAASEKISRE

SEQ ID NO: 13949 - protein, 359 aa, Artificial Sequence
  Synthetic sequence.
SKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIARVKRESKRIVEDAERLIRELAEKLAGLDINAERLIREAAAASEKISRE

SEQ ID NO: 13950 - protein, 359 aa, Artificial Sequence
  Synthetic sequence.
SKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIARVKRESKELAEKLRAGLDLNAAASEKISREAERLIREAAAASEKISRE

SEQ ID NO: 13951 - protein, 359 aa, Artificial Sequence
  Synthetic sequence.
SKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIARVKRESKAAAKRARTSIREAAAASEKISREAERLIREAAAASEKISRE

SEQ ID NO: 13952 - protein, 380 aa, Artificial Sequence
  Synthetic sequence.
MGSSHHHHHHSSGLVPRGSHMSKEAVTKLQALNIKLAEKLLEAVTKLQALNIKLAEKLLEALARLQELNIALVYLAVELTDPKRIADEIKKVKDKSKEIVERAEEEIARAAAESKKILDEAEEEIARAAAESKKILDEGSGSGSDAVAELQALNLKLAELLLEAVAELQALNLKLAELLLEAIAKLQELNIKLVELLTKLTDPATIREAIRKVKEDSERIVAEAERLIAAAKAESERIIREAERLIAAAKAESERIIREGSGSGDPDVARLQELNIELARELLRDVARLQELNIELARELLRAAAELQELNIKLVELASELTDPDEARKAIARVKTMFSSNRQKILERTETLNQEWKQRRIQAERLIREAAAASEKISRE

SEQ ID NO: 13953 - protein, 451 aa, Artificial Sequence
  Synthetic sequence.
MGSHHHHHHGSGSENLYFQGSKEAAKKLQDLNIELARKLLEASTKLQRLNIRLAEALLEAIARLQELNLELVYLAVELTDPKRIRDEIKEVKDKSKEIIRRAEKEIDDAAKESKKILEEARKAIRDAAEESRKILEEGSGSGSDALDELQKLNLELAKLLLKAIAETQDLNLRAAKAFLEAAAKLQELNIRAVELLVKLTDPATIRRALEHAKRRSKEIIDEAERAIRAAKRESERIIEEARRLIEKAKEESERIIREGSGSGDPDIKKLQDLNIELARELLRAHAQLQRLNLELLRELLRALAQLQELNLDLLRLASELTGGSGGSGGSVLLNVLSKCAGSKKFRPAPAAAFARECRGFYFELQELKEDDYYGITLSDDSDHQFLLANQVVVHNCGGSGGSDEIWIAQELRRIGDEFNAYYADAERLIREAAAASEKISREAERLIREAA

SEQ ID NO: 13954 - protein, 823 aa, Artificial Sequence
  Synthetic sequence.
MGSHHHHHHGSGSENLYFQGHMSKGEELFTGVVPILVELDGDVNGHKFSVRGEGEGDATNGKLTLKFICTTGKLPVPWPTLVTTLTYGVQCFARYPDHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSVLSKDPNEKRDHMVLLEFVTAAGITHGMDELYKSGSGSGCFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPILYGGSGGSGGGGSGGSGSKEAAKKLQDLNIELARKLLEASTKLQRLNIRLAEALLEAIARLQELNLELVYLAVELTDPKRIRDEIKEVKDKSKEIIRRAEKEIDDAAKESKKILEEARKAIRDAAEESRKILEEGSGSGSDALDELQKLNLELAKLLLKAIAETQDLNLRAAKAFLEAAAKLQELNIRAVELLVKLTDPATIRRALEHAKRRSKEIIDEAERAIRAAKRESERIIEEARRLIEKAKEESERIIREGSGSGDPDIKKLQDLNIELARELLRAHAQLQRLNLELLRELLRALAQLQELNLDLLRLASELTDEIWIAQELRRIGDEFNAYYADAERLSREAAAASEKISREAERSIREAAAASEKISRE

SEQ ID NO: 13955 - protein, 822 aa, Artificial Sequence
  Synthetic sequence.
MGSSHHHHHHSSGLVPRGSHMSKGEELFTGVVPILVELDGDVNGHKFSVRGEGEGDATNGKLTLKFICTTGKLPVPWPTLVTTLTYGVQCFARYPDHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSVLSKDPNEKRDHMVLLEFVTAAGITHGMDELYKSGSGSGCFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPILYGGSGGSGGGGSGGSGSKEAAKKLQDLNIELARKLLEASTKLQRLNIRLAEALLEAIARLQELNLELVYLAVELTDPKRIRDEIKEVKDKSKEIIRRAEKEIDDAAKESKKILEEARKAIRDAAEESRKILEEGSGSGSDALDELQKLNLELAKLLLKAIAETQDLNLRAAKAFLEAAAKLQELNIRAVELLVKLTDPATIRRALEHAKRRSKEIIDEAERAIRAAKRESERIIEEARRLIEKAKEESERIIREGSGSGDPDIKKLQDLNIELARELLRAHAQLQRLNLELLRELLRALAQLQELNLDLLRLASELTDEIWIAQELRRIGDEFNAYYADAERLSREAAAASEKISREAERSIREAAAASEKISRE

SEQ ID NO: 13956 - protein, 379 aa, Artificial Sequence
  Synthetic sequence.
MGSHHHHHHGSGSENLYFQGSKEAAKKLQDLNIELARKLLEASTKLQRLNIRLAEALLEAIARLQELNLELVYLAVELTDPKRIRDEIKEVKDKSKEIIRRAEKEIDDAAKESKKILEEARKAIRDAAEESRKILEEGSGSGSDALDELQKLNLELAKLLLKAIAETQDLNLRAAKAFLEAAAKLQELNIRAVELLVKLTDPATIRRALEHAKRRSKEIIDEAERAIRAAKRESERIIEEARRLIEKAKEESERIIREGSGSGDPDIKKLQDLNIELARELLRAHAQLQRLNLELLRELLRALAQLQELNLDLLRLASELTDEIWIAQELRRIGDEFNAYYADAERLIREAAAASEKISREAERLIREAAAASEKISRE

SEQ ID NO: 13957 - protein, 379 aa, Artificial Sequence
  Synthetic sequence.
MGSHHHHHHGSGSENLYFQGSKEAAKKLQDLNIELARKLLEASTKLQRLNIRLAEALLEAIARLQELNLELVYLAVELTDPKRIRDEIKEVKDKSKEIIRRAEKEIDDAAKESKKILEEARKAIRDAAEESRKILEEGSGSGSDALDELQKLNLELAKLLLKAIAETQDLNLRAAKAFLEAAAKLQELNIRAVELLVKLTDPATIRRALEHAKRRSKEIIDEAERAIRAAKRESERIIEEARRLIEKAKEESERIIREGSGSGDPDIKKLQDLNIELARELLRAHAQLQRLNLELLRELLRALAQLQELNLDLLRLASELRDHMVLHEYVNAAGITFNAYYADAERLIREAAAASEKISREAERLIREAAAASEKISRE

SEQ ID NO: 13958 - protein, 311 aa, Artificial Sequence
  Synthetic sequence.
MGSHHHHHHGSGSENLYFQGSGGSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDEIWIAQELRRIGDEFNAYYADAERLIREAAAASEKISREAERLIR

SEQ ID NO: 13959 - protein, 311 aa, Artificial Sequence
  Synthetic sequence.
MGSHHHHHHGSGSENLYFQGSGGSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELRDHMVLHEYVNAAGITFNAYYADAERLIREAAAASEKISREAERLIR

SEQ ID NO: 13960 - protein, 494 aa, Artificial Sequence
  Synthetic sequence.
MGSHHHHHHGSGSENLYFQGSAMVDTLSGLSSEQGQSGDMTIEEDSATHIKFSKRDEDGKELAGATMELRDSSGKTISTWISDGQVKDFYLYPGKYTFVETAAPDGYEVATAITFTVNEQGQVTVNGKATKGSGGSKEAAKKLQDLNIELARKLLEASTKLQRLNIRLAEALLEAIARLQELNLELVYLAVELTDPKRIRDEIKEVKDKSKEIIRRAEKEIDDAAKESKKILEEARKAIRDAAEESRKILEEGSGSGSDALDELQKLNLELAKLLLKAIAETQDLNLRAAKAFLEAAAKLQELNIRAVELLVKLTDPATIRRALEHAKRRSKEIIDEAERAIRAAKRESERIIEEARRLIEKAKEESERIIREGSGSGDPDIKKLQDLNIELARELLRAHAQLQRLNLELLRELLRALAQLQELNLDLLRLASELRDHMVLHEYVNAAGITFNAYYADAERLIREAAAASEKISREAERLIREAAAASEKISRE

SEQ ID NO: 13961 - protein, 423 aa, Artificial Sequence
  Synthetic sequence.
MGSHHHHHHGSGSENLYFQGSAMVDTLSGLSSEQGQSGDMTIEEDSATHIKFSKRDEDGKELAGATMELRDSSGKTISTWISDGQVKDFYLYPGKYTFVETAAPDGYEVATAITFTVNEQGQVTVNGKATKGSGGSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELRDHMVLHEYVNAAGITFNAYYADAERLIREAAAASEKISREAERLIR

SEQ ID NO: 13962 - protein, 379 aa, Artificial Sequence
  Synthetic sequence.
MGSHHHHHHGSGSENLYFQGSKEAAKKLQDLNIELARKLLEASTKLQRLNIRLAEALLEAIARLQELNLELVYLAVELTDPKRIRDEIKEVKDKSKEIIRRAEKEIDDAAKESKKILEEARKAIRDAAEESRKILEEGSGSGSDALDELQKLNLELAKLLLKAIAETQDLNLRAAKAFLEAAAKLQELNIRAVELLVKLTDPATIRRALEHAKRRSKEIIDEAERAIRAAKRESERIIEEARRLIEKAKEESERIIREGSGSGDPDIKKLQDLNIELARELLRAHAQLQRLNLELLRELLRALAQLQELNLDLLRLASELTNIQMLLEAADYLERESKRIVEDAERLIREAAAASEKISREAERSIREAAAASEKISRE

SEQ ID NO: 13963 - protein, 377 aa, Artificial Sequence
  Synthetic sequence.
MGSHHHHHHGSGSENLYFQGSKEAAKKLQDLNIELARKLLEASTKLQRLNIRLAEALLEAIARLQELNLELVYLAVELTDPKRIRDEIKEVKDKSKEIIRRAEKEIDDAAKESKKILEEARKAIRDAAEESRKILEEGSGSGSDALDELQKLNLELAKLLLKAIAETQDLNLRAAKAFLEAAAKLQELNIRAVELLVKLTDPATIRRALEHAKRRSKEIIDEAERAIRAAKRESERIIEEARRLIEKAKEESERIIREGSGSGDPDIKKLQDLNIELARELLRAHAQLQRLNLELLRELLRALAQLQELNLDLLRLASELTDPDEARKNIQMLLEAADYLEEDAERLIREAAAASEKISREAERLIREAASEKISRE

SEQ ID NO: 13964 - protein, 285 aa, Artificial Sequence
  Synthetic sequence.
MDEARKAIARVKRESKRIEIWIAQELRRIGDEFNAYYAEAEKLATDELWHRLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASE

SEQ ID NO: 13965 - protein, 309 aa, Artificial Sequence
  Synthetic sequence.
MGSSHHHHHHSSGLVPRGSHMSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARAHIVMVDAYKKRIVEDAERLIREAAAASEKISREAERLIR

SEQ ID NO: 13966 - protein, 309 aa, Artificial Sequence
  Synthetic sequence.
MGSSHHHHHHSSGLVPRGSHMSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARVKRESKAHIVMVDAYKREAAAASEKISREAERLIR

SEQ ID NO: 13967 - protein, 309 aa, Artificial Sequence
  Synthetic sequence.
MGSSHHHHHHSSGLVPRGSHMSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARENLYFQGSESKRIVEDAERLIREAAAASEKISREAERLIR

SEQ ID NO: 13968 - protein, 309 aa, Artificial Sequence
  Synthetic sequence.
MGSSHHHHHHSSGLVPRGSHMSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARVKRESKRIVENLYFQGSEAAAASEKISREAERLIR

SEQ ID NO: 13969 - protein, 309 aa, Artificial Sequence
  Synthetic sequence.
MGSSHHHHHHSSGLVPRGSHMSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARVSGWRLFKKISRIVEDAERLIREAAAASEKISREAERLIR

SEQ ID NO: 13970 - protein, 309 aa, Artificial Sequence
  Synthetic sequence.
MGSSHHHHHHSSGLVPRGSHMSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARVKRESKVSGWRLFKKISEAAAASEKISREAERLIR

SEQ ID NO: 13971 - protein, 309 aa, Artificial Sequence
  Synthetic sequence.
MGSSHHHHHHSSGLVPRGSHMSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIIQIGRESKRIVEDAERLIREAAAASEKISVQLGRLIR

SEQ ID NO: 13972 - protein, 309 aa, Artificial Sequence
  Synthetic sequence.
MGSSHHHHHHSSGLVPRGSHMSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARVKRESKRIVIQIGRLIVQLGAASEKISREAERLIR

SEQ ID NO: 13973 - protein, 309 aa, Artificial Sequence
  Synthetic sequence.
MGSSHHHHHHSSGLVPRGSHMSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARVKRESKRIVIQIGRLIREAAAASEKISVQLGRLIR

SEQ ID NO: 13974 - protein, 309 aa, Artificial Sequence
  Synthetic sequence.
MGSSHHHHHHSSGLVPRGSHMSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDESVKELEDKVEELLSKNYHLENEVARLKKLVGERSREAERLIR

SEQ ID NO: 13975 - protein, 309 aa, Artificial Sequence
  Synthetic sequence.
MGSSHHHHHHSSGLVPRGSHMSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIAGEIAALKQEIAALKKENAALKWEIAALKQGAERLIR

SEQ ID NO: 13976 - protein, 309 aa, Artificial Sequence
  Synthetic sequence.
MGSSHHHHHHSSGLVPRGSHMSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARVKRGLEQEIAALEKENAALEWEIAALEQGGERLIR

SEQ ID NO: 13977 - protein, 309 aa, Artificial Sequence
  Synthetic sequence.
MGSSHHHHHHSSGLVPRGSHMSELARKLLEASTKLQRLNIRLAEALLEAIARLQELNLELVYLAVELTDPKRIRDEIKEVKDKSKEIIRRAEKEIDDAAKESEKILEEAREAISGSGSELAKLLLKAIAETQDLNLRAAKAFLEAAAKLQELNIRAVELLVKLTDPATIREALEHAKRRSKEIIDEAERAIRAAKRESERIIEEARRLIEKGSGSGSELARELLRAHAQLQRLNLELLRELLRALAQLQELNLDLLRLASELTDPDEARKAIARVKRGLKQKIAALKYKNAALKKKIAALKQGGERLIR

SEQ ID NO: 13978 - protein, 186 aa, Artificial Sequence
  Synthetic sequence.
SRVEEIIEDLRRLLEEIRKENADSIRASKELLDRVKEINDTIIAELERLLKDIEKEVREKGSESEEVKKALRRVLEELEKLLRRVAEINEEVLRRNSKLVEEDARRNAEVLKELKRLVEELMREIGDEDKVRKVAEVAEKVLRDIDKLDRWSHPQFEKTNGEISKLDEDTRRVAERVKKAIEDLAK

SEQ ID NO: 13979 - protein, 179 aa, Artificial Sequence
  Synthetic sequence.
SEVDEIIADNERALDEVRREVEEIDKENAERLGEWSHPQFEKGDRLAKALEEIRKGVRSRLVDELERAIREVEEVIRRVLERVRRLIEEVSKIITDVLREVERLHEEVTKELRKVEDGNSREALDALRRLIEKVVEDSARLIKKVDEALKAVNKEIEDLSREVADLVRAVAEELDARVK

SEQ ID NO: 13980 - protein, 177 aa, Artificial Sequence
  Synthetic sequence.
SSDEVLKEIEEIIRRLEAEVRRVNAEVNASTEDLAREVEEVLRATNELIEELERRVTGTEELKRVIDELRDRDRKVRRRVERVIEESAKRDDESRKRLTRAVEKLRADLKKLADDGVPEEALSKAIKDVRDIVKKVKDELKEWSHPQFEKVDRLSEELKEWLKDVERVLKELTDKDR

SEQ ID NO: 13981 - protein, 178 aa, Artificial Sequence
  Synthetic sequence.
SDAEELLKRVADLLKASLESLEKILRDSKELMDRWRKKLEDLLRESEELVDRAEKILRRGGSDKEVLDKIAEEVRRTNDDSRRLDEELHRLSRDTLRKLEENLRRTEKEVREMDKRAAERGVDERVREELKKLLTRVEWSHPQFEKGDKKILKEAHKESKEVNDRDRELLERLEESVR

SEQ ID NO: 13982 - protein, 178 aa, Artificial Sequence
  Synthetic sequence.
SDAEELLKRVADLLKASLESLEKILRDSKELMDRWSHPQFEKLGESEELVDRAEKILRRGGSDKEVLDKIAEEVRRTNDDSRRLDEELHRLSRDTLRKLEENLRRTEKEVREMDKRAAERGVDERVREELKKLLTRVEEEHRKVLETDKKILKEAHKESKEVNDRDRELLERLEESVR

SEQ ID NO: 13983 - protein, 242 aa, Artificial Sequence
  Synthetic sequence.
SEAEDLLERVKRVLDELIEIVDRNHELNARVVETSARLVERLLEEVERALETLEREIPGRELLDKAIKDLRDVLRRVAEKVKRSIEELKEVLEESRRVLEEVVRALAEVIDRVRRLVEKGVDLRDLIRELKRVLEEAVSLIERLVRLNTRAAEKDNESLRELVRAIKEALKRAVDMVRADGLDSRLVKKLDEIVKEVAKKLEDVVRANEELWSHPQFEKGSSVARLREAVERVARDLEETAR

SEQ ID NO: 13984 - protein, 235 aa, Artificial Sequence
  Synthetic sequence.
SDEERLEKVVKDVIEKVRRILEKWSHPQFEKGSELRRILEEWEKIIREVLDKVRRGSGSADALVEVLEEILRLAEELSKRVEEVLREILKLAKALSDELVKVLAEIVEAAKRISRDDELRKAVEDVARELEDLAAKDRKILDDVREALERIAKEDKDILREAEETLRRLADEMRRSGVDERLLKRVVDILARLLELNATTIERLLRILEELLKLNKELAERVIRVLEKLLEEIKR

SEQ ID NO: 13985 - protein, 235 aa, Artificial Sequence
  Synthetic sequence.
SVLETVKKALEDSSEKIERIVEEDERVAKESSDRIRRLVEEDKRVADEILDLIEKGGDTDTLAKLVEEWSRTSKKLLDDVLKLHKDWSDDSRRLLEEILRVHEELIRAVKEILDRGGKPEEVVRELEKVLKESLDTLEEIIRRLDEANARTVKRVADVIRELEDANAKVLEEIERKGDDKDAVIKVIEELIRANAAVWSHPQFEKGDLVRVNKTVWKELLRVNEKLARDLERVVK

SEQ ID NO: 13986 - protein, 235 aa, Artificial Sequence
  Synthetic sequence.
SLVDELRKSLERNVRVSEEVARRLKEALGRWSHPQFEKGGDLIRLNEDVVRVVEKVGVDESAIERVRRIIEELNRALDAVLKKNEDLVRRLTELLDKLLEENRRLVEELDEDLKRRGGTEEVIDTILELIERSIERLKRLLDELLRIVREALKDNARVADENLKALKEILDELRKDGVSDEELKRVLEKAADLHARLKDAHRKLLEDLERIIRELKKKLDEVVEENKRSVDELKR

SEQ ID NO: 13987 - protein, 237 aa, Artificial Sequence
  Synthetic sequence.
MKDAVIKVIEELIRANAAVWSHPQFEKGDLVRVNKTVWKELLRVNEKLARDLERALDERDVSAWETVKKALEDSSEKIERIVEEDERVAKESSDRIRRLVEEDKRVADEILDLIEKGGDTDTLAKLVEEWSRTSKKLLDDVLKLHKDWSDDSRRLLEEILRVHEELIRAVKEILDRGGAPEEVVRELEKVLKESLDTLEEIIRRLDEANARTVKRVADVIRELEDANAKVLEEIERK

SEQ ID NO: 13988 - protein, 175 aa, Artificial Sequence
  Synthetic sequence.
MEEAASKAIKDVRDIVKKVKDELKEWSHPQFEKVDRLSEELKEWLKDVERVLKELTDREEASEEELKRVIDELRDRDRKVRRRVERVIEESAKRDDESRKRLTRAVEKLRADLKKLSVEGASDEVLKEIEEIIRRLEAEVRRVNAEVNASTEDLAREVEEVLRATNELIEELERR

SEQ ID NO: 13989 - protein, 170 aa, Artificial Sequence
  Synthetic sequence.
SEVEDVVRKVEKLVRDLIKHVEENVRRVEEVVRKLIEEIKRIAEEITRIAEELAKEPGSEDLLRKLEKVLKEIDDKLKELEDRLRDMVRRSRESSEENERRLKRVEDEVRRDHMVLHEYVNAAGITKEVEKVNRESREVTRRVLEEAKEMLERVKKIVKEVIEKVRRVVK

SEQ ID NO: 13990 - protein, 171 aa, Artificial Sequence
  Synthetic sequence.
SEKEKVIKEARELLERLRKRLKDVNDDVTRLLDELRKENEKSREDVEREVKRLEEEVPVEDVIRELKRRLEEVDKKNRDILETLKRELDEVSRRTREELEKLRKELEEVERDHMVLHEYVNAAGITRRRLERLVEENERVVKKILDEIRRSVEENKRIVDKVRKDLDERRK

SEQ ID NO: 13991 - protein, 172 aa, Artificial Sequence
  Synthetic sequence.
SRAETVLKEVTDKIKKLADSSDELLRRNKENIDELKKSSEELLRRLTKAIEEIEKGSVDEETLEELIRRVEAELEAHHRELEKNSREDEKRNRDHHAKLEEEMRRVEERLERDHMVLHEYVNAAGITDTVRRRNEKVNEDVKRMNDKLRRDNEDVIRRVEKLLRELEEKRRT

SEQ ID NO: 13992 - protein, 172 aa, Artificial Sequence
  Synthetic sequence.
SKEEELEKLLREHHEKIKRLKEESKRINDRIRRTVEELIKESEKINRDINDTVRKGDRDEEVIRRLLEDVRRKHEELRERLKRELDKVRERHKELLDRARRATEAVKERLDRDHMVLHEYVNAAGITERNLDDLARVLKESEDDLAEILRRLKEVLEESERDLERVEREVRK

SEQ ID NO: 13993 - protein, 171 aa, Artificial Sequence
  Synthetic sequence.
SEKEKVIKEARELLERLRKRLKDVNDDVTRLLDELRKENEKSREDVEREVKRLEEEVPVEDVIRELKRRLEEVDKKNRDILETLKRELDEVSRRTREELEKLRKELEEVEKARDHMVLHEYVNAAGITRLERLVEENERVVKKILDEIRRSVEENKRIVDKVRKDLDERRK

SEQ ID NO: 13994 - protein, 173 aa, Artificial Sequence
  Synthetic sequence.
STEDVLRKIKEDVKRVIDDNRRILDEVRRTSKRVLDDLRANLKHIAEEVERVLRGSDSEEVVRELAKILDEIREEHRRLIRTNEKVLEDIERDHRRISEELKRILDEVDELLRDHMVLHEYVNAAGITVDEIKRLAEESLKRLEDLSRDHKRRAKELNDEIAKVVDELAKRAT

SEQ ID NO: 13995 - protein, 174 aa, Artificial Sequence
  Synthetic sequence.
SRDEKIRDILRRVLKEVRDSTKKVEEDLEDVHRRTEEELRKVKKRLDEVLKRVRDEGASEELKRRMEEVVRRIEELLKKLLKEDRDVVKEIRDKLDETRKEMEEVAERIKDKIRDHMVLHEYVNAAGITADRLIDLNRRIAEEVDKIVRDSIKKVEEIVTEVEKIVEKLIRDVR

SEQ ID NO: 13996 - protein, 174 aa, Artificial Sequence
  Synthetic sequence.
SELEKVVKEVADLLRRNLEKSKRVLEEVRRRLEENLRESEKVHDDNRKTARRILELVREGKDKRDLTRLLEEDDKRVKEALDKSRENNERILKEVRRALRESEEDNRRILKEVRDHMVLHEYVNAAGITRESIERSRRFIEELEKIVEETLTESEKLARASSEITKTVLDEIRK

SEQ ID NO: 13997 - protein, 171 aa, Artificial Sequence
  Synthetic sequence.
SEKEKVIKEARELLERLRKRLKDVNDDVTRLLDELRKENEKSREDVEREVKRLEEEVPVEDVIRELKRRLEEVDKKNRDILETLKRELDEVSRRTREELEKLRKELEEVEKAGRDHMVLHEYVNAAGITLERLVEENERVVKKILDEIRRSVEENKRIVDKVRKDLDERRK

SEQ ID NO: 13998 - protein, 174 aa, Artificial Sequence
  Synthetic sequence.
SEIEELEKRIDELLKELRDLSRRIAEEVKRLLEELKKLSKDSEDKLRELLERLKRKGVPEEELRRVEEEVERVVRESRKLNKETEDELRRLLEEIKESNDRVEKRARELKKLLRDHMVLHEYVNAAGITVREDKERLKKVLKDARDLIKKDKDLNEKLSRELEKLVRELEERAR

SEQ ID NO: 13999 - protein, 174 aa, Artificial Sequence
  Synthetic sequence.
DELRDVKRELDRLLRENEEIVERIAETVRRLLEELKKLTKELAEELRKLLEELRKRGVPEKELKEVADTLRKLLKDIERSNKEVEDRLRKLLEEIKESTDRLREELEEVEKLLRDHMVLHEYVNAAGITSRDNKRRMRRVLEEAKRLAKEDKERIDKIRKEIEELIKRLKDKAT

SEQ ID NO: 14000 - protein, 174 aa, Artificial Sequence
  Synthetic sequence.
DEEEDLERRIKKLLDENRELLKRIAEELRRLLEELRRLTEESADRLRRLLKELKDRGVPEKDLRDVAEKVKKVLKESEDSNRDVKRKLEKLLRDLERSTERLEREARKVRKLLRDHMVLHEYVNAAGITSRDNKELLKKIEKEIRDLIKEDKERNRELSERLRKLVEELKKKAT

SEQ ID NO: 14001 - protein, 174 aa, Artificial Sequence
  Synthetic sequence.
REIEEAAKDLDRLLEENKKLVKEVEEELRRLLKENRDLVKESEDRIRKLLEELRRRGVPEEELKEVEERARRVIEESRRSSKELEKRLRELLEELRRSTKELEDRLREIKKLLRDHMVLHEYVNAAGITSRENKEKIRKILEDVKKLSEDNKRRNEELSRRVKTLVDEIKKRAT

SEQ ID NO: 14002 - protein, 174 aa, Artificial Sequence
  Synthetic sequence.
EELERILDKVRKVIEEVRKRLRDDLRTVEKVLKETEEVLRRAAERAKRALERVEEAARRGRDRREIKEELKKVLDDLRELLRALEEKNRRVNKENEDSLRKIEEDLRDVLRKLRDHMVLHEYVNAAGITLRTIREEVERVLRKSNELSTRIKKRIDDVLETLERLLKELDDKLR

SEQ ID NO: 14003 - protein, 174 aa, Artificial Sequence
  Synthetic sequence.
SEEEVLREAAKTVEKLLDEIRRSLEKVSKRVEDSNRELKESLDRVRERVRELLEELRKNNVDRTLLEDVRRKLERIEERNEEMNDRSRRKLEELRERNRKILEDIRRTLEDLKRDHMVLHEYVNAAGITAKLVDEVDKENKRALRENEERVKTLNRENEEMLKRIEEEVRRATK

SEQ ID NO: 14004 - protein, 174 aa, Artificial Sequence
  Synthetic sequence.
SESDEVIRDLARLLDELARHVDDSVRRMDEVVKRSTREADELAKRLDELVKEVEKKPGDERVERMVAEIERLVAEVLEELKKKYEKLKREVEENLRRLEETVRDIVEKARKVTRDHMVLHEYVNAAGITERILEEAKKKHEDVLRRLEDSLRRVAELLKAALDRLREIVDRLRR

SEQ ID NO: 14005 - protein, 172 aa, Artificial Sequence
  Synthetic sequence.
SRAETVLKEVTDKIKKLADSSDELLRRNKENIDELKKSSEELLRRLTKAIEEIEKGSVDEETLEELIRRVEAELEAHHRELEKNSREDEKRNRDHHAKLEEEMRRVEERLERERDHMVLHEYVNAAGITVRRRNEKVNEDVKRMNDKLRRDNEDVIRRVEKLLRELEEKRRT

SEQ ID NO: 14006 - protein, 174 aa, Artificial Sequence
  Synthetic sequence.
KEVEDAVKELEDLLRANEDKTRSIVEDMRASNKDLEDHSRASEEEVRKLLDDLRRAGVPRDSLKRLAEDVERVTRESRELLERVHRADRELIERLKESNERLRRAIEEIRKAIRDHMVLHEYVNAAGITAEEDAERLDRLRRESEELNERVRRVDKKLLEEIRRKAKKVEDDTR

SEQ ID NO: 14007 - protein, 174 aa, Artificial Sequence
  Synthetic sequence.
DEEEDLERAIKKLLDENRELLKRIAEELRRLLEELRRLTEESADRLRRLLKELKDRGVPEEDLADVAEKVKKVLKESEDSNADVARKLEKLLRDLERSTERLEREARKVRKLLRDHMVLHEYVNAAGITSRDNKELLKKIEKEIRDLIKEDKERNIELSERLRKLVEELKKKAT

SEQ ID NO: 14008 - protein, 174 aa, Artificial Sequence
  Synthetic sequence.
SEDETIRRIVRTVHEESRKSTEDVRREVERVLRESEEVVKKVKKKVDDVLKRVEETGISEELEERMRRIIREIREHLKDNLRRVREVIERIERKLEETERRDEKVLREIEKKIRRDHMVLHEYVNAAGITRDTIRENEEIAKEVREIVERSIKNLEEVAEEVERVVRELIEARR

SEQ ID NO: 14009 - protein, 174 aa, Artificial Sequence
  Synthetic sequence.
SRDEKIRDILRRVLKEVRDSTKKVEEDLEDVHRRTEEELRKVKKRLDEVLKRVRDEGASEELKRRMEEVVRRIEELLKKLLKEDRDVVKEIRDKLDETRKEMEEVAERIKDKIRRDHMVLHEYVNAAGITDRLIDLNRRIAEEVDKIVRDSIKKVEEIVTEVEKIVEKLIRDVR

SEQ ID NO: 14010 - protein, 173 aa, Artificial Sequence
  Synthetic sequence.
SLEELLEEARKTVERLIRESERVLRESEERVRRLIEELERVVRETRKRVKEVIERVEDEEALKELEKLLREDSKRVKEVLDDLRRDLERNKRRNEKVLRELEELLKRLEELVRERDHMVLHEYVNAAGITRVKEMLKRDEDTLREIERKVKEAVRDSERTLEEIEKRVTEEKT

SEQ ID NO: 14011 - protein, 175 aa, Artificial Sequence
  Synthetic sequence.
SEKEDLERELEEVRRRVEESLRKNEEDVKRVRDELKKLLDENRKELERIRREVERANVDKRVLDEADRLLKELEDDHKKLEEDAKKALDELREEHKRLEETLRRMLKRIKEVLDRDHMVLHEYVNAAGITLRDIERVSRELNKKLEEIVRRLKKVSDELNRRIEEIAERVRRRRK

SEQ ID NO: 14012 - protein, 175 aa, Artificial Sequence
  Synthetic sequence.
SEEDELRRLLKEVNERVERLLDEIRKELEKIAEELRDLLKKNEDKLREIKRRVEENRVDEEIKKDAERALTELKEEHERLDREAKKDLDRIRKELERLEEEHRRVSERIEEVLDRDHMVLHEYVNAAGITMERTRRVIEEIKKELRDILEKLRRVSEELNKKLDEILKRIEDRTR

SEQ ID NO: 14013 - protein, 174 aa, Artificial Sequence
  Synthetic sequence.
DELRDVKRELDRLLRENEEIVERIAETVRRLLEELKKLTKELAEELRKLLEELRKRGVPEKELKEVADTLRKLLKDIERSNKEVEDRLRKLLEEIKESTDRLREELEEVEKLLRRDHMVLHEYVNAAGITRDNKRRMRRVLEEAKRLAKEDKERIDKIRKEIEELIKRLKDKAT

SEQ ID NO: 14014 - protein, 174 aa, Artificial Sequence
  Synthetic sequence.
REIEEAAKDLDRLLEENKKLVKEVEEELRRLLKENRDLVKESEDRIRKLLEELRRRGVPEEELKEVEERARRVIEESRRSSKELEKRLRELLEELRRSTKELEDRLREIKKLLRRDHMVLHEYVNAAGITRENKEKIRKILEDVKKLSEDNKRRNEELSRRVKTLVDEIKKRAT

SEQ ID NO: 14015 - protein, 175 aa, Artificial Sequence
  Synthetic sequence.
SEVDEVLREAKRIVDEVHKDNERATEESRRLVKKVHEENEEMVKDIERIVKEVKDANIDEKLVTEILKEIEEALKEAARRNKEVKDRLRELSRRVSERNREILEELKERLDRVRRDHMVLHEYVNAAGITLKRIEESLRRHRKENKRLLEELDRSLRELAKIVKEVLDEIRERTR

SEQ ID NO: 14016 - protein, 175 aa, Artificial Sequence
  Synthetic sequence.
SEMDDVLKKLAETVKRIIERLKKLTDDSRRLVEEVHRRNDKLSKESREAVRKAEERNIDEKDVRKLLEDLKKKSEEVAERNKRILDTLREISKRAEDEVRKVLKELEKTLKELERDHMVLHEYVNAAGITLDEVRKALKRHKDENDKLLKEIEDSLRRHKEENDRLLEKLKESTR

SEQ ID NO: 14017 - protein, 172 aa, Artificial Sequence
  Synthetic sequence.
SRAETVLKEVTDKIKKLADSSDELLRRNKENIDELKKSSEELLRRLTKAIEEIEKGSVDEETLEELIRRVEAELEAHHRELEKNSREDEKRNRDHHAKLEEEMRRVEERLEREGRDHMVLHEYVNAAGITRRRNEKVNEDVKRMNDKLRRDNEDVIRRVEKLLRELEEKRRT

SEQ ID NO: 14018 - protein, 174 aa, Artificial Sequence
  Synthetic sequence.
KEVEDAVKELEDLLRANEDKTRSIVEDMRASNKDLEDHSRASEEEVRKLLDDLRRAGVPRDSLKRLAEDVERVTRESRELLERVHRADRELIERLKESNERLRRAIEEIRKAIKRDHMVLHEYVNAAGITEEDAERLDRLRRESEELNERVRRVDKKLLEEIRRKAKKVEDDTR

SEQ ID NO: 14019 - protein, 175 aa, Artificial Sequence
  Synthetic sequence.
SEADDVLKKLAETVKRIIERLKKLTDDSRRLVEEVHRRNDKLSKESAEAVRKAEERGIDEKDVRKLLEDLKKKSEEVAERNKRILDTLREISKRAEDEVRKVLKELEKTLKELERDHMVLHEYVNAAGITLDEVRKALARHKDENDKLLKEIEDSLRRHKEENDRLLEKLKESTR

SEQ ID NO: 14020 - protein, 175 aa, Artificial Sequence
  Synthetic sequence.
SEIERVKKRLEELLAEVEESTRRLEERLKRLLEEAKRSSEEVEKELRRLLEAVRRGLSRDEKLVSELEARVKELLEDSRASLEELKKRVRKLAEDSARLLEEVKREVEKLKAKLRDHMVLHEYVNAAGITAKRAHDENERLIREVEELVRAHNKRNKELVDEVKRLVEKVIEEER

SEQ ID NO: 14021 - protein, 174 aa, Artificial Sequence
  Synthetic sequence.
SRDEKIRDILRRVLKEVRDSTKKVEEDLEDVHRRTEEELRKVKKRLDEVLKRVRDEGASEELKRRMEEVVRRIEELLKKLLKEDRDVVKEIRDKLDETRKEMEEVAERIKDKIRRRDHMVLHEYVNAAGITRLIDLNRRIAEEVDKIVRDSIKKVEEIVTEVEKIVEKLIRDVR

SEQ ID NO: 14022 - protein, 175 aa, Artificial Sequence
  Synthetic sequence.
SEKEDLERELEEVRRRVEESLRKNEEDVKRVRDELKKLLDENRKELERIRREVERANVDKRVLDEADRLLKELEDDHKKLEEDAKKALDELREEHKRLEETLRRMLKRIKEVLDRRDHMVLHEYVNAAGITRDIERVSRELNKKLEEIVRRLKKVSDELNRRIEEIAERVRRRRK

SEQ ID NO: 14023 - protein, 174 aa, Artificial Sequence
  Synthetic sequence.
DEEEDLERRIKKLLDENRELLKRIAEELRRLLEELRRLTEESADRLRRLLKELKDRGVPEKDLRDVAEKVKKVLKESEDSNRDVKRKLEKLLRDLERSTERLEREARKVRKLLRDRDHMVLHEYVNAAGITDNKELLKKIEKEIRDLIKEDKERNRELSERLRKLVEELKKKAT

SEQ ID NO: 14024 - protein, 175 aa, Artificial Sequence
  Synthetic sequence.
SEMDDVLKKLAETVKRIIERLKKLTDDSRRLVEEVHRRNDKLSKESREAVRKAEERNIDEKDVRKLLEDLKKKSEEVAERNKRILDTLREISKRAEDEVRKVLKELEKTLKELEDRDHMVLHEYVNAAGITDEVRKALKRHKDENDKLLKEIEDSLRRHKEENDRLLEKLKESTR

SEQ ID NO: 14025 - protein, 174 aa, Artificial Sequence
  Synthetic sequence.
SEEEVLREAAKTVEKLLDEIRRSLEKVSKRVEDSNRELKESLDRVRERVRELLEELRKNNVDRTLLEDVRRKLERIEERNEEMNDRSRRKLEELRERNRKILEDIRRTLEDLKRRRDHMVLHEYVNAAGITLVDEVDKENKRALRENEERVKTLNRENEEMLKRIEEEVRRATK

SEQ ID NO: 14026 - protein, 174 aa, Artificial Sequence
  Synthetic sequence.
SESDEVIRDLARLLDELARHVDDSVRRMDEVVKRSTREADELAKRLDELVKEVEKKPGDERVERMVAEIERLVAEVLEELKKKYEKLKREVEENLRRLEETVRDIVEKARKVTEKRDHMVLHEYVNAAGITILEEAKKKHEDVLRRLEDSLRRVAELLKAALDRLREIVDRLRR

SEQ ID NO: 14027 - protein, 172 aa, Artificial Sequence
  Synthetic sequence.
SRAETVLKEVTDKIKKLADSSDELLRRNKENIDELKKSSEELLRRLTKAIEEIEKGSVDEETLEELIRRVEAELEAHHRELEKNSREDEKRNRDHHAKLEEEMRRVEERLEREGIRDHMVLHEYVNAAGITRRNEKVNEDVKRMNDKLRRDNEDVIRRVEKLLRELEEKRRT

SEQ ID NO: 14028 - protein, 175 aa, Artificial Sequence
  Synthetic sequence.
SEADDVLKKLAETVKRIIERLKKLTDDSRRLVEEVHRRNDKLSKESAEAVRKAEERGIDEKDVRKLLEDLKKKSEEVAERNKRILDTLREISKRAEDEVRKVLKELEKTLKELEDRDHMVLHEYVNAAGITDEVRKALARHKDENDKLLKEIEDSLRRHKEENDRLLEKLKESTR

SEQ ID NO: 14029 - protein, 174 aa, Artificial Sequence
  Synthetic sequence.
KELEDVIEEVKKLLKTVNEESRRVAEEVRKLIREVSEELTEVIRRVERLVEEVAKGVDSEEALDAVRKRIEELVRRVEEVNAASKRRIEELEDELRKVDEESRETIERLIDLLRRRDHMVLHEYVNAAGITKNRKLAEEVLRRVKKIVEENRKIASEVLDDVRKLVEDVLARAS

SEQ ID NO: 14030 - protein, 175 aa, Artificial Sequence
  Synthetic sequence.
SEIERVKKRLEELLAEVEESTRRLEERLKRLLEEAKRSSEEVEKELRRLLEAVRRGLSRDEKLVSELEARVKELLEDSRASLEELKKRVRKLAEDSARLLEEVKREVEKLKAKLDRDHMVLHEYVNAAGITKRAHDENERLIREVEELVRAHNKRNKELVDEVKRLVEKVIEEER

SEQ ID NO: 14031 - protein, 174 aa, Artificial Sequence
  Synthetic sequence.
SEDETIRRIVRTVHEESRKSTEDVRREVERVLRESEEVVKKVKKKVDDVLKRVEETGISEELEERMRRIIREIREHLKDNLRRVREVIERIERKLEETERRDEKVLREIEKKIRDGRDHMVLHEYVNAAGITTIRENEEIAKEVREIVERSIKNLEEVAEEVERVVRELIEARR

SEQ ID NO: 14032 - protein, 174 aa, Artificial Sequence
  Synthetic sequence.
SRDEKIRDILRRVLKEVRDSTKKVEEDLEDVHRRTEEELRKVKKRLDEVLKRVRDEGASEELKRRMEEVVRRIEELLKKLLKEDRDVVKEIRDKLDETRKEMEEVAERIKDKIRRGRDHMVLHEYVNAAGITLIDLNRRIAEEVDKIVRDSIKKVEEIVTEVEKIVEKLIRDVR

SEQ ID NO: 14033 - protein, 173 aa, Artificial Sequence
  Synthetic sequence.
SLEELLEEARKTVERLIRESERVLRESEERVRRLIEELERVVRETRKRVKEVIERVEDEEALKELEKLLREDSKRVKEVLDDLRRDLERNKRRNEKVLRELEELLKRLEELVREGVRDHMVLHEYVNAAGITKEMLKRDEDTLREIERKVKEAVRDSERTLEEIEKRVTEEKT

SEQ ID NO: 14034 - protein, 175 aa, Artificial Sequence
  Synthetic sequence.
SEKEDLERELEEVRRRVEESLRKNEEDVKRVRDELKKLLDENRKELERIRREVERANVDKRVLDEADRLLKELEDDHKKLEEDAKKALDELREEHKRLEETLRRMLKRIKEVLDRERDHMVLHEYVNAAGITDIERVSRELNKKLEEIVRRLKKVSDELNRRIEEIAERVRRRRK

SEQ ID NO: 14035 - protein, 177 aa, Artificial Sequence
  Synthetic sequence.
SAIEKVKEVVERVLETVRDSVRRSHEESKRLIDKVRKRLEEVREEVKELIERVRRKGIPERMVEKLERDLEELLKEIKDTIDRIEEELRTSNRRLKETNDEIAKRLEELLRELSRDRDHMVLHEYVNAAGITIRDLNKKNDDNVRRVKEVIDRAEKLVRDLLREIRKLIEKLIRDTE

SEQ ID NO: 14036 - protein, 177 aa, Artificial Sequence
  Synthetic sequence.
SVLEEVRRRVEELLKTVKESVDRSHERSERLIEEVRESLKEVKRRVKELVERVREKGIPEDRVKRIEDKLREELERLERENRKIEEDLKRSNDELRRENERIAERLEELLRELSRDRDHMVLHEYVNAAGITIREANERNKRNLEDVERVIRELNKENERVLREVEKKIEKLIRETE

SEQ ID NO: 14037 - protein, 174 aa, Artificial Sequence
  Synthetic sequence.
DELRDVKRELDRLLRENEEIVERIAETVRRLLEELKKLTKELAEELRKLLEELRKRGVPEKELKEVADTLRKLLKDIERSNKEVEDRLRKLLEEIKESTDRLREELEEVEKLLRGGRDHMVLHEYVNAAGITNKRRMRRVLEEAKRLAKEDKERIDKIRKEIEELIKRLKDKAT

SEQ ID NO: 14038 - protein, 174 aa, Artificial Sequence
  Synthetic sequence.
REIEEAAKDLDRLLEENKKLVKEVEEELRRLLKENRDLVKESEDRIRKLLEELRRRGVPEEELKEVEERARRVIEESRRSSKELEKRLRELLEELRRSTKELEDRLREIKKLLRNGRDHMVLHEYVNAAGITNKEKIRKILEDVKKLSEDNKRRNEELSRRVKTLVDEIKKRAT

SEQ ID NO: 14039 - protein, 177 aa, Artificial Sequence
  Synthetic sequence.
SEAEKVVEELKKLLREVEKKIRDHTEDVKRILEELERRLRKHSEEVRRTAKELKDKNSDDDTVRKVKEELDRSHEKLREELRKVAKELKESNEELERDLKRLVEEAEDRLRRLKDRRDHMVLHEYVNAAGITKRTLDKLLRENRETLKRIEDRLRELLEENRKLLEKIERELRERSR

SEQ ID NO: 14040 - protein, 177 aa, Artificial Sequence
  Synthetic sequence.
DEVEDILRKVEEIVKKSITDARRLLKEAREIVEESIKTAEELLRRNEDIVRKLSEDVKRTTDEEKKKKLEEESRRVLEKTKRDLDRTKDDNRKALEKIRKRVKETEEENREVVDRVRDHMVLHEYVNAAGITVDDSVRVNREVLKRVEEVLEESKRVNEKVEEDVRRVHEEVRKEIK

SEQ ID NO: 14041 - protein, 174 aa, Artificial Sequence
  Synthetic sequence.
SESDEVIRDLARLLDELARHVDDSVRRMDEVVKRSTREADELAKRLDELVKEVEKKPGDERVERMVAEIERLVAEVLEELKKKYEKLKREVEENLRRLEETVRDIVEKARKVTEKGRDHMVLHEYVNAAGITLEEAKKKHEDVLRRLEDSLRRVAELLKAALDRLREIVDRLRR

SEQ ID NO: 14042 - protein, 174 aa, Artificial Sequence
  Synthetic sequence.
SESDDVIRKLRELLEELRTHVEKSIRDLRKILEDSTRHAKRSIEELERLLEEVRKKPGDEEVRKTVEEISRRVAENVKRLEDLYRRMEEEVKKNLDRLRKRVEDIIREVEEARKKGRDHMVLHEYVNAAGITLRRAAEAHKKLIDDARESLERAKREHEKLIDRLKKILEELER

SEQ ID NO: 14043 - protein, 174 aa, Artificial Sequence
  Synthetic sequence.
KEVEDAVKELEDLLRANEDKTRSIVEDMRASNKDLEDHSRASEEEVRKLLDDLRRAGVPRDSLKRLAEDVERVTRESRELLERVHRADRELIERLKESNERLRRAIEEIRKAIKGGRDHMVLHEYVNAAGITDAERLDRLRRESEELNERVRRVDKKLLEEIRRKAKKVEDDTR

SEQ ID NO: 14044 - protein, 176 aa, Artificial Sequence
  Synthetic sequence.
STAETVEKKVEEVIRENEKSMRESEEKVDRSTKRIEDVLRRLEETIRKTSDDIAKGVKGERVKEVLEENRRLLEEAKKLVDEVLETNKKLLEDDKRLNEEVSKTLKKLLEEIKSVDRDHMVLHEYVNAAGITDEARKLNEETIRRSEELVRRIERVIEEIIKRSEKLLEDVARESK

SEQ ID NO: 14045 - protein, 175 aa, Artificial Sequence
  Synthetic sequence.
SEADDVLKKLAETVKRIIERLKKLTDDSRRLVEEVHRRNDKLSKESAEAVRKAEERGIDEKDVRKLLEDLKKKSEEVAERNKRILDTLREISKRAEDEVRKVLKELEKTLKELEDRRDHMVLHEYVNAAGITEVRKALARHKDENDKLLKEIEDSLRRHKEENDRLLEKLKESTR

SEQ ID NO: 14046 - protein, 174 aa, Artificial Sequence
  Synthetic sequence.
KELEDVIEEVKKLLKTVNEESRRVAEEVRKLIREVSEELTEVIRRVERLVEEVAKGVDSEEALDAVRKRIEELVRRVEEVNAASKRRIEELEDELRKVDEESRETIERLIDLLRRGRDHMVLHEYVNAAGITNRKLAEEVLRRVKKIVEENRKIASEVLDDVRKLVEDVLARAS

SEQ ID NO: 14047 - protein, 175 aa, Artificial Sequence
  Synthetic sequence.
SEIERVKKRLEELLAEVEESTRRLEERLKRLLEEAKRSSEEVEKELRRLLEAVRRGLSRDEKLVSELEARVKELLEDSRASLEELKKRVRKLAEDSARLLEEVKREVEKLKAKLDRRDHMVLHEYVNAAGITRAHDENERLIREVEELVRAHNKRNKELVDEVKRLVEKVIEEER

SEQ ID NO: 14048 - protein, 173 aa, Artificial Sequence
  Synthetic sequence.
STEDVLRKIKEDVKRVIDDNRRILDEVRRTSKRVLDDLRANLKHIAEEVERVLRGSDSEEVVRELAKILDEIREEHRRLIRTNEKVLEDIERDHRRISEELKRILDEVDELLRGGKRDHMVLHEYVNAAGITKRLAEESLKRLEDLSRDHKRRAKELNDEIAKVVDELAKRAT

SEQ ID NO: 14049 - protein, 177 aa, Artificial Sequence
  Synthetic sequence.
SEDEDLDRVAEKLAREHKKSVEEIKRVLKSADEESKKLVRDTERVIEEIKREVEEARRGNIDEELVERLKKKIEDILRTLEERHKKLIKELREILKRLSDESRRLAEETEKVLEDLRDHMVLHEYVNAAGITVRRVKEENRKVNEEVEKRLRELEEENKKVIEDLKSTVEELVERLR

SEQ ID NO: 14050 - protein, 177 aa, Artificial Sequence; identical to SEQ ID NO: 14049
  Synthetic sequence.

SEQ ID NO: 14051 - protein, 177 aa, Artificial Sequence
  Synthetic sequence.
SKEDRLREELKKLLARLAEEIERLKRALEESNKDLKRTIDASEKHLRDVNEDVKRGGVSEELLRELERSTAENKERAKELLKRHEDLVRKVEKELADLLRRLEEIVARVDEALKRGRDHMVLHEYVNAAGITIREIEKRLEELLKRVEKLTEDAKRDLERSNREHKELADRIKETAR

SEQ ID NO: 14052 - protein, 178 aa, Artificial Sequence
  Synthetic sequence.
DEVEKLLRDLEELDRDIERKVRELLKRNKEVLDDIEREVRRLEKELRRIIKEVADVIRKTTDKRTVDKLLKELEKILKEVLDRVRRLLEEAKESLDRSREEIERLLEESKTLVDEVRRDHMVLHEYVNAAGITRDLIERAKRETDRLLEEAERLMREVVDRVRKILEEAKRLIDEARR

SEQ ID NO: 14053 - protein, 174 aa, Artificial Sequence
  Synthetic sequence.
SEDETIRRIVRTVHEESRKSTEDVRREVERVLRESEEVVKKVKKKVDDVLKRVEETGISEELEERMRRIIREIREHLKDNLRRVREVIERIERKLEETERRDEKVLREIEKKIRDGDRDHMVLHEYVNAAGITIRENEEIAKEVREIVERSIKNLEEVAEEVERVVRELIEARR

SEQ ID NO: 14054 - protein, 174 aa, Artificial Sequence
  Synthetic sequence.
SRDEKIRDILRRVLKEVRDSTKKVEEDLEDVHRRTEEELRKVKKRLDEVLKRVRDEGASEELKRRMEEVVRRIEELLKKLLKEDRDVVKEIRDKLDETRKEMEEVAERIKDKIRRGDRDHMVLHEYVNAAGITIDLNRRIAEEVDKIVRDSIKKVEEIVTEVEKIVEKLIRDVR

SEQ ID NO: 14055 - protein, 170 aa, Artificial Sequence
  Synthetic sequence.
SEVEDVVRKVEKLVRDLIKHVEENVRRVEEVVRKLIEEIKRIAEEITRIAEELAKEPGSEDLLRKLEKVLKEIDDKLKELEDRLRDMVRRSRESSEENERRLKRVEDEVRRNGISEERDHMVLHEYVNAAGITRESREVTRRVLEEAKEMLERVKKIVKEVIEKVRRVVK

SEQ ID NO: 14056 - protein, 178 aa, Artificial Sequence
  Synthetic sequence.
DDLERVLKEIKKAADKIREDNKRTADKIRKRVKELDDETRDMLRRIRKLVKEIKERVRGREEARKVIEELKKLVDEVRKRNEKSIEELKKLLKEDRDLMRRVIEELEDLVRRLREEVRDHMVLHEYVNAAGITIRDLRRVLKETSDRVRELIDKHRRLSEEVEKDVKRLIDELKKKTD

SEQ ID NO: 14057 - protein, 175 aa, Artificial Sequence
  Synthetic sequence.
SEKEDLERELEEVRRRVEESLRKNEEDVKRVRDELKKLLDENRKELERIRREVERANVDKRVLDEADRLLKELEDDHKKLEEDAKKALDELREEHKRLEETLRRMLKRIKEVLDRESRDHMVLHEYVNAAGITIERVSRELNKKLEEIVRRLKKVSDELNRRIEEIAERVRRRRK

SEQ ID NO: 14058 - protein, 175 aa, Artificial Sequence
  Synthetic sequence.
SEEDELRRLLKEVNERVERLLDEIRKELEKIAEELRDLLKKNEDKLREIKRRVEENRVDEEIKKDAERALTELKEEHERLDREAKKDLDRIRKELERLEEEHRRVSERIEEVLDKESRDHMVLHEYVNAAGITTRRVIEEIKKELRDILEKLRRVSEELNKKLDEILKRIEDRTR

SEQ ID NO: 14059 - protein, 178 aa, Artificial Sequence
  Synthetic sequence.
SSIERVEKEVRRLLRESDESLKRVMEEAKELIKSVRESTKRVEEDARDLLRKVVERTGDEREDLRRVLEELRKLIEDNRREDKRSEDELRKLIRDNKEENDRARREAEKLLEDLSRGRDHMVLHEYVNAAGITIEKLKEDDKRSLERIERIVRRNNELNKESVDRIRKIIKEMEERAD

SEQ ID NO: 14060 - protein, 177 aa, Artificial Sequence
  Synthetic sequence.
SVIERVEEEMEKVIRDSERVTKEVEDRAREVHERSEKRIREVEETSRRVLEELRRAGVDKRILDELRKRIKDSREDLERINEELRRALRKLLEDSKRINEELRKTLEELRKRLERVDRDHMVLHEYVNAAGITEDSIRKLEELARRVDELVRESIERVDRNVEENKRLVREAIERRR

SEQ ID NO: 14061 - protein, 177 aa, Artificial Sequence
  Synthetic sequence.
SEAEKVVEELKKLLREVEKKIRDHTEDVKRILEELERRLRKHSEEVRRTAKELKDKNSDDDTVRKVKEELDRSHEKLREELRKVAKELKESNEELERDLKRLVEEAEDRLRRLKDRVRDHMVLHEYVNAAGITRTLDKLLRENRETLKRIEDRLRELLEENRKLLEKIERELRERSR

SEQ ID NO: 14062 - protein, 174 aa, Artificial Sequence
  Synthetic sequence.
EELERILDKVRKVIEEVRKRLRDDLRTVEKVLKETEEVLRRAAERAKRALERVEEAARRGRDRREIKEELKKVLDDLRELLRALEEKNRRVNKENEDSLRKIEEDLRDVLRKLEEEIRDHMVLHEYVNAAGITREEVERVLRKSNELSTRIKKRIDDVLETLERLLKELDDKLR

SEQ ID NO: 14063 - protein, 178 aa, Artificial Sequence
  Synthetic sequence.
SKVEKLEEEIARLVERSRRLVEELKKEVTKVKEKVDEIVERSRRHVKKVVEKLRDIKRRGGSEEVLRRVTEELKKVLEDNRRVIEEVLRDLERILEELKRKAEEVTKRNRDDLKRLRRDHMVLHEYVNAAGITDRSEKELRTVLRDVTEDIKRIAEELKKALEDSTEIIRRAEDELRT

SEQ ID NO: 14064 - protein, 177 aa, Artificial Sequence
  Synthetic sequence.
DEVEDILRKVEEIVKKSITDARRLLKEAREIVEESIKTAEELLRRNEDIVRKLSEDVKRTTDEEKKKKLEEESRRVLEKTKRDLDRTKDDNRKALEKIRKRVKETEEENREVVDRVRRDHMVLHEYVNAAGITDDSVRVNREVLKRVEEVLEESKRVNEKVEEDVRRVHEEVRKEIK

SEQ ID NO: 14065 - protein, 175 aa, Artificial Sequence
  Synthetic sequence.
SEVDEVLREAKRIVDEVHKDNERATEESRRLVKKVHEENEEMVKDIERIVKEVKDANIDEKLVTEILKEIEEALKEAARRNKEVKDRLRELSRRVSERNREILEELKERLDRVRERRRDHMVLHEYVNAAGITIEESLRRHRKENKRLLEELDRSLRELAKIVKEVLDEIRERTR

SEQ ID NO: 14066 - protein, 175 aa, Artificial Sequence
  Synthetic sequence.
SEMDDVLKKLAETVKRIIERLKKLTDDSRRLVEEVHRRNDKLSKESREAVRKAEERNIDEKDVRKLLEDLKKKSEEVAERNKRILDTLREISKRAEDEVRKVLKELEKTLKELEDRRRDHMVLHEYVNAAGITVRKALKRHKDENDKLLKEIEDSLRRHKEENDRLLEKLKESTR

SEQ ID NO: 14067 - protein, 178 aa, Artificial Sequence
  Synthetic sequence.
SEEEKLKEVKDRIREVLRKLEEHTDKVKKEVEKVLRDIRRTTDELKKEVRAMLERLRRKKKDAEDLLRELEKIIEEIERELDRVLEENDKMAEEWKKLLDKVLDDNRKSIRDIEKELRDHMVLHEYVNAAGITLRDDEETNRDVVKKVREAVKKDADTNRKVIEEVKKVLEDAARRLD

SEQ ID NO: 14068 - protein, 176 aa, Artificial Sequence
  Synthetic sequence.
REAEEAKEEVEELNRRNKKELDDARRRVDELDKRNKDRLKESSDRVKRLVEELERVKEEGRSDDRLREKIERMLKTSADELERLKEENKRALRDLAERLRELIERNRRKLEEITRRTRDHMVLHEYVNAAGITSIRELERVLEELAEKIDRSLKELDDVLRKNETDLKRVIEDLKR

SEQ ID NO: 14069 - protein, 174 aa, Artificial Sequence
  Synthetic sequence.
SEEEVLREAAKTVEKLLDEIRRSLEKVSKRVEDSNRELKESLDRVRERVRELLEELRKNNVDRTLLEDVRRKLERIEERNEEMNDRSRRKLEELRERNRKILEDIRRTLEDLKRRQLRDHMVLHEYVNAAGITDEVDKENKRALRENEERVKTLNRENEEMLKRIEEEVRRATK

SEQ ID NO: 14070 - protein, 178 aa, Artificial Sequence
  Synthetic sequence.
DAEELVRELEERIKRSHERLEELLREVKRLIERSHEELKRLNEEVLRELDRVLDEVAKRGSDSEELLRELEERVARIKERSKESYARSKESLDRAKEVLEELYRASKRSLEEFERELRDHMVLHEYVNAAGITVKENAELAERVFREVEKIVRENTKLAEDSVRELKRLVEELKKRAK

SEQ ID NO: 14071 - protein, 174 aa, Artificial Sequence
  Synthetic sequence.
SESDEVIRDLARLLDELARHVDDSVRRMDEVVKRSTREADELAKRLDELVKEVEKKPGDERVERMVAEIERLVAEVLEELKKKYEKLKREVEENLRRLEETVRDIVEKARKVTEKGVRDHMVLHEYVNAAGITEEAKKKHEDVLRRLEDSLRRVAELLKAALDRLREIVDRLRR

SEQ ID NO: 14072 - protein, 174 aa, Artificial Sequence
  Synthetic sequence.
SESDDVIRKLRELLEELRTHVEKSIRDLRKILEDSTRHAKRSIEELERLLEEVRKKPGDEEVRKTVEEISRRVAENVKRLEDLYRRMEEEVKKNLDRLRKRVEDIIREVEEARKKGVRDHMVLHEYVNAAGITRRAAEAHKKLIDDARESLERAKREHEKLIDRLKKILEELER

SEQ ID NO: 14073 - protein, 172 aa, Artificial Sequence
  Synthetic sequence.
SRAETVLKEVTDKIKKLADSSDELLRRNKENIDELKKSSEELLRRLTKAIEEIEKGSVDEETLEELIRRVEAELEAHHRELEKNSREDEKRNRDHHAKLEEEMRRVEERLEREGIDDRDHMVLHEYVNAAGITNEKVNEDVKRMNDKLRRDNEDVIRRVEKLLRELEEKRRT

SEQ ID NO: 14074 - protein, 178 aa, Artificial Sequence
  Synthetic sequence.
SEAEKAKETIDRLADRVRKLLEEIKRSLDDSRRKSKETVEENEKTLDRMRKEVDAAKRGSVSEEELERLIRKLKKTLDELRRRHEKLVEDLRRNLERIKRRLEELTREMRETLERLARDHMVLHEYVNAAGITRRLTKELEDVLREYERELRRLEEENKRVIDKTEEEIRRLADRLRR

SEQ ID NO: 14075 - protein, 178 aa, Artificial Sequence
  Synthetic sequence.
DEARELVKELEDLIREITKTVRRLLEESEELIKRIDDAVDDLRRADEDLNREIKEEIEKGKSKESLEALIERLKESLERVKRTIEKLIRDLERLNEKLRRDVESLVAELEKILSKIKRDHMVLHEYVNAAGITKELEKEAREILKRSEDETDKLREKAERILEDLERANRRTMDEARR

SEQ ID NO: 14076 - protein, 175 aa, Artificial Sequence
  Synthetic sequence.
SEADDVLKKLAETVKRIIERLKKLTDDSRRLVEEVHRRNDKLSKESAEAVRKAEERGIDEKDVRKLLEDLKKKSEEVAERNKRILDTLREISKRAEDEVRKVLKELEKTLKELEDRRRDHMVLHEYVNAAGITVRKALARHKDENDKLLKEIEDSLRRHKEENDRLLEKLKESTR

SEQ ID NO: 14077 - protein, 175 aa, Artificial Sequence
  Synthetic sequence.
SEAEEIRRRLEEISRRSVEHLRKVLEEIKRISERSKRHLDRVLEENARRLEELAELLKRGGDKEELLADLKAVHDESRKVIEKNAEENDRALKAAKEVIDENRERNKRVLDEVRKGGRDHMVLHEYVNAAGITEERIKRIEEEIKKIIDKSREDIKRVLEEIERLNAKAADDLRK

SEQ ID NO: 14078 - protein, 175 aa, Artificial Sequence
  Synthetic sequence.
SEIERVKKRLEELLAEVEESTRRLEERLKRLLEEAKRSSEEVEKELRRLLEAVRRGLSRDEKLVSELEARVKELLEDSRASLEELKKRVRKLAEDSARLLEEVKREVEKLKAKLDRGRDHMVLHEYVNAAGITAHDENERLIREVEELVRAHNKRNKELVDEVKRLVEKVIEEER

SEQ ID NO: 14079 - protein, 177 aa, Artificial Sequence
  Synthetic sequence.
SEDEDLDRVAEKLAREHKKSVEEIKRVLKSADEESKKLVRDTERVIEEIKREVEEARRGNIDEELVERLKKKIEDILRTLEERHKKLIKELREILKRLSDESRRLAEETEKVLEDLERDHMVLHEYVNAAGITRRVKEENRKVNEEVEKRLRELEEENKKVIEDLKSTVEELVERLR

SEQ ID NO: 14080 - protein, 177 aa, Artificial Sequence
  Synthetic sequence.
SKEDRLREELKKLLARLAEEIERLKRALEESNKDLKRTIDASEKHLRDVNEDVKRGGVSEELLRELERSTAENKERAKELLKRHEDLVRKVEKELADLLRRLEEIVARVDEALKRGIRDHMVLHEYVNAAGITREIEKRLEELLKRVEKLTEDAKRDLERSNREHKELADRIKETAR

SEQ ID NO: 14081 - protein, 174 aa, Artificial Sequence
  Synthetic sequence.
SEDETIRRIVRTVHEESRKSTEDVRREVERVLRESEEVVKKVKKKVDDVLKRVEETGISEELEERMRRIIREIREHLKDNLRRVREVIERIERKLEETERRDEKVLREIEKKIRDGDGRDHMVLHEYVNAAGITRENEEIAKEVREIVERSIKNLEEVAEEVERVVRELIEARR

SEQ ID NO: 14082 - protein, 178 aa, Artificial Sequence
  Synthetic sequence.
DDLERVLKEIKKAADKIREDNKRTADKIRKRVKELDDETRDMLRRIRKLVKEIKERVRGREEARKVIEELKKLVDEVRKRNEKSIEELKKLLKEDRDLMRRVIEELEDLVRRLREEVRRDHMVLHEYVNAAGITRDLRRVLKETSDRVRELIDKHRRLSEEVEKDVKRLIDELKKKTD

SEQ ID NO: 14083 - protein, 175 aa, Artificial Sequence
  Synthetic sequence.
SEKEDLERELEEVRRRVEESLRKNEEDVKRVRDELKKLLDENRKELERIRREVERANVDKRVLDEADRLLKELEDDHKKLEEDAKKALDELREEHKRLEETLRRMLKRIKEVLDRESDRDHMVLHEYVNAAGITERVSRELNKKLEEIVRRLKKVSDELNRRIEEIAERVRRRRK

SEQ ID NO: 14084 - protein, 175 aa, Artificial Sequence
  Synthetic sequence.
SEEDELRRLLKEVNERVERLLDEIRKELEKIAEELRDLLKKNEDKLREIKRRVEENRVDEEIKKDAERALTELKEEHERLDREAKKDLDRIRKELERLEEEHRRVSERIEEVLDKESDRDHMVLHEYVNAAGITRRVIEEIKKELRDILEKLRRVSEELNKKLDEILKRIEDRTR

SEQ ID NO: 14085 - protein, 174 aa, Artificial Sequence
  Synthetic sequence.
DELRDVKRELDRLLRENEEIVERIAETVRRLLEELKKLTKELAEELRKLLEELRKRGVPEKELKEVADTLRKLLKDIERSNKEVEDRLRKLLEEIKESTDRLREELEEVEKLLRGGKDRDHMVLHEYVNAAGITRRMRRVLEEAKRLAKEDKERIDKIRKEIEELIKRLKDKAT

SEQ ID NO: 14086 - protein, 178 aa, Artificial Sequence
  Synthetic sequence.
SSKDEIRRRVEEVVERSDEIVKRSREHVKTVVDELDRVVKELERKVREVVKKLDKIRKDGGSEETLKRVLDELREILKELKEEVKKVKRKLEKVVKENRDTIREVEERNRKILDELRKRDHMVLHEYVNAAGITKSEEKLRRVLKESEDIAKEAEDRLKTVLERVERIADEVLKRLTK

SEQ ID NO: 14087 - protein, 178 aa, Artificial Sequence
  Synthetic sequence.
SKVEKLEEEIARLVERSRRLVEELKKEVTKVKEKVDEIVERSRRHVKKVVEKLRDIKRRGGSEEVLRRVTEELKKVLEDNRRVIEEVLRDLERILEELKRKAEEVTKRNRDDLKRLRDRDHMVLHEYVNAAGITRSEKELRTVLRDVTEDIKRIAEELKKALEDSTEIIRRAEDELRT

SEQ ID NO: 14088 - protein, 175 aa, Artificial Sequence
  Synthetic sequence.
SEVDEVLREAKRIVDEVHKDNERATEESRRLVKKVHEENEEMVKDIERIVKEVKDANIDEKLVTEILKEIEEALKEAARRNKEVKDRLRELSRRVSERNREILEELKERLDRVRERRKRDHMVLHEYVNAAGITEESLRRHRKENKRLLEELDRSLRELAKIVKEVLDEIRERTR

SEQ ID NO: 14089 - protein, 175 aa, Artificial Sequence
  Synthetic sequence.
SEMDDVLKKLAETVKRIIERLKKLTDDSRRLVEEVHRRNDKLSKESREAVRKAEERNIDEKDVRKLLEDLKKKSEEVAERNKRILDTLREISKRAEDEVRKVLKELEKTLKELEDRRPRDHMVLHEYVNAAGITRKALKRHKDENDKLLKEIEDSLRRHKEENDRLLEKLKESTR

SEQ ID NO: 14090 - protein, 178 aa, Artificial Sequence
  Synthetic sequence.
SEEEKLKEVKDRIREVLRKLEEHTDKVKKEVEKVLRDIRRTTDELKKEVRAMLERLRRKKKDAEDLLRELEKIIEEIERELDRVLEENDKMAEEWKKLLDKVLDDNRKSIRDIEKELDRDHMVLHEYVNAAGITRDDEETNRDVVKKVREAVKKDADTNRKVIEEVKKVLEDAARRLD

SEQ ID NO: 14091 - protein, 178 aa, Artificial Sequence
  Synthetic sequence.
KAAEEIRKKVEDYKRESEKILEEVEDHSRRSKETLKRLLDDLRRAVEELKRRLEELKRRPRTEEIAKRAEEAVRRAAERIKKVIDDVERHIRENAKELKRLLEEDREASRRLEDEIDKRDHMVLHEYVNAAGITRANEESERVLRELAERNKTALEEAERVLRRLKEEIEKVLRKLKK

SEQ ID NO: 14092 - protein, 176 aa, Artificial Sequence
  Synthetic sequence.
REAEEAKEEVEELNRRNKKELDDARRRVDELDKRNKDRLKESSDRVKRLVEELERVKEEGRSDDRLREKIERMLKTSADELERLKEENKRALRDLAERLRELIERNRRKLEEITRRTVRDHMVLHEYVNAAGITIRELERVLEELAEKIDRSLKELDDVLRKNETDLKRVIEDLKR

SEQ ID NO: 14093 - protein, 174 aa, Artificial Sequence
  Synthetic sequence.
SEEEVLREAAKTVEKLLDEIRRSLEKVSKRVEDSNRELKESLDRVRERVRELLEELRKNNVDRTLLEDVRRKLERIEERNEEMNDRSRRKLEELRERNRKILEDIRRTLEDLKRRQLPRDHMVLHEYVNAAGITEVDKENKRALRENEERVKTLNRENEEMLKRIEEEVRRATK

SEQ ID NO: 14094 - protein, 179 aa, Artificial Sequence
  Synthetic sequence.
RLEDEVRKMEKEVREEVKRLEDESRKVLEESRRNLDKLREESKRVLDTVRERIKDLRRRGLDERVLRELLKRVREVHERNRKLLDEVRRASEKVHEDNRRILEEVRKTVKDVVDKLRRRDHMVLHEYVNAAGITLEDVEREVKKSIEEVKEINRRLNEEVKKTIEEVKEIVKEVTERAK

SEQ ID NO: 14095 - protein, 178 aa, Artificial Sequence
  Synthetic sequence.
SEAEKAKETIDRLADRVRKLLEEIKRSLDDSRRKSKETVEENEKTLDRMRKEVDAAKRGSVSEEELERLIRKLKKTLDELRRRHEKLVEDLRRNLERIKRRLEELTREMRETLERLARRDHMVLHEYVNAAGITRLTKELEDVLREYERELRRLEEENKRVIDKTEEEIRRLADRLRR

SEQ ID NO: 14096 - protein, 179 aa, Artificial Sequence
  Synthetic sequence.
SEVEELIKRLAKVLKELVDKVRKVIEDTKELLERLKRRSEDHIRKLREVLKEAKDQPIDDEELKEILDRLRKTLEELEEELKKALEDDREEAKRLVDDARRVLKELEEEVREIRERRGRDHMVLHEYVNAAGITEEKIREVIKEWERVHREVEELLKRLIDENRKVLDEIRKLLEEKSK

SEQ ID NO: 14097 - protein, 178 aa, Artificial Sequence
  Synthetic sequence.
DEARELVKELEDLIREITKTVRRLLEESEELIKRIDDAVDDLRRADEDLNREIKEEIEKGKSKESLEALIERLKESLERVKRTIEKLIRDLERLNEKLRRDVESLVAELEKILSKIKRRDHMVLHEYVNAAGITELEKEAREILKRSEDETDKLREKAERILEDLERANRRTMDEARR

SEQ ID NO: 14098 - protein, 175 aa, Artificial Sequence
  Synthetic sequence.
SEADDVLKKLAETVKRIIERLKKLTDDSRRLVEEVHRRNDKLSKESAEAVRKAEERGIDEKDVRKLLEDLKKKSEEVAERNKRILDTLREISKRAEDEVRKVLKELEKTLKELEDRRPRDHMVLHEYVNAAGITRKALARHKDENDKLLKEIEDSLRRHKEENDRLLEKLKESTR

SEQ ID NO: 14099 - protein, 177 aa, Artificial Sequence
  Synthetic sequence.
SEDEDLDRVAEKLAREHKKSVEEIKRVLKSADEESKKLVRDTERVIEEIKREVEEARRGNIDEELVERLKKKIEDILRTLEERHKKLIKELREILKRLSDESRRLAEETEKVLEDLERRDHMVLHEYVNAAGITRVKEENRKVNEEVEKRLRELEEENKKVIEDLKSTVEELVERLR

SEQ ID NO: 14100 - protein, 177 aa, Artificial Sequence
  Synthetic sequence.
ELREDVERVVDEIRRLVEENVRRIDEVAKDIKRLADDNVRRVKELVRKIEEDIRRLKEEGVTEVVDELREEVRKLSEDNRRHSRELIERVKKLLKELEEHSRDLKRRVKELLEDLKRKGRDHMVLHEYVNAAGITERKSRDALRRLEEAIRRVRRESERVNRELDEVIKRVTEELKK

SEQ ID NO: 14101 - protein, 174 aa, Artificial Sequence
  Synthetic sequence.
SELEKVVKEVADLLRRNLEKSKRVLEEVRRRLEENLRESEKVHDDNRKTARRILELVREGKDKRDLTRLLEEDDKRVKEALDKSRENNERILKEVRRALRESEEDNRRILKEVREKVDSRDHMVLHEYVNAAGITSRRFIEELEKIVEETLTESEKLARASSEITKTVLDEIRK

SEQ ID NO: 14102 - protein, 175 aa, Artificial Sequence
  Synthetic sequence.
SEKEDLERELEEVRRRVEESLRKNEEDVKRVRDELKKLLDENRKELERIRREVERANVDKRVLDEADRLLKELEDDHKKLEEDAKKALDELREEHKRLEETLRRMLKRIKEVLDRESDKRDHMVLHEYVNAAGITRVSRELNKKLEEIVRRLKKVSDELNRRIEEIAERVRRRRK

SEQ ID NO: 14103 - protein, 175 aa, Artificial Sequence
  Synthetic sequence.
SEEDELRRLLKEVNERVERLLDEIRKELEKIAEELRDLLKKNEDKLREIKRRVEENRVDEEIKKDAERALTELKEEHERLDREAKKDLDRIRKELERLEEEHRRVSERIEEVLDKESDKRDHMVLHEYVNAAGITRVIEEIKKELRDILEKLRRVSEELNKKLDEILKRIEDRTR

SEQ ID NO: 14104 - protein, 177 aa, Artificial Sequence
  Synthetic sequence.
SAIEKVKEVVERVLETVRDSVRRSHEESKRLIDKVRKRLEEVREEVKELIERVRRKGIPERMVEKLERDLEELLKEIKDTIDRIEEELRTSNRRLKETNDEIAKRLEELLRELSRDRDKRDHMVLHEYVNAAGITLNKKNDDNVRRVKEVIDRAEKLVRDLLREIRKLIEKLIRDTE

SEQ ID NO: 14105 - protein, 179 aa, Artificial Sequence
  Synthetic sequence.
SSKEVADELRKKAEKVLDELRKIIRELERKNEDSLRRTEEIVRRLEEEAERVLRDLVRTRGEDDRLVREVERLLRELKRRLEELIRRSEELIKRSREEVDRVIRTVEKLLEELDRLLRARDHMVLHEYVNAAGITEEIKDLARKLAKSSDDTVREDEKLVEELRKDVKRIVRKIKKDLE

SEQ ID NO: 14106 - protein, 174 aa, Artificial Sequence
  Synthetic sequence.
DELRDVKRELDRLLRENEEIVERIAETVRRLLEELKKLTKELAEELRKLLEELRKRGVPEKELKEVADTLRKLLKDIERSNKEVEDRLRKLLEEIKESTDRLREELEEVEKLLRGGKDVRDHMVLHEYVNAAGITRMRRVLEEAKRLAKEDKERIDKIRKEIEELIKRLKDKAT

SEQ ID NO: 14107 - protein, 174 aa, Artificial Sequence
  Synthetic sequence.
DEEEDLERRIKKLLDENRELLKRIAEELRRLLEELRRLTEESADRLRRLLKELKDRGVPEKDLRDVAEKVKKVLKESEDSNRDVKRKLEKLLRDLERSTERLEREARKVRKLLRDGKDIRDHMVLHEYVNAAGITLLKKIEKEIRDLIKEDKERNRELSERLRKLVEELKKKAT

SEQ ID NO: 14108 - protein, 178 aa, Artificial Sequence
  Synthetic sequence.
SSKDEIRRRVEEVVERSDEIVKRSREHVKTVVDELDRVVKELERKVREVVKKLDKIRKDGGSEETLKRVLDELREILKELKEEVKKVKRKLEKVVKENRDTIREVEERNRKILDELRKRRDHMVLHEYVNAAGITSEEKLRRVLKESEDIAKEAEDRLKTVLERVERIADEVLKRLTK

SEQ ID NO: 14109 - protein, 178 aa, Artificial Sequence
  Synthetic sequence.
SKVEKLEEEIARLVERSRRLVEELKKEVTKVKEKVDEIVERSRRHVKKVVEKLRDIKRRGGSEEVLRRVTEELKKVLEDNRRVIEEVLRDLERILEELKRKAEEVTKRNRDDLKRLRDSRDHMVLHEYVNAAGITSEKELRTVLRDVTEDIKRIAEELKKALEDSTEIIRRAEDELRT

SEQ ID NO: 14110 - protein, 175 aa, Artificial Sequence
  Synthetic sequence.
SEVDEVLREAKRIVDEVHKDNERATEESRRLVKKVHEENEEMVKDIERIVKEVKDANIDEKLVTEILKEIEEALKEAARRNKEVKDRLRELSRRVSERNREILEELKERLDRVRERRKDRDHMVLHEYVNAAGITESLRRHRKENKRLLEELDRSLRELAKIVKEVLDEIRERTR

SEQ ID NO: 14111 - protein, 175 aa, Artificial Sequence
  Synthetic sequence.
SEMDDVLKKLAETVKRIIERLKKLTDDSRRLVEEVHRRNDKLSKESREAVRKAEERNIDEKDVRKLLEDLKKKSEEVAERNKRILDTLREISKRAEDEVRKVLKELEKTLKELEDRRPDRDHMVLHEYVNAAGITKALKRHKDENDKLLKEIEDSLRRHKEENDRLLEKLKESTR

SEQ ID NO: 14112 - protein, 178 aa, Artificial Sequence
  Synthetic sequence.
SEEEKLKEVKDRIREVLRKLEEHTDKVKKEVEKVLRDIRRTTDELKKEVRAMLERLRRKKKDAEDLLRELEKIIEEIERELDRVLEENDKMAEEWKKLLDKVLDDNRKSIRDIEKELDDRDHMVLHEYVNAAGITDDEETNRDVVKKVREAVKKDADTNRKVIEEVKKVLEDAARRLD

SEQ ID NO: 14113 - protein, 179 aa, Artificial Sequence
  Synthetic sequence.
RLEDEVRKMEKEVREEVKRLEDESRKVLEESRRNLDKLREESKRVLDTVRERIKDLRRRGLDERVLRELLKRVREVHERNRKLLDEVRRASEKVHEDNRRILEEVRKTVKDVVDKLRRVRDHMVLHEYVNAAGITEDVEREVKKSIEEVKEINRRLNEEVKKTIEEVKEIVKEVTERAK

SEQ ID NO: 14114 - protein, 174 aa, Artificial Sequence
  Synthetic sequence.
SESDEVIRDLARLLDELARHVDDSVRRMDEVVKRSTREADELAKRLDELVKEVEKKPGDERVERMVAEIERLVAEVLEELKKKYEKLKREVEENLRRLEETVRDIVEKARKVTEKGVSKRDHMVLHEYVNAAGITAKKKHEDVLRRLEDSLRRVAELLKAALDRLREIVDRLRR

SEQ ID NO: 14115 - protein, 179 aa, Artificial Sequence
  Synthetic sequence.
SEVEELIKRLAKVLKELVDKVRKVIEDTKELLERLKRRSEDHIRKLREVLKEAKDQPIDDEELKEILDRLRKTLEELEEELKKALEDDREEAKRLVDDARRVLKELEEEVREIRERRGERDHMVLHEYVNAAGITEKIREVIKEWERVHREVEELLKRLIDENRKVLDEIRKLLEEKSK

SEQ ID NO: 14116 - protein, 178 aa, Artificial Sequence
  Synthetic sequence.
DDAERILREMERLLEENKEISDEIAKELKRLLDENRKLSEDVVKALEDLLRDLERRSGVSEEVLKRVREVLERIKRELDRSDDELRKVAERILRDAERSNDELRKVIEEIEEELRGSRDRDHMVLHEYVNAAGITENKERLKELLRELKKLSDENKERIKKLLSDAEKIIEDVARRAK

SEQ ID NO: 14117 - protein, 178 aa, Artificial Sequence
  Synthetic sequence.
DEARELVKELEDLIREITKTVRRLLEESEELIKRIDDAVDDLRRADEDLNREIKEEIEKGKSKESLEALIERLKESLERVKRTIEKLIRDLERLNEKLRRDVESLVAELEKILSKIKRGRDHMVLHEYVNAAGITLEKEAREILKRSEDETDKLREKAERILEDLERANRRTMDEARR

SEQ ID NO: 14118 - protein, 180 aa, Artificial Sequence
  Synthetic sequence.
REVEEMIKELEELLKDLKEKNERASKRNRELVRRLEEENKRVIEELKKLVKELEDLVRSGEDEEVLREVLKRLEEVLERVRALNERVLEAIEKSLEEVKASNEAVKRRLKELLEEAERGRDHMVLHEYVNAAGITAKRIDELDEYTRESIRRAKKEIERLNRETKKVIEEVVKRIEEERK

SEQ ID NO: 14119 - protein, 178 aa, Artificial Sequence
  Synthetic sequence.
SDAEELLKRVADLLKASLESLEKILRDSKELMDRWRKKLEDLLRESEELVDRAEKILRRGGSDKEVLDKIAEEVRRTNDDSRRLDEELHRLSRDTLRKLEENLRRTEKEVREMDKRAAERDHMVLHEYVNAAGITRVEEEHRKVLETDKKILKEAHKESKEVNDRDRELLERLEESVR

SEQ ID NO: 14120 - protein, 175 aa, Artificial Sequence
  Synthetic sequence.
SEIERVKKRLEELLAEVEESTRRLEERLKRLLEEAKRSSEEVEKELRRLLEAVRRGLSRDEKLVSELEARVKELLEDSRASLEELKKRVRKLAEDSARLLEEVKREVEKLKAKLDRGGDRDHMVLHEYVNAAGITDENERLIREVEELVRAHNKRNKELVDEVKRLVEKVIEEER

SEQ ID NO: 14121 - protein, 180 aa, Artificial Sequence
  Synthetic sequence.
SAEELLREVAELVKRVDEDLRRLLEEVRASNEEVIRRLEEILKRIEEENRKVVEELRRGGVSEDLVRESKRLVDESRRVIEKLVKESADSVERTRETVDRLREELKRLVEEIAKMVKGGRDHMVLHEYVNAAGITLERLKRTIEELLKRNRDLLADAEEKARRLLEENRKLLKAARDTAT

SEQ ID NO: 14122 - protein, 177 aa, Artificial Sequence
  Synthetic sequence.
SEDEDLDRVAEKLAREHKKSVEEIKRVLKSADEESKKLVRDTERVIEEIKREVEEARRGNIDEELVERLKKKIEDILRTLEERHKKLIKELREILKRLSDESRRLAEETEKVLEDLERKRDHMVLHEYVNAAGITVKEENRKVNEEVEKRLRELEEENKKVIEDLKSTVEELVERLR

SEQ ID NO: 14123 - protein, 181 aa, Artificial Sequence
  Synthetic sequence.
SEVERVLEDLRRLVRDVEEKLRRIIERDRRLVEEVERENRKTIRKIEELLRKVLEELKDISDKKTIERIVREIIKEARDLVRRNHERNREIVDESRRLVEELRRIVEEIIRRLRELLERVRDHMVLHEYVNAAGITEKRLRELLKELEKTSRDLKKRLEELDRELKALVEKVERDLEELRK

SEQ ID NO: 14124 - protein, 177 aa, Artificial Sequence
  Synthetic sequence.
KEEEDLEREVKRLEDKVREDAKKLEEVVKTVEKLVRDDARRNEEVVKEVADRVRRLTERKLDEETLRKVKEDLKRTLERLKRENEKSLEELRDILRRLKKENDDTLKELRDELKRLTDSGRDHMVLHEYVNAAGITEEVSREVEKRLRRIIRELERVSKEVLDRLREIIEKLDRDAT

SEQ ID NO: 14125 - protein, 174 aa, Artificial Sequence
  Synthetic sequence.
SEDETIRRIVRTVHEESRKSTEDVRREVERVLRESEEVVKKVKKKVDDVLKRVEETGISEELEERMRRIIREIREHLKDNLRRVREVIERIERKLEETERRDEKVLREIEKKIRDGDGRERDHMVLHEYVNAAGITNEEIAKEVREIVERSIKNLEEVAEEVERVVRELIEARR

SEQ ID NO: 14126 - protein, 174 aa, Artificial Sequence
  Synthetic sequence.
SRDEKIRDILRRVLKEVRDSTKKVEEDLEDVHRRTEEELRKVKKRLDEVLKRVRDEGASEELKRRMEEVVRRIEELLKKLLKEDRDVVKEIRDKLDETRKEMEEVAERIKDKIRRGDGRERDHMVLHEYVNAAGITNRRIAEEVDKIVRDSIKKVEEIVTEVEKIVEKLIRDVR

SEQ ID NO: 14127 - protein, 181 aa, Artificial Sequence
  Synthetic sequence.
DEERKLEKSLKDVEDTHRRLLEKNDEDLKELRKRVEDMLRRLEDALRRILEDIEEKLKRIEDDETLKRLRKRVKELLDEIRRRLERLEREVDKRLEEIKERNDRHHEEAKKELKRIRDKIRDHMVLHEYVNAAGITLRKVAEDLKRSNDEVKELAERLEETIRDLLRRIEEILKEIEERVR

SEQ ID NO: 14128 - protein, 181 aa, Artificial Sequence
  Synthetic sequence.
DEEETLEDVLRELEERVEKLLRDLTRDLERVEKEHKELLKRNKEAIDEIEKRIEELLKRIEDDEKLRRLKEEVRKLVEESRERNKRHHKEVREVLERIRELLERLEKELRRALEEIRDKIRDHMVLHEYVNAAGITLRRAEEVIRDLERKVRKLERDIRENIKKNHREVREILRKIEEDVR

SEQ ID NO: 14129 - protein, 175 aa, Artificial Sequence
  Synthetic sequence.
SEKEDLERELEEVRRRVEESLRKNEEDVKRVRDELKKLLDENRKELERIRREVERANVDKRVLDEADRLLKELEDDHKKLEEDAKKALDELREEHKRLEETLRRMLKRIKEVLDRESDKMRDHMVLHEYVNAAGITVSRELNKKLEEIVRRLKKVSDELNRRIEEIAERVRRRRK

SEQ ID NO: 14130 - protein, 177 aa, Artificial Sequence
  Synthetic sequence.
SAIEKVKEVVERVLETVRDSVRRSHEESKRLIDKVRKRLEEVREEVKELIERVRRKGIPERMVEKLERDLEELLKEIKDTIDRIEEELRTSNRRLKETNDEIAKRLEELLRELSRDRDKDRDHMVLHEYVNAAGITNKKNDDNVRRVKEVIDRAEKLVRDLLREIRKLIEKLIRDTE

SEQ ID NO: 14131 - protein, 178 aa, Artificial Sequence
  Synthetic sequence.
SSIERVEKEVRRLLRESDESLKRVMEEAKELIKSVRESTKRVEEDARDLLRKVVERTGDEREDLRRVLEELRKLIEDNRREDKRSEDELRKLIRDNKEENDRARREAEKLLEDLSRGRSERDHMVLHEYVNAAGITLKEDDKRSLERIERIVRRNNELNKESVDRIRKIIKEMEERAD

SEQ ID NO: 14132 - protein, 174 aa, Artificial Sequence
  Synthetic sequence.
DELRDVKRELDRLLRENEEIVERIAETVRRLLEELKKLTKELAEELRKLLEELRKRGVPEKELKEVADTLRKLLKDIERSNKEVEDRLRKLLEEIKESTDRLREELEEVEKLLRGGKDVERDHMVLHEYVNAAGITMRRVLEEAKRLAKEDKERIDKIRKEIEELIKRLKDKAT

SEQ ID NO: 14133 - protein, 174 aa, Artificial Sequence
  Synthetic sequence.
DEEEDLERRIKKLLDENRELLKRIAEELRRLLEELRRLTEESADRLRRLLKELKDRGVPEKDLRDVAEKVKKVLKESEDSNRDVKRKLEKLLRDLERSTERLEREARKVRKLLRDGKDIERDHMVLHEYVNAAGITLKKIEKEIRDLIKEDKERNRELSERLRKLVEELKKKAT

SEQ ID NO: 14134 - protein, 178 aa, Artificial Sequence
  Synthetic sequence.
SKVEKLEEEIARLVERSRRLVEELKKEVTKVKEKVDEIVERSRRHVKKVVEKLRDIKRRGGSEEVLRRVTEELKKVLEDNRRVIEEVLRDLERILEELKRKAEEVTKRNRDDLKRLRDSGRDHMVLHEYVNAAGITEKELRTVLRDVTEDIKRIAEELKKALEDSTEIIRRAEDELRT

SEQ ID NO: 14135 - protein, 177 aa, Artificial Sequence
  Synthetic sequence.
DEVEDILRKVEEIVKKSITDARRLLKEAREIVEESIKTAEELLRRNEDIVRKLSEDVKRTTDEEKKKKLEEESRRVLEKTKRDLDRTKDDNRKALEKIRKRVKETEEENREVVDRVRKAGRDHMVLHEYVNAAGITVRVNREVLKRVEEVLEESKRVNEKVEEDVRRVHEEVRKEIK

SEQ ID NO: 14136 - protein, 178 aa, Artificial Sequence
  Synthetic sequence.
SEEEKLKEVKDRIREVLRKLEEHTDKVKKEVEKVLRDIRRTTDELKKEVRAMLERLRRKKKDAEDLLRELEKIIEEIERELDRVLEENDKMAEEWKKLLDKVLDDNRKSIRDIEKELDDRRDHMVLHEYVNAAGITDEETNRDVVKKVREAVKKDADTNRKVIEEVKKVLEDAARRLD

SEQ ID NO: 14137 - protein, 176 aa, Artificial Sequence
  Synthetic sequence.
REAEEAKEEVEELNRRNKKELDDARRRVDELDKRNKDRLKESSDRVKRLVEELERVKEEGRSDDRLREKIERMLKTSADELERLKEENKRALRDLAERLRELIERNRRKLEEITRRTVPDRDHMVLHEYVNAAGITELERVLEELAEKIDRSLKELDDVLRKNETDLKRVIEDLKR

SEQ ID NO: 14138 - protein, 179 aa, Artificial Sequence
  Synthetic sequence.
RLEDEVRKMEKEVREEVKRLEDESRKVLEESRRNLDKLREESKRVLDTVRERIKDLRRRGLDERVLRELLKRVREVHERNRKLLDEVRRASEKVHEDNRRILEEVRKTVKDVVDKLRRVDRDHMVLHEYVNAAGITDVEREVKKSIEEVKEINRRLNEEVKKTIEEVKEIVKEVTERAK

SEQ ID NO: 14139 - protein, 174 aa, Artificial Sequence
  Synthetic sequence.
SESDEVIRDLARLLDELARHVDDSVRRMDEVVKRSTREADELAKRLDELVKEVEKKPGDERVERMVAEIERLVAEVLEELKKKYEKLKREVEENLRRLEETVRDIVEKARKVTEKGVSKERDHMVLHEYVNAAGITKKKHEDVLRRLEDSLRRVAELLKAALDRLREIVDRLRR

SEQ ID NO: 14140 - protein, 178 aa, Artificial Sequence
  Synthetic sequence.
DEARELVKELEDLIREITKTVRRLLEESEELIKRIDDAVDDLRRADEDLNREIKEEIEKGKSKESLEALIERLKESLERVKRTIEKLIRDLERLNEKLRRDVESLVAELEKILSKIKRGGRDHMVLHEYVNAAGITEKEAREILKRSEDETDKLREKAERILEDLERANRRTMDEARR

SEQ ID NO: 14141 - protein, 176 aa, Artificial Sequence
  Synthetic sequence.
STAETVEKKVEEVIRENEKSMRESEEKVDRSTKRIEDVLRRLEETIRKTSDDIAKGVKGERVKEVLEENRRLLEEAKKLVDEVLETNKKLLEDDKRLNEEVSKTLKKLLEEIKSVDTREDRDHMVLHEYVNAAGITKLNEETIRRSEELVRRIERVIEEIIKRSEKLLEDVARESK

SEQ ID NO: 14142 - protein, 176 aa, Artificial Sequence
  Synthetic sequence.
STAETVAEEVERVLKHSDDLIKEVEDVNRRVEEEIKRVIRELEEENERLVAEVRKGVKGEILAEIEKRLADNSEKVREVAERAKKLLEENTARVKDILRESRKLVKDLLDEVRGTGSEEARDHMVLHEYVNAAGITEKLDELIKHSEEVLERVKRLIDELRKHSEEVLEDLRRRAK

SEQ ID NO: 14143 - protein, 180 aa, Artificial Sequence
  Synthetic sequence.
REVEEMIKELEELLKDLKEKNERASKRNRELVRRLEEENKRVIEELKKLVKELEDLVRSGEDEEVLREVLKRLEEVLERVRALNERVLEAIEKSLEEVKASNEAVKRRLKELLEEAERGVRDHMVLHEYVNAAGITKRIDELDEYTRESIRRAKKEIERLNRETKKVIEEVVKRIEEERK

SEQ ID NO: 14144 - protein, 181 aa, Artificial Sequence
  Synthetic sequence.
DAVEEAEKLIRKVIADSEKLLRDLADLNAKSIRRSEKLVEDDRRANEDVIRKLEELRRNGGSEEELRALLKEVEDTNRASHETNKRLLDEDRALNKEVHDRNEKLLRDIKRLVEEVAKGIRDHMVLHEYVNAAGITKKAIEDSSREIKRLLEESERVMKRSSEDIKRTLDDTRRVVEEVRR

SEQ ID NO: 14145 - protein, 177 aa, Artificial Sequence
  Synthetic sequence.
SSDEVLKEIEEIIRRLEAEVRRVNAEVNASTEDLAREVEEVLRATNELIEELERRVTGTEELKRVIDELRDRDRKVRRRVERVIEESAKRDDESRKRLTRAVEKLRADLKKLADDGVPEERDHMVLHEYVNAAGITKDELKEWRDRNKELVDRLSEELKEWLKDVERVLKELTDKDR

SEQ ID NO: 14146 - protein, 178 aa, Artificial Sequence
  Synthetic sequence.
SDAEELLKRVADLLKASLESLEKILRDSKELMDRWRKKLEDLLRESEELVDRAEKILRRGGSDKEVLDKIAEEVRRTNDDSRRLDEELHRLSRDTLRKLEENLRRTEKEVREMDKRAAERRDHMVLHEYVNAAGITVEEEHRKVLETDKKILKEAHKESKEVNDRDRELLERLEESVR

SEQ ID NO: 14147 - protein, 181 aa, Artificial Sequence
  Synthetic sequence.
SEIETVRREIEKILDDLRRTVKRIEDEVRKIHEDLRRSLEDSKRNIEEILKDLERAARRDGLDKKVEDDMRKLVEDLKRKHDKLRADNEAVTKELKDRLKKLEDDLARAIEELRRRLDKGRDHMVLHEYVNAAGITVEKIKKDLKELLERYEEIVRRIKELLKDLNREAEEVVRRLKEELR

SEQ ID NO: 14148 - protein, 175 aa, Artificial Sequence
  Synthetic sequence.
SEIERVKKRLEELLAEVEESTRRLEERLKRLLEEAKRSSEEVEKELRRLLEAVRRGLSRDEKLVSELEARVKELLEDSRASLEELKKRVRKLAEDSARLLEEVKREVEKLKAKLDRGGDARDHMVLHEYVNAAGITENERLIREVEELVRAHNKRNKELVDEVKRLVEKVIEEER

SEQ ID NO: 14149 - protein, 177 aa, Artificial Sequence
  Synthetic sequence.
SEDEDLDRVAEKLAREHKKSVEEIKRVLKSADEESKKLVRDTERVIEEIKREVEEARRGNIDEELVERLKKKIEDILRTLEERHKKLIKELREILKRLSDESRRLAEETEKVLEDLERKGRDHMVLHEYVNAAGITKEENRKVNEEVEKRLRELEEENKKVIEDLKSTVEELVERLR

SEQ ID NO: 14150 - protein, 180 aa, Artificial Sequence
  Synthetic sequence.
DEVEDVLRKIEKILDDHRKRIEKNSRDMARIIDEHRRKVEENSREMKKLVDDLKKAVDRGEGDEETAEDVKAKLEKSNRELEKHSEEVKRALDESNEDLRRHSEEVKERIERLVKKLREDRDHMVLHEYVNAAGITEKLDRLNRENEKSSEELKRELDKINDENRETSERLKREIDETTR

SEQ ID NO: 14151 - protein, 182 aa, Artificial Sequence
  Synthetic sequence.
RVEDALRKLLDDVRRLVEEAERRLRTSNDKSRRLVEEAKRRLEESNERSEKLVRDVRRRIRDEDVKRVLEELLKRDHDVVRRVLERIDEMLERNSRLVKRVLEDIRRLLKRVREVVERIKRRDHMVLHEYVNAAGITIKTAKKIIEDVLRASEDTIRRLEEIIRKVEEDSKRIIEEIERAAR

SEQ ID NO: 14152 - protein, 179 aa, Artificial Sequence
  Synthetic sequence.
STREDARRLVERVRKEVKRLLKKNSDLLREVTERVKTLNERNRRLLEEVEREAKRLKDSDERDVERLLDRARKLVKESEDLIRKLLKDLRELVRRSEKDIDELRKELKRLLDELRARATDKRDHMVLHEYVNAAGITIRELEENVKTSEKLIEDLIRELEKSVDESRKRVEELVKELRT

SEQ ID NO: 14153 - protein, 174 aa, Artificial Sequence
  Synthetic sequence.
SELEKVVKEVADLLRRNLEKSKRVLEEVRRRLEENLRESEKVHDDNRKTARRILELVREGKDKRDLTRLLEEDDKRVKEALDKSRENNERILKEVRRALRESEEDNRRILKEVREKVDSRLRDHMVLHEYVNAAGITRFIEELEKIVEETLTESEKLARASSEITKTVLDEIRK

SEQ ID NO: 14154 - protein, 181 aa, Artificial Sequence
  Synthetic sequence.
DEERKLEKSLKDVEDTHRRLLEKNDEDLKELRKRVEDMLRRLEDALRRILEDIEEKLKRIEDDETLKRLRKRVKELLDEIRRRLERLEREVDKRLEEIKERNDRHHEEAKKELKRIRDKIRRDHMVLHEYVNAAGITRKVAEDLKRSNDEVKELAERLEETIRDLLRRIEEILKEIEERVR

SEQ ID NO: 14155 - protein, 175 aa, Artificial Sequence
  Synthetic sequence.
SEKEDLERELEEVRRRVEESLRKNEEDVKRVRDELKKLLDENRKELERIRREVERANVDKRVLDEADRLLKELEDDHKKLEEDAKKALDELREEHKRLEETLRRMLKRIKEVLDRESDKMERDHMVLHEYVNAAGITSRELNKKLEEIVRRLKKVSDELNRRIEEIAERVRRRRK

SEQ ID NO: 14156 - protein, 177 aa, Artificial Sequence
  Synthetic sequence.
SVIERVEEEMEKVIRDSERVTKEVEDRAREVHERSEKRIREVEETSRRVLEELRRAGVDKRILDELRKRIKDSREDLERINEELRRALRKLLEDSKRINEELRKTLEELRKRLERVDDEEERDHMVLHEYVNAAGITRKLEELARRVDELVRESIERVDRNVEENKRLVREAIERRR

SEQ ID NO: 14157 - protein, 179 aa, Artificial Sequence
  Synthetic sequence.
SSKEVADELRKKAEKVLDELRKIIRELERKNEDSLRRTEEIVRRLEEEAERVLRDLVRTRGEDDRLVREVERLLRELKRRLEELIRRSEELIKRSREEVDRVIRTVEKLLEELDRLLRANKRDHMVLHEYVNAAGITIKDLARKLAKSSDDTVREDEKLVEELRKDVKRIVRKIKKDLE

SEQ ID NO: 14158 - protein, 174 aa, Artificial Sequence
  Synthetic sequence.
DELRDVKRELDRLLRENEEIVERIAETVRRLLEELKKLTKELAEELRKLLEELRKRGVPEKELKEVADTLRKLLKDIERSNKEVEDRLRKLLEEIKESTDRLREELEEVEKLLRGGKDVETRDHMVLHEYVNAAGITRRVLEEAKRLAKEDKERIDKIRKEIEELIKRLKDKAT

SEQ ID NO: 14159 - protein, 182 aa, Artificial Sequence
  Synthetic sequence.
DEIETVLDEVRRLHEDAKRRLEEMIDEVRKLNEESVRELARVVEEVERLLRTVKEEVERAGLDKGKLEELEERLERVREDVERILREIKRRNEKTLEDSERILEENKERNRTVLKKLKELRRDHMVLHEYVNAAGITVEESRESVRRVLEKNRRVVEESKRLAEELLRRVKKVVDEIRKRVE

SEQ ID NO: 14160 - protein, 178 aa, Artificial Sequence
  Synthetic sequence.
SKVEKLEEEIARLVERSRRLVEELKKEVTKVKEKVDEIVERSRRHVKKVVEKLRDIKRRGGSEEVLRRVTEELKKVLEDNRRVIEEVLRDLERILEELKRKAEEVTKRNRDDLKRLRDSGVRDHMVLHEYVNAAGITKELRTVLRDVTEDIKRIAEELKKALEDSTEIIRRAEDELRT

SEQ ID NO: 14161 - protein, 182 aa, Artificial Sequence
  Synthetic sequence.
SDADRVAEELKKLVEDSRRENERVIEESKRLVKENEDRNRELIERLKKLVDKLRDILEKEKDKKTLDDIVREILERLKRLLEKVEDENRKSHEENKRLLEDVKRKNKRISDELKRLLEEIERDHMVLHEYVNAAGITLEENKRVMEKTEEVAKKSSEDIKRVADETRRRAEELLKEVDELRK

SEQ ID NO: 14162 - protein, 179 aa, Artificial Sequence
  Synthetic sequence.
KDEETLKRLLEKAKEVVDRLKDENEKVTRDNHESVKKAKDANKRSNEKSERVARDAIRRVREAKEVVDTAEKLLRDNHEHSRDTVKKARELNETSRRHSERIVEKIEEILEEVERTLRENRRDHMVLHEYVNAAGITLEELSRENREAVKRISDEIKRLSDENAKDSERIIKEIDDRVR

SEQ ID NO: 14163 - protein, 179 aa, Artificial Sequence
  Synthetic sequence.
REDERLEEIARKIKKVVDELVERNKKLTEDNHESVRRAEKRNRELSRELEEVAKRAIERIRSDKKVVDEVKKLLEDAKKHSKEVIDELRRLNEESKRSSEDTIRRMRKLLRELEETVKAKKRDHMVLHEYVNAAGITLEDLSRRNEEKVRRISEEIKKLSKDNERTIKEIIKEIEERVK

SEQ ID NO: 14164 - protein, 178 aa, Artificial Sequence
  Synthetic sequence.
KAAEEIRKKVEDYKRESEKILEEVEDHSRRSKETLKRLLDDLRRAVEELKRRLEELKRRPRTEEIAKRAEEAVRRAAERIKKVIDDVERHIRENAKELKRLLEEDREASRRLEDEIDKEVKRDHMVLHEYVNAAGITEESERVLRELAERNKTALEEAERVLRRLKEEIEKVLRKLKK

SEQ ID NO: 14165 - protein, 176 aa, Artificial Sequence
  Synthetic sequence.
REAEEAKEEVEELNRRNKKELDDARRRVDELDKRNKDRLKESSDRVKRLVEELERVKEEGRSDDRLREKIERMLKTSADELERLKEENKRALRDLAERLRELIERNRRKLEEITRRTVPDKRDHMVLHEYVNAAGITLERVLEELAEKIDRSLKELDDVLRKNETDLKRVIEDLKR

SEQ ID NO: 14166 - protein, 182 aa, Artificial Sequence
  Synthetic sequence.
DLERRLDELLKRIEDRVRELVRTLEESLRELERRVREIIRRLEEHLRRIEKMVRDLKRANKPDKAVKDDVRRLRENADRLNKRVREELKKLREDVKRVNEDVKRELDKLAEEAKDMLRKLRRDHMVLHEYVNAAGITRRLLREIEEVSERHKREVDRLEREIEEVSREHKERVEKLLREIER

SEQ ID NO: 14167 - protein, 179 aa, Artificial Sequence
  Synthetic sequence.
RLEDEVRKMEKEVREEVKRLEDESRKVLEESRRNLDKLREESKRVLDTVRERIKDLRRRGLDERVLRELLKRVREVHERNRKLLDEVRRASEKVHEDNRRILEEVRKTVKDVVDKLRRVDARDHMVLHEYVNAAGITVEREVKKSIEEVKEINRRLNEEVKKTIEEVKEIVKEVTERAK

SEQ ID NO: 14168 - protein, 174 aa, Artificial Sequence
  Synthetic sequence.
SESDEVIRDLARLLDELARHVDDSVRRMDEVVKRSTREADELAKRLDELVKEVEKKPGDERVERMVAEIERLVAEVLEELKKKYEKLKREVEENLRRLEETVRDIVEKARKVTEKGVSKEKRDHMVLHEYVNAAGITKKHEDVLRRLEDSLRRVAELLKAALDRLREIVDRLRR

SEQ ID NO: 14169 - protein, 174 aa, Artificial Sequence; identical to SEQ ID NO: 14168
  Synthetic sequence.

SEQ ID NO: 14170 - protein, 181 aa, Artificial Sequence
  Synthetic sequence.
SEVDEAVKNNEEDAKESRRVVEEAVKRDEDIARDIERAAREVVERDKEIVDEVRRGVKDEKKLREVVTLSKKIVDETKEIADRVLELSKRIVKETRDIAKRVLKLNDDSVKDVRRIAREGRRDHMVLHEYVNAAGITEISREVKKDLERTVRENKKIVDEVAKALEDTVDKNRRIVEEVTT

SEQ ID NO: 14171 - protein, 172 aa, Artificial Sequence
  Synthetic sequence.
SRAETVLKEVTDKIKKLADSSDELLRRNKENIDELKKSSEELLRRLTKAIEEIEKGSVDEETLEELIRRVEAELEAHHRELEKNSREDEKRNRDHHAKLEEEMRRVEERLEREGIDDEVVKRDHMVLHEYVNAAGITNEDVKRMNDKLRRDNEDVIRRVEKLLRELEEKRRT

SEQ ID NO: 14172 - protein, 179 aa, Artificial Sequence
  Synthetic sequence.
SEVEELIKRLAKVLKELVDKVRKVIEDTKELLERLKRRSEDHIRKLREVLKEAKDQPIDDEELKEILDRLRKTLEELEEELKKALEDDREEAKRLVDDARRVLKELEEEVREIRERRGESERDHMVLHEYVNAAGITIREVIKEWERVHREVEELLKRLIDENRKVLDEIRKLLEEKSK

SEQ ID NO: 14173 - protein, 181 aa, Artificial Sequence
  Synthetic sequence.
DAVEEAEKLIRKVIADSEKLLRDLADLNAKSIRRSEKLVEDDRRANEDVIRKLEELRRNGGSEEELRALLKEVEDTNRASHETNKRLLDEDRALNKEVHDRNEKLLRDIKRLVEEVAKGIDRDHMVLHEYVNAAGITKAIEDSSREIKRLLEESERVMKRSSEDIKRTLDDTRRVVEEVRR

SEQ ID NO: 14174 - protein, 175 aa, Artificial Sequence
  Synthetic sequence.
SEADDVLKKLAETVKRIIERLKKLTDDSRRLVEEVHRRNDKLSKESAEAVRKAEERGIDEKDVRKLLEDLKKKSEEVAERNKRILDTLREISKRAEDEVRKVLKELEKTLKELEDRRPDSERDHMVLHEYVNAAGITLARHKDENDKLLKEIEDSLRRHKEENDRLLEKLKESTR

SEQ ID NO: 14175 - protein, 181 aa, Artificial Sequence
  Synthetic sequence.
SEIETVRREIEKILDDLRRTVKRIEDEVRKIHEDLRRSLEDSKRNIEEILKDLERAARRDGLDKKVEDDMRKLVEDLKRKHDKLRADNEAVTKELKDRLKKLEDDLARAIEELRRRLDKGLRDHMVLHEYVNAAGITEKIKKDLKELLERYEEIVRRIKELLKDLNREAEEVVRRLKEELR

SEQ ID NO: 14176 - protein, 175 aa, Artificial Sequence
  Synthetic sequence.
SEIERVKKRLEELLAEVEESTRRLEERLKRLLEEAKRSSEEVEKELRRLLEAVRRGLSRDEKLVSELEARVKELLEDSRASLEELKKRVRKLAEDSARLLEEVKREVEKLKAKLDRGGDADRDHMVLHEYVNAAGITNERLIREVEELVRAHNKRNKELVDEVKRLVEKVIEEER

SEQ ID NO: 14177 - protein, 177 aa, Artificial Sequence
  Synthetic sequence.
SEDEDLDRVAEKLAREHKKSVEEIKRVLKSADEESKKLVRDTERVIEEIKREVEEARRGNIDEELVERLKKKIEDILRTLEERHKKLIKELREILKRLSDESRRLAEETEKVLEDLERKGVRDHMVLHEYVNAAGITEENRKVNEEVEKRLRELEEENKKVIEDLKSTVEELVERLR

SEQ ID NO: 14178 - protein, 177 aa, Artificial Sequence; identical to SEQ ID NO: 14177
  Synthetic sequence.

SEQ ID NO: 14179 - protein, 182 aa, Artificial Sequence
  Synthetic sequence.
RVEDALRKLLDDVRRLVEEAERRLRTSNDKSRRLVEEAKRRLEESNERSEKLVRDVRRRIRDEDVKRVLEELLKRDHDVVRRVLERIDEMLERNSRLVKRVLEDIRRLLKRVREVVERIKRVRDHMVLHEYVNAAGITKTAKKIIEDVLRASEDTIRRLEEIIRKVEEDSKRIIEEIERAAR

SEQ ID NO: 14180 - protein, 183 aa, Artificial Sequence
  Synthetic sequence.
KVEKRLTDLLKTVADEVKRVEDELRETVRESKEVVDKSRRDLERTVEESEKTVKDAERRVSEDLVRRIRKVLDENREVNDRVVKEDERILEENERVNRKVVEKIRDILRKIEEVVRRAAEEIRDHMVLHEYVNAAGITLERLKEEADRVRERSKKILTDLKKSSEDVKRESERMLKKLEDEIR

SEQ ID NO: 14181 - protein, 174 aa, Artificial Sequence
  Synthetic sequence.
SEDETIRRIVRTVHEESRKSTEDVRREVERVLRESEEVVKKVKKKVDDVLKRVEETGISEELEERMRRIIREIREHLKDNLRRVREVIERIERKLEETERRDEKVLREIEKKIRDGDGREEVRDHMVLHEYVNAAGITEIAKEVREIVERSIKNLEEVAEEVERVVRELIEARR

SEQ ID NO: 14182 - protein, 178 aa, Artificial Sequence
  Synthetic sequence.
DDLERVLKEIKKAADKIREDNKRTADKIRKRVKELDDETRDMLRRIRKLVKEIKERVRGREEARKVIEELKKLVDEVRKRNEKSIEELKKLLKEDRDLMRRVIEELEDLVRRLREEVRDDEARDHMVLHEYVNAAGITRVLKETSDRVRELIDKHRRLSEEVEKDVKRLIDELKKKTD

SEQ ID NO: 14183 - protein, 175 aa, Artificial Sequence
  Synthetic sequence.
SEKEDLERELEEVRRRVEESLRKNEEDVKRVRDELKKLLDENRKELERIRREVERANVDKRVLDEADRLLKELEDDHKKLEEDAKKALDELREEHKRLEETLRRMLKRIKEVLDRESDKMEERDHMVLHEYVNAAGITRELNKKLEEIVRRLKKVSDELNRRIEEIAERVRRRRK

SEQ ID NO: 14184 - protein, 178 aa, Artificial Sequence
  Synthetic sequence.
SSIERVEKEVRRLLRESDESLKRVMEEAKELIKSVRESTKRVEEDARDLLRKVVERTGDEREDLRRVLEELRKLIEDNRREDKRSEDELRKLIRDNKEENDRARREAEKLLEDLSRGRSEEERDHMVLHEYVNAAGITEDDKRSLERIERIVRRNNELNKESVDRIRKIIKEMEERAD

SEQ ID NO: 14185 - protein, 179 aa, Artificial Sequence
  Synthetic sequence.
SSKEVADELRKKAEKVLDELRKIIRELERKNEDSLRRTEEIVRRLEEEAERVLRDLVRTRGEDDRLVREVERLLRELKRRLEELIRRSEELIKRSREEVDRVIRTVEKLLEELDRLLRANKGRDHMVLHEYVNAAGITKDLARKLAKSSDDTVREDEKLVEELRKDVKRIVRKIKKDLE

SEQ ID NO: 14186 - protein, 183 aa, Artificial Sequence
  Synthetic sequence.
KDAEDLERRVRELVEENNRVSKRLAEEVTRLVKENEDKVRELEKEVRDRAKELLDMKRRGEVREEEVKRVLREIEELLREITEHSKEVLKTIEKLLRDSLEHSRRVLEEIERLLETILRKSKRDHMVLHEYVNAAGITERSLRENEKVADELRKRAEKSLEDVKRVVDELRKIVDDVLKRVED

SEQ ID NO: 14187 - protein, 183 aa, Artificial Sequence
  Synthetic sequence.
SEIEKLVEDVRKLVEDNLRHSEEVHRRNRRLIEENERKIDELEKRVRKLVEELRELAERGEIREEEARKVLEEIKRLLDEIRRHSEEVLKEIERTLKENLKHSEEVLRRIEERLEDIKRKDKRDHMVLHEYVNAAGITKRSLDESEKLNRESRKRVTRSLEKVDDLVRELEKLARKVLEEVKT

SEQ ID NO: 14188 - protein, 174 aa, Artificial Sequence
  Synthetic sequence.
SEIEELEKRIDELLKELRDLSRRIAEEVKRLLEELKKLSKDSEDKLRELLERLKRKGVPEEELRRVEEEVERVVRESRKLNKETEDELRRLLEEIKESNDRVEKRARELKKLLRDGKDVEEVRDHMVLHEYVNAAGITKVLKDARDLIKKDKDLNEKLSRELEKLVRELEERAR

SEQ ID NO: 14189 - protein, 174 aa, Artificial Sequence
  Synthetic sequence.
DELRDVKRELDRLLRENEEIVERIAETVRRLLEELKKLTKELAEELRKLLEELRKRGVPEKELKEVADTLRKLLKDIERSNKEVEDRLRKLLEEIKESTDRLREELEEVEKLLRGGKDVETVRDHMVLHEYVNAAGITRVLEEAKRLAKEDKERIDKIRKEIEELIKRLKDKAT

SEQ ID NO: 14190 - protein, 174 aa, Artificial Sequence
  Synthetic sequence.
DEEEDLERRIKKLLDENRELLKRIAEELRRLLEELRRLTEESADRLRRLLKELKDRGVPEKDLRDVAEKVKKVLKESEDSNRDVKRKLEKLLRDLERSTERLEREARKVRKLLRDGKDIETLRDHMVLHEYVNAAGITKIEKEIRDLIKEDKERNRELSERLRKLVEELKKKAT

SEQ ID NO: 14191 - protein, 177 aa, Artificial Sequence
  Synthetic sequence.
DEVEDILRKVEEIVKKSITDARRLLKEAREIVEESIKTAEELLRRNEDIVRKLSEDVKRTTDEEKKKKLEEESRRVLEKTKRDLDRTKDDNRKALEKIRKRVKETEEENREVVDRVRKAGVDRDHMVLHEYVNAAGITVNREVLKRVEEVLEESKRVNEKVEEDVRRVHEEVRKEIK

SEQ ID NO: 14192 - protein, 182 aa, Artificial Sequence
  Synthetic sequence.
SDADRVAEELKKLVEDSRRENERVIEESKRLVKENEDRNRELIERLKKLVDKLRDILEKEKDKKTLDDIVREILERLKRLLEKVEDENRKSHEENKRLLEDVKRKNKRISDELKRLLEEIERRDHMVLHEYVNAAGITEENKRVMEKTEEVAKKSSEDIKRVADETRRRAEELLKEVDELRK

SEQ ID NO: 14193 - protein, 175 aa, Artificial Sequence
  Synthetic sequence.
SEMDDVLKKLAETVKRIIERLKKLTDDSRRLVEEVHRRNDKLSKESREAVRKAEERNIDEKDVRKLLEDLKKKSEEVAERNKRILDTLREISKRAEDEVRKVLKELEKTLKELEDRRPDVRERDHMVLHEYVNAAGITKRHKDENDKLLKEIEDSLRRHKEENDRLLEKLKESTR

SEQ ID NO: 14194 - protein, 183 aa, Artificial Sequence
  Synthetic sequence.
SEVDEVLERIKRLLERLAEHSDKVVRDIEKLLDDNRKENERLLDKLRRELKRLEEMRRRGDLREELLERVVREVEKEIRDIKRKNKRSVETVEKLVRDDRKELKRALEDVERLIRELETRLKRDHMVLHEYVNAAGITEKVIDELLKKTDEVLKRARETIEDLNRKLDKVLKEVRDKLDRLRD

SEQ ID NO: 14195 - protein, 179 aa, Artificial Sequence
  Synthetic sequence.
KDEETLKRLLEKAKEVVDRLKDENEKVTRDNHESVKKAKDANKRSNEKSERVARDAIRRVREAKEVVDTAEKLLRDNHEHSRDTVKKARELNETSRRHSERIVEKIEEILEEVERTLRENRGRDHMVLHEYVNAAGITEELSRENREAVKRISDEIKRLSDENAKDSERIIKEIDDRVR

SEQ ID NO: 14196 - protein, 179 aa, Artificial Sequence
  Synthetic sequence.
SDDETVTKLLKEAEKVVRELTKRNKELLRKNHESVREAKKRNEDLSRKLEEVVRRLIEEIREREDVVRELEKLLEDAKRHSERIVREMEDLNRKSKKHSKETVDRLKDLLRKVEETARARKGRDHMVLHEYVNAAGITEELTRRNEKRIEEISDEIRRLSDTNRREIERIREELRRRAK

SEQ ID NO: 14197 - protein, 176 aa, Artificial Sequence
  Synthetic sequence.
REAEEAKEEVEELNRRNKKELDDARRRVDELDKRNKDRLKESSDRVKRLVEELERVKEEGRSDDRLREKIERMLKTSADELERLKEENKRALRDLAERLRELIERNRRKLEEITRRTVPDKDRDHMVLHEYVNAAGITERVLEELAEKIDRSLKELDDVLRKNETDLKRVIEDLKR

SEQ ID NO: 14198 - protein, 182 aa, Artificial Sequence
  Synthetic sequence.
SELEKTLEDLKRHSEENKKKLEEDLRDMERNLKENKDRLKKILEEAEKTLKDLERRFREGDIDERELERVRRKMEEIKKRLDENVERNRRKAEDIKRKLDENVKRSEDRVKEIKEDIRRRVRRDHMVLHEYVNAAGITKENREIHERVKKALDDIVKELEELHERLKRRLEEILRRIAETVR

SEQ ID NO: 14199 - protein, 179 aa, Artificial Sequence
  Synthetic sequence.
RLEDEVRKMEKEVREEVKRLEDESRKVLEESRRNLDKLREESKRVLDTVRERIKDLRRRGLDERVLRELLKRVREVHERNRKLLDEVRRASEKVHEDNRRILEEVRKTVKDVVDKLRRVDAKRDHMVLHEYVNAAGITEREVKKSIEEVKEINRRLNEEVKKTIEEVKEIVKEVTERAK

SEQ ID NO: 14200 - protein, 183 aa, Artificial Sequence
  Synthetic sequence.
RVDERLDTVLKRVEETVRENKKKNDELLERSKENIDRLKKRLDDLLDKVRREAEKLKREVTKEEVKKIIDEVLKEIEDLLRTVKEELDRALERNREVVEETKRRIDRVLKEIEKLIRDVKRDRDHMVLHEYVNAAGITLKEVNDTSKDAERRLRETNERLNEIVKEVEKRIRELSEEVRKRVK

SEQ ID NO: 14201 - protein, 183 aa, Artificial Sequence
  Synthetic sequence.
SVDERLDEVLERVKEDMDRNRRKNDESLREDEENVRRNKKETDESVKRVEERVRELKKRVKDERVKEFLDRVLEEIRKSAEEVKTIIDEVHKESEETVRRTKKIIEEVLRRIEELIRRVKKDRDHMVLHEYVNAAGITLKEVNKVSDEAHKRNKELNERVNRVNKEAHKRNEDLLREAERKVR

SEQ ID NO: 14202 - protein, 183 aa, Artificial Sequence
  Synthetic sequence.
SIEDEIRKLKEDIKRVLDKVRRDNERLKERLDKVLEDIRRSSEDNNRKLEEVLKRIRDKPVDERLVRKVEEAVKRLKEHNEDSTRRVEEVIRRLKEESEESVRKTEKVARDLERELDEVLTRRDHMVLHEYVNAAGITLERLKREDKEVADRAEKLLREAEEHNKRSLDESRRVLEELDEEIR

SEQ ID NO: 14203 - protein, 183 aa, Artificial Sequence
  Synthetic sequence.
SIREKIRELEERLEEVLRRIEENSERVLREAERVLKEIKDNSKRNNEKLERALEEIRKLPVEDELVRRVKELVERLKRHNKKSSEDVERVVRELKEELKRSSEEVKKAVDRLKEELEKVLRDRDHMVLHEYVNAAGITLRKLEEHNRRVVERLKRLLEELKKHNEDSLRKSEEVLRKLEEDAR

SEQ ID NO: 14204 - protein, 182 aa, Artificial Sequence
  Synthetic sequence.
SIEDLVRELKKKVDEVAEDLRRKVREALERSRENIDRLKKHSEENLRRSEEVVDKLRKETREEEVKDILRRVLELSKRIVEESKEILDRVLELSKKVVDDIEEIIRRVEETVKEVLTRLSRVRDHMVLHEYVNAAGITREVTKLVEKLIRELEDINRKVNERNRRLAEESRKILDEVEKRVR

SEQ ID NO: 14205 - protein, 174 aa, Artificial Sequence
  Synthetic sequence.
SESDEVIRDLARLLDELARHVDDSVRRMDEVVKRSTREADELAKRLDELVKEVEKKPGDERVERMVAEIERLVAEVLEELKKKYEKLKREVEENLRRLEETVRDIVEKARKVTEKGVSKEKIRDHMVLHEYVNAAGITKHEDVLRRLEDSLRRVAELLKAALDRLREIVDRLRR

SEQ ID NO: 14206 - protein, 178 aa, Artificial Sequence
  Synthetic sequence.
DREREVKKRLDEVRERIERLLRRVEEESRRVAEEIRRLIEEVRRRNKKVTEEIRELLKGLKDKEEVRRVLERLRKLNAESDELLERILERLRRLVEATNRLVKAIIEELRRLVEKIVREVPDRDHMVLHEYVNAAGITKVAKEIHDHDKEVTERLEDLLRRITEHARKSDREIEETAR

SEQ ID NO: 14207 - protein, 179 aa, Artificial Sequence
  Synthetic sequence.
SEVEELIKRLAKVLKELVDKVRKVIEDTKELLERLKRRSEDHIRKLREVLKEAKDQPIDDEELKEILDRLRKTLEELEEELKKALEDDREEAKRLVDDARRVLKELEEEVREIRERRGESEERDHMVLHEYVNAAGITREVIKEWERVHREVEELLKRLIDENRKVLDEIRKLLEEKSK

SEQ ID NO: 14208 - protein, 176 aa, Artificial Sequence
  Synthetic sequence.
STAETVEKKVEEVIRENEKSMRESEEKVDRSTKRIEDVLRRLEETIRKTSDDIAKGVKGERVKEVLEENRRLLEEAKKLVDEVLETNKKLLEDDKRLNEEVSKTLKKLLEEIKSVDTREDATRDHMVLHEYVNAAGITNEETIRRSEELVRRIERVIEEIIKRSEKLLEDVARESK

SEQ ID NO: 14209 - protein, 180 aa, Artificial Sequence
  Synthetic sequence.
REVEEMIKELEELLKDLKEKNERASKRNRELVRRLEEENKRVIEELKKLVKELEDLVRSGEDEEVLREVLKRLEEVLERVRALNERVLEAIEKSLEEVKASNEAVKRRLKELLEEAERGVDSRDHMVLHEYVNAAGITIDELDEYTRESIRRAKKEIERLNRETKKVIEEVVKRIEEERK

SEQ ID NO: 14210 - protein, 181 aa, Artificial Sequence
  Synthetic sequence.
DAVEEAEKLIRKVIADSEKLLRDLADLNAKSIRRSEKLVEDDRRANEDVIRKLEELRRNGGSEEELRALLKEVEDTNRASHETNKRLLDEDRALNKEVHDRNEKLLRDIKRLVEEVAKGIDSRDHMVLHEYVNAAGITAIEDSSREIKRLLEESERVMKRSSEDIKRTLDDTRRVVEEVRR

SEQ ID NO: 14211 - protein, 181 aa, Artificial Sequence
  Synthetic sequence.
SEIETVRREIEKILDDLRRTVKRIEDEVRKIHEDLRRSLEDSKRNIEEILKDLERAARRDGLDKKVEDDMRKLVEDLKRKHDKLRADNEAVTKELKDRLKKLEDDLARAIEELRRRLDKGLDRDHMVLHEYVNAAGITKIKKDLKELLERYEEIVRRIKELLKDLNREAEEVVRRLKEELR

SEQ ID NO: 14212 - protein, 183 aa, Artificial Sequence
  Synthetic sequence.
SDVDRVLEEIRKLLEDLKRHSEKVSEENEDLLRANTELNKRVSEDNERLLEELKRLRERGGISEEDLKRALDRVRKTVETVKEENKRSLEDVRRTVETNKRKLERVVEEIKKLIEDAKRRGSRDHMVLHEYVNAAGITKRTIDRLLETSDRSLEKVEADLRRLNEELDRSLERAERTIRELAK

SEQ ID NO: 14213 - protein, 177 aa, Artificial Sequence
  Synthetic sequence.
SEDEDLDRVAEKLAREHKKSVEEIKRVLKSADEESKKLVRDTERVIEEIKREVEEARRGNIDEELVERLKKKIEDILRTLEERHKKLIKELREILKRLSDESRRLAEETEKVLEDLERKGVDRDHMVLHEYVNAAGITENRKVNEEVEKRLRELEEENKKVIEDLKSTVEELVERLR

SEQ ID NO: 14214 - protein, 177 aa, Artificial Sequence; identical to SEQ ID NO: 14213
  Synthetic sequence.

SEQ ID NO: 14215 - protein, 183 aa, Artificial Sequence
  Synthetic sequence.
KVEKRLTDLLKTVADEVKRVEDELRETVRESKEVVDKSRRDLERTVEESEKTVKDAERRVSEDLVRRIRKVLDENREVNDRVVKEDERILEENERVNRKVVEKIRDILRKIEEVVRRAAEEIRRDHMVLHEYVNAAGITERLKEEADRVRERSKKILTDLKKSSEDVKRESERMLKKLEDEIR

SEQ ID NO: 14216 - protein, 184 aa, Artificial Sequence
  Synthetic sequence.
SLEEVIKTVRKLLEEVERRLREVVERAERMLEEVRRRTREVSEEAREMLKDVEKALRDKNVSEEIEEKLRKIKEELERDNEKVNRDNERSVETLRRLLDRVRKEVKDIAKELEERLKEVERKSRDHMVLHEYVNAAGITVKRLRELIEKLREEVEKIVDENRKTVEELRRRNEEIVRRLRREIE

SEQ ID NO: 14217 - protein, 184 aa, Artificial Sequence
  Synthetic sequence.
KLDEVIEEIRKLLRRMEEELRRSVEEIDKLLREVRELLRESSEKVKELLRRVTEELKKRGVPEEVKERLDRLVETLRRLSEETLKELDKLVREVKELSKESLKRLRELVERLRRELEEIKKRGRDHMVLHEYVNAAGITIRELREIVKRNTEIAREVVERAKRIVEKNEKLLKDVVEEAKKIVK

SEQ ID NO: 14218 - protein, 181 aa, Artificial Sequence
  Synthetic sequence.
SEVERVLEDLRRLVRDVEEKLRRIIERDRRLVEEVERENRKTIRKIEELLRKVLEELKDISDKKTIERIVREIIKEARDLVRRNHERNREIVDESRRLVEELRRIVEEIIRRLRELLERVKSGRDHMVLHEYVNAAGITLRELLKELEKTSRDLKKRLEELDRELKALVEKVERDLEELRK

SEQ ID NO: 14219 - protein, 177 aa, Artificial Sequence
  Synthetic sequence.
KEEEDLEREVKRLEDKVREDAKKLEEVVKTVEKLVRDDARRNEEVVKEVADRVRRLTERKLDEETLRKVKEDLKRTLERLKRENEKSLEELRDILRRLKKENDDTLKELRDELKRLTDSGASERDHMVLHEYVNAAGITSREVEKRLRRIIRELERVSKEVLDRLREIIEKLDRDAT

SEQ ID NO: 14220 - protein, 177 aa, Artificial Sequence
  Synthetic sequence.
ELREDVERVVDEIRRLVEENVRRIDEVAKDIKRLADDNVRRVKELVRKIEEDIRRLKEEGVTEVVDELREEVRKLSEDNRRHSRELIERVKKLLKELEEHSRDLKRRVKELLEDLKRKGVDERRDHMVLHEYVNAAGITRDALRRLEEAIRRVRRESERVNRELDEVIKRVTEELKK

SEQ ID NO: 14221 - protein, 181 aa, Artificial Sequence
  Synthetic sequence.
DEERKLEKSLKDVEDTHRRLLEKNDEDLKELRKRVEDMLRRLEDALRRILEDIEEKLKRIEDDETLKRLRKRVKELLDEIRRRLERLEREVDKRLEEIKERNDRHHEEAKKELKRIRDKIRRDRDHMVLHEYVNAAGITVAEDLKRSNDEVKELAERLEETIRDLLRRIEEILKEIEERVR

SEQ ID NO: 14222 - protein, 181 aa, Artificial Sequence
  Synthetic sequence.
DEEETLEDVLRELEERVEKLLRDLTRDLERVEKEHKELLKRNKEAIDEIEKRIEELLKRIEDDEKLRRLKEEVRKLVEESRERNKRHHKEVREVLERIRELLERLEKELRRALEEIRDKIRKDRDHMVLHEYVNAAGITAEEVIRDLERKVRKLERDIRENIKKNHREVREILRKIEEDVR

SEQ ID NO: 14223 - protein, 175 aa, Artificial Sequence
  Synthetic sequence.
SEEDELRRLLKEVNERVERLLDEIRKELEKIAEELRDLLKKNEDKLREIKRRVEENRVDEEIKKDAERALTELKEEHERLDREAKKDLDRIRKELERLEEEHRRVSERIEEVLDKESDKTEDIRDHMVLHEYVNAAGITEIKKELRDILEKLRRVSEELNKKLDEILKRIEDRTR

SEQ ID NO: 14224 - protein, 177 aa, Artificial Sequence
  Synthetic sequence.
SAIEKVKEVVERVLETVRDSVRRSHEESKRLIDKVRKRLEEVREEVKELIERVRRKGIPERMVEKLERDLEELLKEIKDTIDRIEEELRTSNRRLKETNDEIAKRLEELLRELSRDRDKDAVERDHMVLHEYVNAAGITNDDNVRRVKEVIDRAEKLVRDLLREIRKLIEKLIRDTE

SEQ ID NO: 14225 - protein, 177 aa, Artificial Sequence
  Synthetic sequence.
SVLEEVRRRVEELLKTVKESVDRSHERSERLIEEVRESLKEVKRRVKELVERVREKGIPEDRVKRIEDKLREELERLERENRKIEEDLKRSNDELRRENERIAERLEELLRELSRDTNDKVARRDHMVLHEYVNAAGITNKRNLEDVERVIRELNKENERVLREVEKKIEKLIRETE

SEQ ID NO: 14226 - protein, 179 aa, Artificial Sequence
  Synthetic sequence.
SSKEVADELRKKAEKVLDELRKIIRELERKNEDSLRRTEEIVRRLEEEAERVLRDLVRTRGEDDRLVREVERLLRELKRRLEELIRRSEELIKRSREEVDRVIRTVEKLLEELDRLLRANKGDRDHMVLHEYVNAAGITDLARKLAKSSDDTVREDEKLVEELRKDVKRIVRKIKKDLE

SEQ ID NO: 14227 - protein, 183 aa, Artificial Sequence
  Synthetic sequence.
KDAEDLERRVRELVEENNRVSKRLAEEVTRLVKENEDKVRELEKEVRDRAKELLDMKRRGEVREEEVKRVLREIEELLREITEHSKEVLKTIEKLLRDSLEHSRRVLEEIERLLETILRKSKDRDHMVLHEYVNAAGITRSLRENEKVADELRKRAEKSLEDVKRVVDELRKIVDDVLKRVED

SEQ ID NO: 14228 - protein, 183 aa, Artificial Sequence
  Synthetic sequence.
SEIEKLVEDVRKLVEDNLRHSEEVHRRNRRLIEENERKIDELEKRVRKLVEELRELAERGEIREEEARKVLEEIKRLLDEIRRHSEEVLKEIERTLKENLKHSEEVLRRIEERLEDIKRKDKDRDHMVLHEYVNAAGITRSLDESEKLNRESRKRVTRSLEKVDDLVRELEKLARKVLEEVKT

SEQ ID NO: 14229 - protein, 181 aa, Artificial Sequence
  Synthetic sequence.
EEIERALREMRELSRTHKELVEKILRDIAELAKTHERINEDILRKIKKLIDEIADEIRKEDKKEELKRKIDELRRRAEELLKESKEHLKRLEDTVRELIERLKETLKKVEEDLKRILEKLEKSRDHMVLHEYVNAAGITNRELLKRVEDEVRRLIRKLEELNRRTEEEVKKLIKKLEDDLK

SEQ ID NO: 14230 - protein, 174 aa, Artificial Sequence
  Synthetic sequence.
DEEEDLERRIKKLLDENRELLKRIAEELRRLLEELRRLTEESADRLRRLLKELKDRGVPEKDLRDVAEKVKKVLKESEDSNRDVKRKLEKLLRDLERSTERLEREARKVRKLLRDGKDIETLLRDHMVLHEYVNAAGITIEKEIRDLIKEDKERNRELSERLRKLVEELKKKAT

SEQ ID NO: 14231 - protein, 178 aa, Artificial Sequence
  Synthetic sequence.
SSKDEIRRRVEEVVERSDEIVKRSREHVKTVVDELDRVVKELERKVREVVKKLDKIRKDGGSEETLKRVLDELREILKELKEEVKKVKRKLEKVVKENRDTIREVEERNRKILDELRKRGVEERDHMVLHEYVNAAGITLRRVLKESEDIAKEAEDRLKTVLERVERIADEVLKRLTK

SEQ ID NO: 14232 - protein, 178 aa, Artificial Sequence
  Synthetic sequence.
SKVEKLEEEIARLVERSRRLVEELKKEVTKVKEKVDEIVERSRRHVKKVVEKLRDIKRRGGSEEVLRRVTEELKKVLEDNRRVIEEVLRDLERILEELKRKAEEVTKRNRDDLKRLRDSGVDERDHMVLHEYVNAAGITLRTVLRDVTEDIKRIAEELKKALEDSTEIIRRAEDELRT

SEQ ID NO: 14233 - protein, 179 aa, Artificial Sequence
  Synthetic sequence.
REDERLEEIARKIKKVVDELVERNKKLTEDNHESVRRAEKRNRELSRELEEVAKRAIERIRSDKKVVDEVKKLLEDAKKHSKEVIDELRRLNEESKRSSEDTIRRMRKLLRELEETVKAKKGDRDHMVLHEYVNAAGITDLSRRNEEKVRRISEEIKKLSKDNERTIKEIIKEIEERVK

SEQ ID NO: 14234 - protein, 184 aa, Artificial Sequence
  Synthetic sequence.
ELIKKARKDVEEVRERSERLVDELRKRNKKLADESRRLIDKLRKDVEKVLREIEDLLRKRRTKDVLKEIEDLVRELERELRRVVKESSDKVRKLIRENEKVVEESSRLFRDLVEKLRRVVEERRDHMVLHEYVNAAGITEDVNEKSERDVREINKESERVNEETEREVEDAIRKLREVLRRAKK

SEQ ID NO: 14235 - protein, 176 aa, Artificial Sequence
  Synthetic sequence.
REAEEAKEEVEELNRRNKKELDDARRRVDELDKRNKDRLKESSDRVKRLVEELERVKEEGRSDDRLREKIERMLKTSADELERLKEENKRALRDLAERLRELIERNRRKLEEITRRTVPDKDVRDHMVLHEYVNAAGITRVLEELAEKIDRSLKELDDVLRKNETDLKRVIEDLKR

SEQ ID NO: 14236 - protein, 174 aa, Artificial Sequence
  Synthetic sequence.
SEEEVLREAAKTVEKLLDEIRRSLEKVSKRVEDSNRELKESLDRVRERVRELLEELRKNNVDRTLLEDVRRKLERIEERNEEMNDRSRRKLEELRERNRKILEDIRRTLEDLKRRQLPKDDVERDHMVLHEYVNAAGITNKRALRENEERVKTLNRENEEMLKRIEEEVRRATK

SEQ ID NO: 14237 - protein, 182 aa, Artificial Sequence
  Synthetic sequence.
SELEKTLEDLKRHSEENKKKLEEDLRDMERNLKENKDRLKKILEEAEKTLKDLERRFREGDIDERELERVRRKMEEIKKRLDENVERNRRKAEDIKRKLDENVKRSEDRVKEIKEDIRRRVRDRDHMVLHEYVNAAGITENREIHERVKKALDDIVKELEELHERLKRRLEEILRRIAETVR

SEQ ID NO: 14238 - protein, 179 aa, Artificial Sequence
  Synthetic sequence.
RLEDEVRKMEKEVREEVKRLEDESRKVLEESRRNLDKLREESKRVLDTVRERIKDLRRRGLDERVLRELLKRVREVHERNRKLLDEVRRASEKVHEDNRRILEEVRKTVKDVVDKLRRVDAKVRDHMVLHEYVNAAGITREVKKSIEEVKEINRRLNEEVKKTIEEVKEIVKEVTERAK

SEQ ID NO: 14239 - protein, 183 aa, Artificial Sequence
  Synthetic sequence.
RVDERLDTVLKRVEETVRENKKKNDELLERSKENIDRLKKRLDDLLDKVRREAEKLKREVTKEEVKKIIDEVLKEIEDLLRTVKEELDRALERNREVVEETKRRIDRVLKEIEKLIRDVKRDRRDHMVLHEYVNAAGITKEVNDTSKDAERRLRETNERLNEIVKEVEKRIRELSEEVRKRVK

SEQ ID NO: 14240 - protein, 183 aa, Artificial Sequence
  Synthetic sequence.
SVDERLDEVLERVKEDMDRNRRKNDESLREDEENVRRNKKETDESVKRVEERVRELKKRVKDERVKEFLDRVLEEIRKSAEEVKTIIDEVHKESEETVRRTKKIIEEVLRRIEELIRRVKKDRRDHMVLHEYVNAAGITKEVNKVSDEAHKRNKELNERVNRVNKEAHKRNEDLLREAERKVR

SEQ ID NO: 14241 - protein, 183 aa, Artificial Sequence
  Synthetic sequence.
SIEDEIRKLKEDIKRVLDKVRRDNERLKERLDKVLEDIRRSSEDNNRKLEEVLKRIRDKPVDERLVRKVEEAVKRLKEHNEDSTRRVEEVIRRLKEESEESVRKTEKVARDLERELDEVLTRGRDHMVLHEYVNAAGITERLKREDKEVADRAEKLLREAEEHNKRSLDESRRVLEELDEEIR

SEQ ID NO: 14242 - protein, 183 aa, Artificial Sequence
  Synthetic sequence.
SIREKIRELEERLEEVLRRIEENSERVLREAERVLKEIKDNSKRNNEKLERALEEIRKLPVEDELVRRVKELVERLKRHNKKSSEDVERVVRELKEELKRSSEEVKKAVDRLKEELEKVLRDGRDHMVLHEYVNAAGITRKLEEHNRRVVERLKRLLEELKKHNEDSLRKSEEVLRKLEEDAR

SEQ ID NO: 14243 - protein, 179 aa, Artificial Sequence
  Synthetic sequence.
SEVEELIKRLAKVLKELVDKVRKVIEDTKELLERLKRRSEDHIRKLREVLKEAKDQPIDDEELKEILDRLRKTLEELEEELKKALEDDREEAKRLVDDARRVLKELEEEVREIRERRGESEELRDHMVLHEYVNAAGITEVIKEWERVHREVEELLKRLIDENRKVLDEIRKLLEEKSK

SEQ ID NO: 14244 - protein, 178 aa, Artificial Sequence
  Synthetic sequence.
DEARELVKELEDLIREITKTVRRLLEESEELIKRIDDAVDDLRRADEDLNREIKEEIEKGKSKESLEALIERLKESLERVKRTIEKLIRDLERLNEKLRRDVESLVAELEKILSKIKRGGLDERDHMVLHEYVNAAGITAREILKRSEDETDKLREKAERILEDLERANRRTMDEARR

SEQ ID NO: 14245 - protein, 184 aa, Artificial Sequence
  Synthetic sequence.
DEIRKVVKEITDLLKASNDKNRKVVEEIRDLLRKSKKLADELVERLRALVEDLRRRIDKSGDKETAEDIVRRIIEELKRILKEIEDLARRINREIERLVEEVERDNRDVNRAIEELLKDIARRRDHMVLHEYVNAAGITSRRNEESMRRVKEDADRVSEANKEVLDRVREEVKRLIEEVRETLR

SEQ ID NO: 14246 - protein, 180 aa, Artificial Sequence
  Synthetic sequence.
REVEEMIKELEELLKDLKEKNERASKRNRELVRRLEEENKRVIEELKKLVKELEDLVRSGEDEEVLREVLKRLEEVLERVRALNERVLEAIEKSLEEVKASNEAVKRRLKELLEEAERGVDSERDHMVLHEYVNAAGITDELDEYTRESIRRAKKEIERLNRETKKVIEEVVKRIEEERK

SEQ ID NO: 14247 - protein, 181 aa, Artificial Sequence
  Synthetic sequence.
DAVEEAEKLIRKVIADSEKLLRDLADLNAKSIRRSEKLVEDDRRANEDVIRKLEELRRNGGSEEELRALLKEVEDTNRASHETNKRLLDEDRALNKEVHDRNEKLLRDIKRLVEEVAKGIDSERDHMVLHEYVNAAGITIEDSSREIKRLLEESERVMKRSSEDIKRTLDDTRRVVEEVRR

SEQ ID NO: 14248 - protein, 181 aa, Artificial Sequence; identical to SEQ ID NO: 14247
  Synthetic sequence.

SEQ ID NO: 14249 - protein, 175 aa, Artificial Sequence
  Synthetic sequence.
SEAEEIRRRLEEISRRSVEHLRKVLEEIKRISERSKRHLDRVLEENARRLEELAELLKRGGDKEELLADLKAVHDESRKVIEKNAEENDRALKAAKEVIDENRERNKRVLDEVRKGGLPEEVLRDHMVLHEYVNAAGITIEEEIKKIIDKSREDIKRVLEEIERLNAKAADDLRK

SEQ ID NO: 14250 - protein, 183 aa, Artificial Sequence
  Synthetic sequence.
SDVDRVLEEIRKLLEDLKRHSEKVSEENEDLLRANTELNKRVSEDNERLLEELKRLRERGGISEEDLKRALDRVRKTVETVKEENKRSLEDVRRTVETNKRKLERVVEEIKKLIEDAKRRGSGRDHMVLHEYVNAAGITRTIDRLLETSDRSLEKVEADLRRLNEELDRSLERAERTIRELAK

SEQ ID NO: 14251 - protein, 177 aa, Artificial Sequence
  Synthetic sequence.
SEDEDLDRVAEKLAREHKKSVEEIKRVLKSADEESKKLVRDTERVIEEIKREVEEARRGNIDEELVERLKKKIEDILRTLEERHKKLIKELREILKRLSDESRRLAEETEKVLEDLERKGVDERDHMVLHEYVNAAGITNRKVNEEVEKRLRELEEENKKVIEDLKSTVEELVERLR

SEQ ID NO: 14252 - protein, 177 aa, Artificial Sequence
  Synthetic sequence.
SKEDRLREELKKLLARLAEEIERLKRALEESNKDLKRTIDASEKHLRDVNEDVKRGGVSEELLRELERSTAENKERAKELLKRHEDLVRKVEKELADLLRRLEEIVARVDEALKRGISEEELDRDHMVLHEYVNAAGITLEELLKRVEKLTEDAKRDLERSNREHKELADRIKETAR

SEQ ID NO: 14253 - protein, 177 aa, Artificial Sequence; identical to SEQ ID NO: 14252
  Synthetic sequence.

SEQ ID NO: 14254 - protein, 183 aa, Artificial Sequence
  Synthetic sequence.
KVEKRLTDLLKTVADEVKRVEDELRETVRESKEVVDKSRRDLERTVEESEKTVKDAERRVSEDLVRRIRKVLDENREVNDRVVKEDERILEENERVNRKVVEKIRDILRKIEEVVRRAAEEIRDRDHMVLHEYVNAAGITRLKEEADRVRERSKKILTDLKKSSEDVKRESERMLKKLEDEIR

SEQ ID NO: 14255 - protein, 184 aa, Artificial Sequence
  Synthetic sequence.
KLDEVIEEIRKLLRRMEEELRRSVEEIDKLLREVRELLRESSEKVKELLRRVTEELKKRGVPEEVKERLDRLVETLRRLSEETLKELDKLVREVKELSKESLKRLRELVERLRRELEEIKKRGERDHMVLHEYVNAAGITRELREIVKRNTEIAREVVERAKRIVEKNEKLLKDVVEEAKKIVK

SEQ ID NO: 14256 - protein, 181 aa, Artificial Sequence
  Synthetic sequence.
SEVERVLEDLRRLVRDVEEKLRRIIERDRRLVEEVERENRKTIRKIEELLRKVLEELKDISDKKTIERIVREIIKEARDLVRRNHERNREIVDESRRLVEELRRIVEEIIRRLRELLERVKSGERDHMVLHEYVNAAGITRELLKELEKTSRDLKKRLEELDRELKALVEKVERDLEELRK

SEQ ID NO: 14257 - protein, 178 aa, Artificial Sequence
  Synthetic sequence.
DDLERVLKEIKKAADKIREDNKRTADKIRKRVKELDDETRDMLRRIRKLVKEIKERVRGREEARKVIEELKKLVDEVRKRNEKSIEELKKLLKEDRDLMRRVIEELEDLVRRLREEVRDDEALRRDHMVLHEYVNAAGITLKETSDRVRELIDKHRRLSEEVEKDVKRLIDELKKKTD

SEQ ID NO: 14258 - protein, 181 aa, Artificial Sequence
  Synthetic sequence.
DEERKLEKSLKDVEDTHRRLLEKNDEDLKELRKRVEDMLRRLEDALRRILEDIEEKLKRIEDDETLKRLRKRVKELLDEIRRRLERLEREVDKRLEEIKERNDRHHEEAKKELKRIRDKIRRDGRDHMVLHEYVNAAGITAEDLKRSNDEVKELAERLEETIRDLLRRIEEILKEIEERVR

SEQ ID NO: 14259 - protein, 175 aa, Artificial Sequence
  Synthetic sequence.
SEKEDLERELEEVRRRVEESLRKNEEDVKRVRDELKKLLDENRKELERIRREVERANVDKRVLDEADRLLKELEDDHKKLEEDAKKALDELREEHKRLEETLRRMLKRIKEVLDRESDKMEEIKRDHMVLHEYVNAAGITLNKKLEEIVRRLKKVSDELNRRIEEIAERVRRRRK

SEQ ID NO: 14260 - protein, 177 aa, Artificial Sequence
  Synthetic sequence.
SAIEKVKEVVERVLETVRDSVRRSHEESKRLIDKVRKRLEEVREEVKELIERVRRKGIPERMVEKLERDLEELLKEIKDTIDRIEEELRTSNRRLKETNDEIAKRLEELLRELSRDRDKDAVEDRDHMVLHEYVNAAGITDDNVRRVKEVIDRAEKLVRDLLREIRKLIEKLIRDTE

SEQ ID NO: 14261 - protein, 177 aa, Artificial Sequence
  Synthetic sequence.
SVLEEVRRRVEELLKTVKESVDRSHERSERLIEEVRESLKEVKRRVKELVERVREKGIPEDRVKRIEDKLREELERLERENRKIEEDLKRSNDELRRENERIAERLEELLRELSRDTNDKVARDRDHMVLHEYVNAAGITKRNLEDVERVIRELNKENERVLREVEKKIEKLIRETE

SEQ ID NO: 14262 - protein, 177 aa, Artificial Sequence
  Synthetic sequence.
SVIERVEEEMEKVIRDSERVTKEVEDRAREVHERSEKRIREVEETSRRVLEELRRAGVDKRILDELRKRIKDSREDLERINEELRRALRKLLEDSKRINEELRKTLEELRKRLERVDDEEEVKKRDHMVLHEYVNAAGITEELARRVDELVRESIERVDRNVEENKRLVREAIERRR

SEQ ID NO: 14263 - protein, 183 aa, Artificial Sequence
  Synthetic sequence.
SEIEKLVEDVRKLVEDNLRHSEEVHRRNRRLIEENERKIDELEKRVRKLVEELRELAERGEIREEEARKVLEEIKRLLDEIRRHSEEVLKEIERTLKENLKHSEEVLRRIEERLEDIKRKDKDSRDHMVLHEYVNAAGITSLDESEKLNRESRKRVTRSLEKVDDLVRELEKLARKVLEEVKT

SEQ ID NO: 14264 - protein, 181 aa, Artificial Sequence
  Synthetic sequence.
EEIERALREMRELSRTHKELVEKILRDIAELAKTHERINEDILRKIKKLIDEIADEIRKEDKKEELKRKIDELRRRAEELLKESKEHLKRLEDTVRELIERLKETLKKVEEDLKRILEKLEKSRRDHMVLHEYVNAAGITRELLKRVEDEVRRLIRKLEELNRRTEEEVKKLIKKLEDDLK

SEQ ID NO: 14265 - protein, 182 aa, Artificial Sequence
  Synthetic sequence.
DEIETVLDEVRRLHEDAKRRLEEMIDEVRKLNEESVRELARVVEEVERLLRTVKEEVERAGLDKGKLEELEERLERVREDVERILREIKRRNEKTLEDSERILEENKERNRTVLKKLKELRDRGRDHMVLHEYVNAAGITSRESVRRVLEKNRRVVEESKRLAEELLRRVKKVVDEIRKRVE

SEQ ID NO: 14266 - protein, 182 aa, Artificial Sequence
  Synthetic sequence.
DELEEVVRRVRELSRTVKEELREVIERVRELSERVKKKLRKVLREVAELHREVMKRVRDSGLDKSKLEKLEDESRRVLDKSREILRKNEEDNRRLNKELEEILKKNEDDNEDVRRKVDEVTRKGRDHMVLHEYVNAAGITSRRSAKDALKRVEDRVRESDKSVRELLEENRKVVEDIKRRVD

SEQ ID NO: 14267 - protein, 178 aa, Artificial Sequence
  Synthetic sequence.
SSKDEIRRRVEEVVERSDEIVKRSREHVKTVVDELDRVVKELERKVREVVKKLDKIRKDGGSEETLKRVLDELREILKELKEEVKKVKRKLEKVVKENRDTIREVEERNRKILDELRKRGVEERRDHMVLHEYVNAAGITRRVLKESEDIAKEAEDRLKTVLERVERIADEVLKRLTK

SEQ ID NO: 14268 - protein, 182 aa, Artificial Sequence
  Synthetic sequence.
SDADRVAEELKKLVEDSRRENERVIEESKRLVKENEDRNRELIERLKKLVDKLRDILEKEKDKKTLDDIVREILERLKRLLEKVEDENRKSHEENKRLLEDVKRKNKRISDELKRLLEEIERRNRDHMVLHEYVNAAGITNKRVMEKTEEVAKKSSEDIKRVADETRRRAEELLKEVDELRK

SEQ ID NO: 14269 - protein, 182 aa, Artificial Sequence
  Synthetic sequence.
DEVREVAERLRRLVDESRKRNEEVIKESEALVDRVRKTNEEVMKRLRELIDKLEKDIRRLKDKKTVEKIIREVLKKIDELLKRVERTNREISKENKRLLDEVRKTNEEISRRLKKLLEDIRRRNRDHMVLHEYVNAAGITNKEVLRKTEEMVKRSTETNKRLLERSKEVADRLRERIKEAAK

SEQ ID NO: 14270 - protein, 175 aa, Artificial Sequence
  Synthetic sequence.
SEVDEVLREAKRIVDEVHKDNERATEESRRLVKKVHEENEEMVKDIERIVKEVKDANIDEKLVTEILKEIEEALKEAARRNKEVKDRLRELSRRVSERNREILEELKERLDRVRERRKDVKELERDHMVLHEYVNAAGITHRKENKRLLEELDRSLRELAKIVKEVLDEIRERTR

SEQ ID NO: 14271 - protein, 185 aa, Artificial Sequence
  Synthetic sequence.
DDIERLKREIERLLKEAEKISRDNEERSKELLDRLRKLSEDNKRKIDKLVEELKRLADKIKDKEELTRRLKEVVDRVEKSVRDSERMLREVVREDEESVRRSKTKLEDLLRKVEELVRRLEKKVRDHMVLHEYVNAAGITKKKVDELKRKNDEVHRRSREEVKRLLEENRKLLEDLRRMVREITQ

SEQ ID NO: 14272 - protein, 185 aa, Artificial Sequence
  Synthetic sequence.
SAEELLRTIEKRIEDNHRRLEEILEEIARLIEDMLRTDERIVREIKELLKEVLDRVRRAGVPEEVLERVRRELERLKKELEELRRRSEEKVKELKRRLEEIRRKLEEEHRDLRRKLEELRRDLGRDHMVLHEYVNAAGITLERSLREAEDLLRRVEEVIRTSKKESKDVLEKIERLLRDLERRTR

SEQ ID NO: 14273 - protein, 182 aa, Artificial Sequence
  Synthetic sequence.
SELEKTLEDLKRHSEENKKKLEEDLRDMERNLKENKDRLKKILEEAEKTLKDLERRFREGDIDERELERVRRKMEEIKKRLDENVERNRRKAEDIKRKLDENVKRSEDRVKEIKEDIRRRVRDKRDHMVLHEYVNAAGITNREIHERVKKALDDIVKELEELHERLKRRLEEILRRIAETVR

SEQ ID NO: 14274 - protein, 179 aa, Artificial Sequence
  Synthetic sequence.
RLEDEVRKMEKEVREEVKRLEDESRKVLEESRRNLDKLREESKRVLDTVRERIKDLRRRGLDERVLRELLKRVREVHERNRKLLDEVRRASEKVHEDNRRILEEVRKTVKDVVDKLRRVDAKVVRDHMVLHEYVNAAGITEVKKSIEEVKEINRRLNEEVKKTIEEVKEIVKEVTERAK

SEQ ID NO: 14275 - protein, 183 aa, Artificial Sequence
  Synthetic sequence.
SIEDEIRKLKEDIKRVLDKVRRDNERLKERLDKVLEDIRRSSEDNNRKLEEVLKRIRDKPVDERLVRKVEEAVKRLKEHNEDSTRRVEEVIRRLKEESEESVRKTEKVARDLERELDEVLTRGGRDHMVLHEYVNAAGITRLKREDKEVADRAEKLLREAEEHNKRSLDESRRVLEELDEEIR

SEQ ID NO: 14276 - protein, 183 aa, Artificial Sequence
  Synthetic sequence.
SIEERVRELMRDLERVLKEIREHSKRVIEEAKRVLEEIERNSERNNKELEEVLDEIRKRPVDETLVREVEEAVKKLKEHNKRSSDTVRDAVRKLVERLKESSDRATELVKDLKRKLEEVLRRGGRDHMVLHEYVNAAGITDLRRNNKEVVDRLKEVLERLKEHNRRSLDESRKVLRELKERIR

SEQ ID NO: 14277 - protein, 180 aa, Artificial Sequence
  Synthetic sequence.
SVEELLRKLEEVLRKIREENERSLKELRDRAREIVKRNRETNRELEEVIKELEKRLSGADKEKVEELVRRIRRIVERVVEEDRRTVEEIEKIAREVVKRDRDSADRVRRTVEDVLRKATGSEDIRDHMVLHEYVNAAGITESVKKVEEIARDIRRKVDESVKNVEKLLRDVDKKARDRKK

SEQ ID NO: 14278 - protein, 185 aa, Artificial Sequence
  Synthetic sequence.
SEAEELLKRLEDRAEEILRRLEEILRTSRKLAEDVLRELEKLLRESERRIREVLEELRGIKDKKELEDVIREVEKELDESLERSRELLKDVLKKLDDNLKESERLVEDIDRELAKILEDLKKAGRDHMVLHEYVNAAGITRERLKRIVDENAKIVEDARRALEKIVKENEEILRRLKKELRELRK

SEQ ID NO: 14279 - protein, 179 aa, Artificial Sequence
  Synthetic sequence.
SEVEELIKRLAKVLKELVDKVRKVIEDTKELLERLKRRSEDHIRKLREVLKEAKDQPIDDEELKEILDRLRKTLEELEEELKKALEDDREEAKRLVDDARRVLKELEEEVREIRERRGESEELDRDHMVLHEYVNAAGITVIKEWERVHREVEELLKRLIDENRKVLDEIRKLLEEKSK

SEQ ID NO: 14280 - protein, 184 aa, Artificial Sequence
  Synthetic sequence.
DEIRKVVKEITDLLKASNDKNRKVVEEIRDLLRKSKKLADELVERLRALVEDLRRRIDKSGDKETAEDIVRRIIEELKRILKEIEDLARRINREIERLVEEVERDNRDVNRAIEELLKDIARRGRDHMVLHEYVNAAGITRRNEESMRRVKEDADRVSEANKEVLDRVREEVKRLIEEVRETLR

SEQ ID NO: 14281 - protein, 176 aa, Artificial Sequence
  Synthetic sequence.
STAETVEKKVEEVIRENEKSMRESEEKVDRSTKRIEDVLRRLEETIRKTSDDIAKGVKGERVKEVLEENRRLLEEAKKLVDEVLETNKKLLEDDKRLNEEVSKTLKKLLEEIKSVDTREDATRVRDHMVLHEYVNAAGITETIRRSEELVRRIERVIEEIIKRSEKLLEDVARESK

SEQ ID NO: 14282 - protein, 182 aa, Artificial Sequence
  Synthetic sequence.
DEVREVAERLRRLVDESRKRNEEVIKESEALVDRVRKTNEEVMKRLRELIDKLEKDIRRSGDKETVEKIIREVLSAIDELLKRVERTNAEISKENARLLDEVRKTNEEISRRLAKLLEDIRRGSRDHMVLHEYVNAAGITNKEVLRKTEEAVKRSTETNKRLLEASKEVADRLRERIKEAAK

SEQ ID NO: 14283 - protein, 180 aa, Artificial Sequence
  Synthetic sequence.
REVEEMIKELEELLKDLKEKNERASKRNRELVRRLEEENKRVIEELKKLVKELEDLVRSGEDEEVLREVLKRLEEVLERVRALNERVLEAIEKSLEEVKASNEAVKRRLKELLEEAERGVDSEKRDHMVLHEYVNAAGITELDEYTRESIRRAKKEIERLNRETKKVIEEVVKRIEEERK

SEQ ID NO: 14284 - protein, 181 aa, Artificial Sequence
  Synthetic sequence.
DAVEEAEKLIRKVIADSEKLLRDLADLNAKSIRRSEKLVEDDRRANEDVIRKLEELRRNGGSEEELRALLKEVEDTNRASHETNKRLLDEDRALNKEVHDRNEKLLRDIKRLVEEVAKGIDSEERDHMVLHEYVNAAGITEDSSREIKRLLEESERVMKRSSEDIKRTLDDTRRVVEEVRR

SEQ ID NO: 14285 - protein, 183 aa, Artificial Sequence
  Synthetic sequence.
SKLEEVEKAVRKVIEDSRRVNEEVNRRSEEVVRELEKVHREVNDASRRVVEKARRVLKGSGDERLAAEVERIIEEIRELNERDRKRVEEIRKEIEDLNRDLNRRSKESEDRLRKLLEDATRGGVRDHMVLHEYVNAAGITENKRRVEDVARKSKELVEDVRRHSEEVVRRVEELVKEVEERVR

SEQ ID NO: 14286 - protein, 183 aa, Artificial Sequence
  Synthetic sequence.
SDVDRVLEEIRKLLEDLKRHSEKVSEENEDLLRANTELNKRVSEDNERLLEELKRLRERGGISEEDLKRALDRVRKTVETVKEENKRSLEDVRRTVETNKRKLERVVEEIKKLIEDAKRRGSGDRDHMVLHEYVNAAGITTIDRLLETSDRSLEKVEADLRRLNEELDRSLERAERTIRELAK

SEQ ID NO: 14287 - protein, 185 aa, Artificial Sequence
  Synthetic sequence.
SSVEELLERLRRISEENKRRIEKLLREVEKVLRELKDRHRKLLKRVEEIIRKVKEEIKSGLPEEAVKRVLERVRERVKEVLEEADRLNDEMRRIVTEVEKELDKSDKEVEDAVRDILKKIEEGVRDHMVLHEYVNAAGITLDENRDRSKKVKEEIRRILEDLTRTTERVKREIAKLLKELEDTAR

SEQ ID NO: 14288 - protein, 180 aa, Artificial Sequence
  Synthetic sequence.
SELEEVLRRIEALVRKAHKENEDVLREIERLVRTAHRLNKKVDDDSAKIAEDLKRGGREDKDKVEEALRRLRELYRRLEEENRRILREIEELVKELEKRNREILKELEDLVADAERKGSDGSEARDHMVLHEYVNAAGITRSLEELRKEVERLKKEVEDSLRELKKSLEEWVKSLEEATR

SEQ ID NO: 14289 - protein, 186 aa, Artificial Sequence
  Synthetic sequence.
SAEDSIRELLERDERLLEEARKEAKRLNEENERLLERIEETVRRLLEEIKRLLDDIRKKIKGEKLREIEELVRRVKRTIEKLLEEVKKSVEDSSKRIEELLEAVERSVERTKEEIRRLLDEVRKDRDHMVLHEYVNAAGITHDENRRLVKEVIEEVEKLIRDNEKLAEDIEREIRRLLKELDEAAK

SEQ ID NO: 14290 - protein, 182 aa, Artificial Sequence
  Synthetic sequence.
DEAEKLLKELRDLLEESRKDLERLLKELEDLLEESKRDLERLLEEITELLKRIKETVERRNEREKLEKLLRELKKVVERLKDNLKDNERRNKEAIERVRKKLKDNERENKKVIEDLRAKLKDLEERDHMVLHEYVNAAGITEEARKRLEEVEEKSKKIIDDARRALDRIDKELRRVVEETRK

SEQ ID NO: 14291 - protein, 183 aa, Artificial Sequence
  Synthetic sequence.
KVEKRLTDLLKTVADEVKRVEDELRETVRESKEVVDKSRRDLERTVEESEKTVKDAERRVSEDLVRRIRKVLDENREVNDRVVKEDERILEENERVNRKVVEKIRDILRKIEEVVRRAAEEIRDERDHMVLHEYVNAAGITLKEEADRVRERSKKILTDLKKSSEDVKRESERMLKKLEDEIR

SEQ ID NO: 14292 - protein, 181 aa, Artificial Sequence
  Synthetic sequence.
SEVERVLEDLRRLVRDVEEKLRRIIERDRRLVEEVERENRKTIRKIEELLRKVLEELKDISDKKTIERIVREIIKEARDLVRRNHERNREIVDESRRLVEELRRIVEEIIRRLRELLERVKSGELRDHMVLHEYVNAAGITELLKELEKTSRDLKKRLEELDRELKALVEKVERDLEELRK

SEQ ID NO: 14293 - protein, 177 aa, Artificial Sequence
  Synthetic sequence.
KEEEDLEREVKRLEDKVREDAKKLEEVVKTVEKLVRDDARRNEEVVKEVADRVRRLTERKLDEETLRKVKEDLKRTLERLKRENEKSLEELRDILRRLKKENDDTLKELRDELKRLTDSGASEDVRDHMVLHEYVNAAGITEVEKRLRRIIRELERVSKEVLDRLREIIEKLDRDAT

SEQ ID NO: 14294 - protein, 181 aa, Artificial Sequence
  Synthetic sequence.
DEERKLEKSLKDVEDTHRRLLEKNDEDLKELRKRVEDMLRRLEDALRRILEDIEEKLKRIEDDETLKRLRKRVKELLDEIRRRLERLEREVDKRLEEIKERNDRHHEEAKKELKRIRDKIRRDGARDHMVLHEYVNAAGITEDLKRSNDEVKELAERLEETIRDLLRRIEEILKEIEERVR

SEQ ID NO: 14295 - protein, 177 aa, Artificial Sequence
  Synthetic sequence.
SVLEEVRRRVEELLKTVKESVDRSHERSERLIEEVRESLKEVKRRVKELVERVREKGIPEDRVKRIEDKLREELERLERENRKIEEDLKRSNDELRRENERIAERLEELLRELSRDTNDKVARDVRDHMVLHEYVNAAGITRNLEDVERVIRELNKENERVLREVEKKIEKLIRETE

SEQ ID NO: 14296 - protein, 183 aa, Artificial Sequence
  Synthetic sequence.
KDAEDLERRVRELVEENNRVSKRLAEEVTRLVKENEDKVRELEKEVRDRAKELLDMKRRGEVREEEVKRVLREIEELLREITEHSKEVLKTIEKLLRDSLEHSRRVLEEIERLLETILRKSKDSERDHMVLHEYVNAAGITLRENEKVADELRKRAEKSLEDVKRVVDELRKIVDDVLKRVED

SEQ ID NO: 14297 - protein, 183 aa, Artificial Sequence
  Synthetic sequence.
SEIEKLVEDVRKLVEDNLRHSEEVHRRNRRLIEENERKIDELEKRVRKLVEELRELAERGEIREEEARKVLEEIKRLLDEIRRHSEEVLKEIERTLKENLKHSEEVLRRIEERLEDIKRKDKDSERDHMVLHEYVNAAGITLDESEKLNRESRKRVTRSLEKVDDLVRELEKLARKVLEEVKT

SEQ ID NO: 14298 - protein, 177 aa, Artificial Sequence
  Synthetic sequence.
REIEELRKEIETLIRENEELNRRSKETSEELIRRLKKLNRDVEEEVRRLVKDLRDRGAPEEDVRRAEERVKKLIEDNKRHSDEVAKTDKKLNEDSERHTRRVEERLRELLDRLSRSDKDEVVRRVRDHMVLHEYVNAAGITEVNETSRRLATRDAKHTRDVLREIKRLADEIRERTR

SEQ ID NO: 14299 - protein, 181 aa, Artificial Sequence
  Synthetic sequence.
EEIERALREMRELSRTHKELVEKILRDIAELAKTHERINEDILRKIKKLIDEIADEIRKEDKKEELKRKIDELRRRAEELLKESKEHLKRLEDTVRELIERLKETLKKVEEDLKRILEKLEKSRERDHMVLHEYVNAAGITELLKRVEDEVRRLIRKLEELNRRTEEEVKKLIKKLEDDLK

SEQ ID NO: 14300 - protein, 178 aa, Artificial Sequence
  Synthetic sequence.
SEIERIERENDRLNEENKKITEDIERELKRLLEENRELSRTIEEELERLLRELRKRNGGREEVLKEVEDRLRRIVEEIRRSDKRLEDIAREVKKRIRESDEELRRVSEEITRRLRKVRDEKTLRERDHMVLHEYVNAAGITKKLLDDLREVSKKNKEDLKRLLREVREVARKVKERAN

SEQ ID NO: 14301 - protein, 182 aa, Artificial Sequence
  Synthetic sequence.
DEIETVLDEVRRLHEDAKRRLEEMIDEVRKLNEESVRELARVVEEVERLLRTVKEEVERAGLDKGKLEELEERLERVREDVERILREIKRRNEKTLEDSERILEENKERNRTVLKKLKELRDRGSRDHMVLHEYVNAAGITRESVRRVLEKNRRVVEESKRLAEELLRRVKKVVDEIRKRVE

SEQ ID NO: 14302 - protein, 178 aa, Artificial Sequence
  Synthetic sequence.
SSKDEIRRRVEEVVERSDEIVKRSREHVKTVVDELDRVVKELERKVREVVKKLDKIRKDGGSEETLKRVLDELREILKELKEEVKKVKRKLEKVVKENRDTIREVEERNRKILDELRKRGVEERARDHMVLHEYVNAAGITRVLKESEDIAKEAEDRLKTVLERVERIADEVLKRLTK

SEQ ID NO: 14303 - protein, 178 aa, Artificial Sequence
  Synthetic sequence.
SKVEKLEEEIARLVERSRRLVEELKKEVTKVKEKVDEIVERSRRHVKKVVEKLRDIKRRGGSEEVLRRVTEELKKVLEDNRRVIEEVLRDLERILEELKRKAEEVTKRNRDDLKRLRDSGVDEEVRDHMVLHEYVNAAGITTVLRDVTEDIKRIAEELKKALEDSTEIIRRAEDELRT

SEQ ID NO: 14304 - protein, 177 aa, Artificial Sequence
  Synthetic sequence.
DEVEDILRKVEEIVKKSITDARRLLKEAREIVEESIKTAEELLRRNEDIVRKLSEDVKRTTDEEKKKKLEEESRRVLEKTKRDLDRTKDDNRKALEKIRKRVKETEEENREVVDRVRKAGVDKRVRDHMVLHEYVNAAGITEVLKRVEEVLEESKRVNEKVEEDVRRVHEEVRKEIK

SEQ ID NO: 14305 - protein, 182 aa, Artificial Sequence
  Synthetic sequence.
SDADRVAEELKKLVEDSRRENERVIEESKRLVKENEDRNRELIERLKKLVDKLRDILEKEKDKKTLDDIVREILERLKRLLEKVEDENRKSHEENKRLLEDVKRKNKRISDELKRLLEEIERRNVRDHMVLHEYVNAAGITKRVMEKTEEVAKKSSEDIKRVADETRRRAEELLKEVDELRK

SEQ ID NO: 14306 - protein, 186 aa, Artificial Sequence
  Synthetic sequence.
SEVDEVRKTLEDLLRRLDEENKDIIRRNKELLDDLDRKVREAIERLKRLLDELRKILEKLKDRETLTRIIEEIEKRARELIKRLRDEIRKIEEESKKSIEDSRKRNDEIRKRLEELIKDLRDKIKRDHMVLHEYVNAAGITREVIERLKEKNKRLEDDSRRVITELRKKLKDLEDRVREEIEELRK

SEQ ID NO: 14307 - protein, 183 aa, Artificial Sequence
  Synthetic sequence.
SEVDEVLERIKRLLERLAEHSDKVVRDIEKLLDDNRKENERLLDKLRRELKRLEEMRRRGDLREELLERVVREVEKEIRDIKRKNKRSVETVEKLVRDDRKELKRALEDVERLIRELETRLKDKERDHMVLHEYVNAAGITIDELLKKTDEVLKRARETIEDLNRKLDKVLKEVRDKLDRLRD

SEQ ID NO: 14308 - protein, 186 aa, Artificial Sequence
  Synthetic sequence.
KEVEDLERRVKEILDRMKRLIDENRKKIEKSIRELERLIDENRKEVERVKKELKDLKREGGDDARTLRERVRKIIEDVEEHSRRSTEEVRRIHKENKEHSERSSDEIRELLRRVEELIEEVKRRLRDHMVLHEYVNAAGITREVVRRAHETNERLVDRSRKAVEKAERTNRRLVEEIRKVAEEVRK

SEQ ID NO: 14309 - protein, 178 aa, Artificial Sequence
  Synthetic sequence.
KAAEEIRKKVEDYKRESEKILEEVEDHSRRSKETLKRLLDDLRRAVEELKRRLEELKRRPRTEEIAKRAEEAVRRAAERIKKVIDDVERHIRENAKELKRLLEEDREASRRLEDEIDKEVKAREVRDHMVLHEYVNAAGITRVLRELAERNKTALEEAERVLRRLKEEIEKVLRKLKK

SEQ ID NO: 14310 - protein, 185 aa, Artificial Sequence
  Synthetic sequence.
SAEELLRTIEKRIEDNHRRLEEILEEIARLIEDMLRTDERIVREIKELLKEVLDRVRRAGVPEEVLERVRRELERLKKELEELRRRSEEKVKELKRRLEEIRRKLEEEHRDLRRKLEELRRDLGDRDHMVLHEYVNAAGITERSLREAEDLLRRVEEVIRTSKKESKDVLEKIERLLRDLERRTR

SEQ ID NO: 14311 - protein, 182 aa, Artificial Sequence
  Synthetic sequence.
SELEKTLEDLKRHSEENKKKLEEDLRDMERNLKENKDRLKKILEEAEKTLKDLERRFREGDIDERELERVRRKMEEIKKRLDENVERNRRKAEDIKRKLDENVKRSEDRVKEIKEDIRRRVRDKDRDHMVLHEYVNAAGITREIHERVKKALDDIVKELEELHERLKRRLEEILRRIAETVR

SEQ ID NO: 14312 - protein, 186 aa, Artificial Sequence
  Synthetic sequence.
SEIEKLIEELRRELEKVKDELERSIEEMDRELDDVRRDSKRLVDEIKRELREVTERTKRGDRPEEVLRKELEDIKRKLRRILEEHHEKIRRIKEKLRRENKRVRDELKRIKDEIDEKVKDVRRKGRDHMVLHEYVNAAGITKRALEELLKKHTRVVERVEKALDELDKELERIVREAEKELDRREK

SEQ ID NO: 14313 - protein, 179 aa, Artificial Sequence
  Synthetic sequence.
RLEDEVRKMEKEVREEVKRLEDESRKVLEESRRNLDKLREESKRVLDTVRERIKDLRRRGLDERVLRELLKRVREVHERNRKLLDEVRRASEKVHEDNRRILEEVRKTVKDVVDKLRRVDAKVVKRDHMVLHEYVNAAGITVKKSIEEVKEINRRLNEEVKKTIEEVKEIVKEVTERAK

SEQ ID NO: 14314 - protein, 183 aa, Artificial Sequence
  Synthetic sequence.
SIEDEIRKLKEDIKRVLDKVRRDNERLKERLDKVLEDIRRSSEDNNRKLEEVLKRIRDKPVDERLVRKVEEAVKRLKEHNEDSTRRVEEVIRRLKEESEESVRKTEKVARDLERELDEVLTRGGERDHMVLHEYVNAAGITLKREDKEVADRAEKLLREAEEHNKRSLDESRRVLEELDEEIR

SEQ ID NO: 14315 - protein, 183 aa, Artificial Sequence
  Synthetic sequence.
SIREKIRELEERLEEVLRRIEENSERVLREAERVLKEIKDNSKRNNEKLERALEEIRKLPVEDELVRRVKELVERLKRHNKKSSEDVERVVRELKEELKRSSEEVKKAVDRLKEELEKVLRDGGERDHMVLHEYVNAAGITLEEHNRRVVERLKRLLEELKKHNEDSLRKSEEVLRKLEEDAR

SEQ ID NO: 14316 - protein, 183 aa, Artificial Sequence
  Synthetic sequence.
SIEDRIRELEKRLEKVLREIEEHSKKVVREAEKVLREIEENSRRNNKRLEEVLDEIRKRPVDETLVREVEEAVRRLKKHNKDSSDTARKLVEELKKELKESSDRVRKVVEELKDRLRKVLEKGGERDHMVLHEYVNAAGITLKEDNEDVVRRLKEVLKELRKHNKRSLDESEKVLRELRERIR

SEQ ID NO: 14317 - protein, 178 aa, Artificial Sequence
  Synthetic sequence.
DEARELVKELEDLIREITKTVRRLLEESEELIKRIDDAVDDLRRADEDLNREIKEEIEKGKSKESLEALIERLKESLERVKRTIEKLIRDLERLNEKLRRDVESLVAELEKILSKIKRGGLDERIRDHMVLHEYVNAAGITEILKRSEDETDKLREKAERILEDLERANRRTMDEARR

SEQ ID NO: 14318 - protein, 176 aa, Artificial Sequence
  Synthetic sequence.
STAETVEKKVEEVIRENEKSMRESEEKVDRSTKRIEDVLRRLEETIRKTSDDIAKGVKGERVKEVLEENRRLLEEAKKLVDEVLETNKKLLEDDKRLNEEVSKTLKKLLEEIKSVDTREDATRVIRDHMVLHEYVNAAGITTIRRSEELVRRIERVIEEIIKRSEKLLEDVARESK

SEQ ID NO: 14319 - protein, 186 aa, Artificial Sequence
  Synthetic sequence.
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIRDHMVLHEYVNAAGITLRDIDKLDRESKEAFRATNEEIAKLDEDTARVAERVKKAIEDLAK

SEQ ID NO: 14320 - protein, 180 aa, Artificial Sequence
  Synthetic sequence.
REVEEMIKELEELLKDLKEKNERASKRNRELVRRLEEENKRVIEELKKLVKELEDLVRSGEDEEVLREVLKRLEEVLERVRALNERVLEAIEKSLEEVKASNEAVKRRLKELLEEAERGVDSEKLRDHMVLHEYVNAAGITLDEYTRESIRRAKKEIERLNRETKKVIEEVVKRIEEERK

SEQ ID NO: 14321 - protein, 181 aa, Artificial Sequence
  Synthetic sequence.
DAVEEAEKLIRKVIADSEKLLRDLADLNAKSIRRSEKLVEDDRRANEDVIRKLEELRRNGGSEEELRALLKEVEDTNRASHETNKRLLDEDRALNKEVHDRNEKLLRDIKRLVEEVAKGIDSEELRDHMVLHEYVNAAGITDSSREIKRLLEESERVMKRSSEDIKRTLDDTRRVVEEVRR

SEQ ID NO: 14322 - protein, 185 aa, Artificial Sequence
  Synthetic sequence.
SEIDEVLTRLRKISKDLNETSDRVNERARKIIDDIKKESKRVNDEAREIVERLKREIDKTRDRDVLRRILKEIEDVARRVKEINEELLARVEKVVREVEEINRELVKRSREAVEAVKRLLDRGVSRDHMVLHEYVNAAGITEEDRKRLEESTRSVRKLLEELKRELEKSTRSVKALVDELRERVR

SEQ ID NO: 14323 - protein, 183 aa, Artificial Sequence
  Synthetic sequence.
SKLEEVEKAVRKVIEDSRRVNEEVNRRSEEVVRELEKVHREVNDASRRVVEKARRVLKGSGDERLAAEVERIIEEIRELNERDRKRVEEIRKEIEDLNRDLNRRSKESEDRLRKLLEDATRGGVTRDHMVLHEYVNAAGITNKRRVEDVARKSKELVEDVRRHSEEVVRRVEELVKEVEERVR

SEQ ID NO: 14324 - protein, 183 aa, Artificial Sequence
  Synthetic sequence.
SDVDRVLEEIRKLLEDLKRHSEKVSEENEDLLRANTELNKRVSEDNERLLEELKRLRERGGISEEDLKRALDRVRKTVETVKEENKRSLEDVRRTVETNKRKLERVVEEIKKLIEDAKRRGSGDERDHMVLHEYVNAAGITIDRLLETSDRSLEKVEADLRRLNEELDRSLERAERTIRELAK

SEQ ID NO: 14325 - protein, 185 aa, Artificial Sequence
  Synthetic sequence.
SSVEELLERLRRISEENKRRIEKLLREVEKVLRELKDRHRKLLKRVEEIIRKVKEEIKSGLPEEAVKRVLERVRERVKEVLEEADRLNDEMRRIVTEVEKELDKSDKEVEDAVRDILKKIEEGVRRDHMVLHEYVNAAGITDENRDRSKKVKEEIRRILEDLTRTTERVKREIAKLLKELEDTAR

SEQ ID NO: 14326 - protein, 186 aa, Artificial Sequence
  Synthetic sequence.
SAEDSIRELLERDERLLEEARKEAKRLNEENERLLERIEETVRRLLEEIKRLLDDIRKKIKGEKLREIEELVRRVKRTIEKLLEEVKKSVEDSSKRIEELLEAVERSVERTKEEIRRLLDEVRKDRRDHMVLHEYVNAAGITDENRRLVKEVIEEVEKLIRDNEKLAEDIEREIRRLLKELDEAAK

SEQ ID NO: 14327 - protein, 182 aa, Artificial Sequence
  Synthetic sequence.
DEAEKLLKELRDLLEESRKDLERLLKELEDLLEESKRDLERLLEEITELLKRIKETVERRNEREKLEKLLRELKKVVERLKDNLKDNERRNKEAIERVRKKLKDNERENKKVIEDLRAKLKDLEEVRDHMVLHEYVNAAGITEARKRLEEVEEKSKKIIDDARRALDRIDKELRRVVEETRK

SEQ ID NO: 14328 - protein, 184 aa, Artificial Sequence
  Synthetic sequence.
SLEEVIKTVRKLLEEVERRLREVVERAERMLEEVRRRTREVSEEAREMLKDVEKALRDKNVSEEIEEKLRKIKEELERDNEKVNRDNERSVETLRRLLDRVRKEVKDIAKELEERLKEVERKSRDDRDHMVLHEYVNAAGITLRELIEKLREEVEKIVDENRKTVEELRRRNEEIVRRLRREIE

SEQ ID NO: 14329 - protein, 184 aa, Artificial Sequence
  Synthetic sequence.
KLDEVIEEIRKLLRRMEEELRRSVEEIDKLLREVRELLRESSEKVKELLRRVTEELKKRGVPEEVKERLDRLVETLRRLSEETLKELDKLVREVKELSKESLKRLRELVERLRRELEEIKKRGEDERDHMVLHEYVNAAGITLREIVKRNTEIAREVVERAKRIVEKNEKLLKDVVEEAKKIVK

SEQ ID NO: 14330 - protein, 187 aa, Artificial Sequence
  Synthetic sequence.
SEKERLKEELEKLSKEIEDILRDDKRSDDELRRRLRELLEKDRREDERLNEELKRMLEEARKRVSEDELRAIKKEIEDLNRRNEESLRAIEEKIKRLNDENRKSLEEIRRRLKRLVEEVDELRKRDRDHMVLHEYVNAAGITAEKLKRDIEDNNRKLRKVATELAKEIEDNSEKLREDAKRLSEKIK

SEQ ID NO: 14331 - protein, 187 aa, Artificial Sequence
  Synthetic sequence.
DEEEELRKRLEKLSKEVRELLRRDEEEDRRLNRELEELLKDHERTVRDLSREVEDLLRKARRKVSEEELTRLRKKLRDLEEESKEALRELRRRVEELNKENKKSLDDLERRLKELEDRAREVEKRDRDHMVLHEYVNAAGITIRKLAEDLKRNTEDLRRVIKELAERLEELNKRLKREIRRLKEELR

SEQ ID NO: 14332 - protein, 181 aa, Artificial Sequence
  Synthetic sequence.
DEERKLEKSLKDVEDTHRRLLEKNDEDLKELRKRVEDMLRRLEDALRRILEDIEEKLKRIEDDETLKRLRKRVKELLDEIRRRLERLEREVDKRLEEIKERNDRHHEEAKKELKRIRDKIRRDGADRDHMVLHEYVNAAGITDLKRSNDEVKELAERLEETIRDLLRRIEEILKEIEERVR

SEQ ID NO: 14333 - protein, 179 aa, Artificial Sequence
  Synthetic sequence.
SSKEVADELRKKAEKVLDELRKIIRELERKNEDSLRRTEEIVRRLEEEAERVLRDLVRTRGEDDRLVREVERLLRELKRRLEELIRRSEELIKRSREEVDRVIRTVEKLLEELDRLLRANKGDIEDRDHMVLHEYVNAAGITRKLAKSSDDTVREDEKLVEELRKDVKRIVRKIKKDLE

SEQ ID NO: 14334 - protein, 183 aa, Artificial Sequence
  Synthetic sequence.
SEIEKLVEDVRKLVEDNLRHSEEVHRRNRRLIEENERKIDELEKRVRKLVEELRELAERGEIREEEARKVLEEIKRLLDEIRRHSEEVLKEIERTLKENLKHSEEVLRRIEERLEDIKRKDKDSERRDHMVLHEYVNAAGITDESEKLNRESRKRVTRSLEKVDDLVRELEKLARKVLEEVKT

SEQ ID NO: 14335 - protein, 182 aa, Artificial Sequence
  Synthetic sequence.
DEIETVLDEVRRLHEDAKRRLEEMIDEVRKLNEESVRELARVVEEVERLLRTVKEEVERAGLDKGKLEELEERLERVREDVERILREIKRRNEKTLEDSERILEENKERNRTVLKKLKELRDRGSDRDHMVLHEYVNAAGITESVRRVLEKNRRVVEESKRLAEELLRRVKKVVDEIRKRVE

SEQ ID NO: 14336 - protein, 182 aa, Artificial Sequence
  Synthetic sequence.
SDADRVAEELKKLVEDSRRENERVIEESKRLVKENEDRNRELIERLKKLVDKLRDILEKEKDKKTLDDIVREILERLKRLLEKVEDENRKSHEENKRLLEDVKRKNKRISDELKRLLEEIERRNVDRDHMVLHEYVNAAGITRVMEKTEEVAKKSSEDIKRVADETRRRAEELLKEVDELRK

SEQ ID NO: 14337 - protein, 186 aa, Artificial Sequence
  Synthetic sequence.
SEVDEVRKTLEDLLRRLDEENKDIIRRNKELLDDLDRKVREAIERLKRLLDELRKILEKLKDRETLTRIIEEIEKRARELIKRLRDEIRKIEEESKKSIEDSRKRNDEIRKRLEELIKDLRDKIKDRDHMVLHEYVNAAGITEVIERLKEKNKRLEDDSRRVITELRKKLKDLEDRVREEIEELRK

SEQ ID NO: 14338 - protein, 183 aa, Artificial Sequence
  Synthetic sequence.
SEVDEVLERIKRLLERLAEHSDKVVRDIEKLLDDNRKENERLLDKLRRELKRLEEMRRRGDLREELLERVVREVEKEIRDIKRKNKRSVETVEKLVRDDRKELKRALEDVERLIRELETRLKDKEERDHMVLHEYVNAAGITDELLKKTDEVLKRARETIEDLNRKLDKVLKEVRDKLDRLRD

SEQ ID NO: 14339 - protein, 184 aa, Artificial Sequence
  Synthetic sequence.
ELIKKARKDVEEVRERSERLVDELRKRNKKLADESRRLIDKLRKDVEKVLREIEDLLRKRRTKDVLKEIEDLVRELERELRRVVKESSDKVRKLIRENEKVVEESSRLFRDLVEKLRRVVEERNDKRDHMVLHEYVNAAGITNEKSERDVREINKESERVNEETEREVEDAIRKLREVLRRAKK

SEQ ID NO: 14340 - protein, 179 aa, Artificial Sequence
  Synthetic sequence.
DEAEKAKRDSEKVVEDNRKMLEDSTRRAERLNEENKKELKKSTEEAEKILREIDETKRRGTDDEVVKDLIRRVEELLERSRKKLEDLTRDNERVLDESRRRLEKLIRDNERIVKDLTDRVVRVDEVRDHMVLHEYVNAAGITEVLRRNEEIIRRSIEDLERVLDRNRRELEDVIRRLKE

SEQ ID NO: 14341 - protein, 179 aa, Artificial Sequence
  Synthetic sequence.
RLEDEVRKMEKEVREEVKRLEDESRKVLEESRRNLDKLREESKRVLDTVRERIKDLRRRGLDERVLRELLKRVREVHERNRKLLDEVRRASEKVHEDNRRILEEVRKTVKDVVDKLRRVDAKVVKERDHMVLHEYVNAAGITKKSIEEVKEINRRLNEEVKKTIEEVKEIVKEVTERAK

SEQ ID NO: 14342 - protein, 183 aa, Artificial Sequence
  Synthetic sequence.
SIEDEIRKLKEDIKRVLDKVRRDNERLKERLDKVLEDIRRSSEDNNRKLEEVLKRIRDKPVDERLVRKVEEAVKRLKEHNEDSTRRVEEVIRRLKEESEESVRKTEKVARDLERELDEVLTRGGEERDHMVLHEYVNAAGITKREDKEVADRAEKLLREAEEHNKRSLDESRRVLEELDEEIR

SEQ ID NO: 14343 - protein, 183 aa, Artificial Sequence
  Synthetic sequence.
SIREKIRELEERLEEVLRRIEENSERVLREAERVLKEIKDNSKRNNEKLERALEEIRKLPVEDELVRRVKELVERLKRHNKKSSEDVERVVRELKEELKRSSEEVKKAVDRLKEELEKVLRDGGERRDHMVLHEYVNAAGITEEHNRRVVERLKRLLEELKKHNEDSLRKSEEVLRKLEEDAR

SEQ ID NO: 14344 - protein, 183 aa, Artificial Sequence
  Synthetic sequence.
SIEERVRELMRDLERVLKEIREHSKRVIEEAKRVLEEIERNSERNNKELEEVLDEIRKRPVDETLVREVEEAVKKLKEHNKRSSDTVRDAVRKLVERLKESSDRATELVKDLKRKLEEVLRRGGEKRDHMVLHEYVNAAGITRRNNKEVVDRLKEVLERLKEHNRRSLDESRKVLRELKERIR

SEQ ID NO: 14345 - protein, 178 aa, Artificial Sequence
  Synthetic sequence.
DEARELVKELEDLIREITKTVRRLLEESEELIKRIDDAVDDLRRADEDLNREIKEEIEKGKSKESLEALIERLKESLERVKRTIEKLIRDLERLNEKLRRDVESLVAELEKILSKIKRGGLDERILRDHMVLHEYVNAAGITILKRSEDETDKLREKAERILEDLERANRRTMDEARR

SEQ ID NO: 14346 - protein, 178 aa, Artificial Sequence; identical to SEQ ID NO: 14345
  Synthetic sequence.

SEQ ID NO: 14347 - protein, 184 aa, Artificial Sequence
  Synthetic sequence.
DEIRKVVKEITDLLKASNDKNRKVVEEIRDLLRKSKKLADELVERLRALVEDLRRRIDKSGDKETAEDIVRRIIEELKRILKEIEDLARRINREIERLVEEVERDNRDVNRAIEELLKDIARRGGSRDHMVLHEYVNAAGITNEESMRRVKEDADRVSEANKEVLDRVREEVKRLIEEVRETLR

SEQ ID NO: 14348 - protein, 186 aa, Artificial Sequence
  Synthetic sequence.
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGRDHMVLHEYVNAAGITRDIDKLDRESKEAFRATNEEIAKLDEDTARVAERVKKAIEDLAK

SEQ ID NO: 14349 - protein, 181 aa, Artificial Sequence
  Synthetic sequence.
DAVEEAEKLIRKVIADSEKLLRDLADLNAKSIRRSEKLVEDDRRANEDVIRKLEELRRNGGSEEELRALLKEVEDTNRASHETNKRLLDEDRALNKEVHDRNEKLLRDIKRLVEEVAKGIDSEELLRDHMVLHEYVNAAGITSSREIKRLLEESERVMKRSSEDIKRTLDDTRRVVEEVRR

SEQ ID NO: 14350 - protein, 177 aa, Artificial Sequence
  Synthetic sequence.
SSDEVLKEIEEIIRRLEAEVRRVNAEVNASTEDLAREVEEVLRATNELIEELERRVTGTEELKRVIDELRDRDRKVRRRVERVIEESAKRDDESRKRLTRAVEKLRADLKKLADDGVPEEALSKAIRDHMVLHEYVNAAGITWRDRNKELVDRLSEELKEWLKDVERVLKELTDKDR

SEQ ID NO: 14351 - protein, 185 aa, Artificial Sequence
  Synthetic sequence.
SEIDEVLTRLRKISKDLNETSDRVNERARKIIDDIKKESKRVNDEAREIVERLKREIDKTRDRDVLRRILKEIEDVARRVKEINEELLARVEKVVREVEEINRELVKRSREAVEAVKRLLDRGVSDRDHMVLHEYVNAAGITEDRKRLEESTRSVRKLLEELKRELEKSTRSVKALVDELRERVR

SEQ ID NO: 14352 - protein, 181 aa, Artificial Sequence
  Synthetic sequence.
SEIETVRREIEKILDDLRRTVKRIEDEVRKIHEDLRRSLEDSKRNIEEILKDLERAARRDGLDKKVEDDMRKLVEDLKRKHDKLRADNEAVTKELKDRLKKLEDDLARAIEELRRRLDKGLDKEDIRDHMVLHEYVNAAGITDLKELLERYEEIVRRIKELLKDLNREAEEVVRRLKEELR

SEQ ID NO: 14353 - protein, 183 aa, Artificial Sequence
  Synthetic sequence.
SDVDRVLEEIRKLLEDLKRHSEKVSEENEDLLRANTELNKRVSEDNERLLEELKRLRERGGISEEDLKRALDRVRKTVETVKEENKRSLEDVRRTVETNKRKLERVVEEIKKLIEDAKRRGSGDEERDHMVLHEYVNAAGITDRLLETSDRSLEKVEADLRRLNEELDRSLERAERTIRELAK

SEQ ID NO: 14354 - protein, 177 aa, Artificial Sequence
  Synthetic sequence.
SKEDRLREELKKLLARLAEEIERLKRALEESNKDLKRTIDASEKHLRDVNEDVKRGGVSEELLRELERSTAENKERAKELLKRHEDLVRKVEKELADLLRRLEEIVARVDEALKRGISEEELDKLLRDHMVLHEYVNAAGITLLKRVEKLTEDAKRDLERSNREHKELADRIKETAR

SEQ ID NO: 14355 - protein, 185 aa, Artificial Sequence
  Synthetic sequence.
SSVEELLERLRRISEENKRRIEKLLREVEKVLRELKDRHRKLLKRVEEIIRKVKEEIKSGLPEEAVKRVLERVRERVKEVLEEADRLNDEMRRIVTEVEKELDKSDKEVEDAVRDILKKIEEGVRDRDHMVLHEYVNAAGITENRDRSKKVKEEIRRILEDLTRTTERVKREIAKLLKELEDTAR

SEQ ID NO: 14356 - protein, 186 aa, Artificial Sequence
  Synthetic sequence.
SAEDSIRELLERDERLLEEARKEAKRLNEENERLLERIEETVRRLLEEIKRLLDDIRKKIKGEKLREIEELVRRVKRTIEKLLEEVKKSVEDSSKRIEELLEAVERSVERTKEEIRRLLDEVRKDRKRDHMVLHEYVNAAGITENRRLVKEVIEEVEKLIRDNEKLAEDIEREIRRLLKELDEAAK

SEQ ID NO: 14357 - protein, 182 aa, Artificial Sequence
  Synthetic sequence.
DEAEKLLKELRDLLEESRKDLERLLKELEDLLEESKRDLERLLEEITELLKRIKETVERRNEREKLEKLLRELKKVVERLKDNLKDNERRNKEAIERVRKKLKDNERENKKVIEDLRAKLKDLEEVKRDHMVLHEYVNAAGITARKRLEEVEEKSKKIIDDARRALDRIDKELRRVVEETRK

SEQ ID NO: 14358 - protein, 182 aa, Artificial Sequence
  Synthetic sequence.
RVEDALRKLLDDVRRLVEEAERRLRTSNDKSRRLVEEAKRRLEESNERSEKLVRDVRRRIRDEDVKRVLEELLKRDHDVVRRVLERIDEMLERNSRLVKRVLEDIRRLLKRVREVVERIKRVRSKVVRDHMVLHEYVNAAGITIIEDVLRASEDTIRRLEEIIRKVEEDSKRIIEEIERAAR

SEQ ID NO: 14359 - protein, 183 aa, Artificial Sequence
  Synthetic sequence.
KVEKRLTDLLKTVADEVKRVEDELRETVRESKEVVDKSRRDLERTVEESEKTVKDAERRVSEDLVRRIRKVLDENREVNDRVVKEDERILEENERVNRKVVEKIRDILRKIEEVVRRAAEEIRDEEVRDHMVLHEYVNAAGITEEADRVRERSKKILTDLKKSSEDVKRESERMLKKLEDEIR

SEQ ID NO: 14360 - protein, 187 aa, Artificial Sequence
  Synthetic sequence.
SEKERLKEELEKLSKEIEDILRDDKRSDDELRRRLRELLEKDRREDERLNEELKRMLEEARKRVSEDELRAIKKEIEDLNRRNEESLRAIEEKIKRLNDENRKSLEEIRRRLKRLVEEVDELRKRDNRDHMVLHEYVNAAGITEKLKRDIEDNNRKLRKVATELAKEIEDNSEKLREDAKRLSEKIK

SEQ ID NO: 14361 - protein, 187 aa, Artificial Sequence
  Synthetic sequence.
DEEEELRKRLEKLSKEVRELLRRDEEEDRRLNRELEELLKDHERTVRDLSREVEDLLRKARRKVSEEELTRLRKKLRDLEEESKEALRELRRRVEELNKENKKSLDDLERRLKELEDRAREVEKRDRRDHMVLHEYVNAAGITRKLAEDLKRNTEDLRRVIKELAERLEELNKRLKREIRRLKEELR

SEQ ID NO: 14362 - protein, 181 aa, Artificial Sequence
  Synthetic sequence.
DEEETLEDVLRELEERVEKLLRDLTRDLERVEKEHKELLKRNKEAIDEIEKRIEELLKRIEDDEKLRRLKEEVRKLVEESRERNKRHHKEVREVLERIRELLERLEKELRRALEEIRDKIRKDGATDRDHMVLHEYVNAAGITIRDLERKVRKLERDIRENIKKNHREVREILRKIEEDVR

SEQ ID NO: 14363 - protein, 183 aa, Artificial Sequence
  Synthetic sequence.
SEIEKLVEDVRKLVEDNLRHSEEVHRRNRRLIEENERKIDELEKRVRKLVEELRELAERGEIREEEARKVLEEIKRLLDEIRRHSEEVLKEIERTLKENLKHSEEVLRRIEERLEDIKRKDKDSERVRDHMVLHEYVNAAGITESEKLNRESRKRVTRSLEKVDDLVRELEKLARKVLEEVKT

SEQ ID NO: 14364 - protein, 181 aa, Artificial Sequence
  Synthetic sequence.
EEIERALREMRELSRTHKELVEKILRDIAELAKTHERINEDILRKIKKLIDEIADEIRKEDKKEELKRKIDELRRRAEELLKESKEHLKRLEDTVRELIERLKETLKKVEEDLKRILEKLEKSRELDRDHMVLHEYVNAAGITLKRVEDEVRRLIRKLEELNRRTEEEVKKLIKKLEDDLK

SEQ ID NO: 14365 - protein, 183 aa, Artificial Sequence
  Synthetic sequence.
SEVDEVLERIKRLLERLAEHSDKVVRDIEKLLDDNRKENERLLDKLRRELKRLEEMRRRGDLREELLERVVREVEKEIRDIKRKNKRSVETVEKLVRDDRKELKRALEDVERLIRELETRLKDKEELRDHMVLHEYVNAAGITELLKKTDEVLKRARETIEDLNRKLDKVLKEVRDKLDRLRD

SEQ ID NO: 14366 - protein, 185 aa, Artificial Sequence
  Synthetic sequence.
DDIERLKREIERLLKEAEKISRDNEERSKELLDRLRKLSEDNKRKIDKLVEELKRLADKIKDKEELTRRLKEVVDRVEKSVRDSERMLREVVREDEESVRRSKTKLEDLLRKVEELVRRLEKKVTDERDHMVLHEYVNAAGITVDELKRKNDEVHRRSREEVKRLLEENRKLLEDLRRMVREITQ

SEQ ID NO: 14367 - protein, 184 aa, Artificial Sequence
  Synthetic sequence.
ELIKKARKDVEEVRERSERLVDELRKRNKKLADESRRLIDKLRKDVEKVLREIEDLLRKRRTKDVLKEIEDLVRELERELRRVVKESSDKVRKLIRENEKVVEESSRLFRDLVEKLRRVVEERNDKKRDHMVLHEYVNAAGITEKSERDVREINKESERVNEETEREVEDAIRKLREVLRRAKK

SEQ ID NO: 14368 - protein, 186 aa, Artificial Sequence
  Synthetic sequence.
KEVEDLERTVRTILKRMRELITRNEEEIRRSIEELKKLLKENKDTVRRILEEMKELKKEGGDDKKRLVEEIKRLLDELRENSKRSSDRAKEIHERNKRHSEESSRTIEKLLKELRDLVRDVERKLRDRDHMVLHEYVNAAGITVVREADERNKRLTKRSKEVLDEVHRANEEALKEVEEVVRRVTK

SEQ ID NO: 14369 - protein, 178 aa, Artificial Sequence
  Synthetic sequence.
KAAEEIRKKVEDYKRESEKILEEVEDHSRRSKETLKRLLDDLRRAVEELKRRLEELKRRPRTEEIAKRAEEAVRRAAERIKKVIDDVERHIRENAKELKRLLEEDREASRRLEDEIDKEVKAREVADRDHMVLHEYVNAAGITLRELAERNKTALEEAERVLRRLKEEIEKVLRKLKK

SEQ ID NO: 14370 - protein, 185 aa, Artificial Sequence
  Synthetic sequence.
SAEELLRTIEKRIEDNHRRLEEILEEIARLIEDMLRTDERIVREIKELLKEVLDRVRRAGVPEEVLERVRRELERLKKELEELRRRSEEKVKELKRRLEEIRRKLEEEHRDLRRKLEELRRDLGDKERDHMVLHEYVNAAGITSLREAEDLLRRVEEVIRTSKKESKDVLEKIERLLRDLERRTR

SEQ ID NO: 14371 - protein, 182 aa, Artificial Sequence
  Synthetic sequence.
DLERRLDELLKRIEDRVRELVRTLEESLRELERRVREIIRRLEEHLRRIEKMVRDLKRANKPDKAVKDDVRRLRENADRLNKRVREELKKLREDVKRVNEDVKRELDKLAEEAKDMLRKLREAGIDERDHMVLHEYVNAAGITIEEVSERHKREVDRLEREIEEVSREHKERVEKLLREIER

SEQ ID NO: 14372 - protein, 179 aa, Artificial Sequence
  Synthetic sequence.
RLEDEVRKMEKEVREEVKRLEDESRKVLEESRRNLDKLREESKRVLDTVRERIKDLRRRGLDERVLRELLKRVREVHERNRKLLDEVRRASEKVHEDNRRILEEVRKTVKDVVDKLRRVDAKVVKELRDHMVLHEYVNAAGITKSIEEVKEINRRLNEEVKKTIEEVKEIVKEVTERAK

SEQ ID NO: 14373 - protein, 185 aa, Artificial Sequence
  Synthetic sequence.
SEAEELLKRLEDRAEEILRRLEEILRTSRKLAEDVLRELEKLLRESERRIREVLEELRGIKDKKELEDVIREVEKELDESLERSRELLKDVLKKLDDNLKESERLVEDIDRELAKILEDLKKAGVPKRDHMVLHEYVNAAGITLKRIVDENAKIVEDARRALEKIVKENEEILRRLKKELRELRK

SEQ ID NO: 14374 - protein, 184 aa, Artificial Sequence
  Synthetic sequence.
DDLERAREEVADLIRKHEEKTRRILEESRRLNERHRELSARILDEIRKLAERIEELIKRERGKDELRRKVEDLEARVEDLIRRLEEHLRRVHDKDRRLIEDLRRHLKRVVEELKRLIDELRRGVPKERDHMVLHEYVNAAGITREKNREVEKRARDSNRDLKRTNDEIAKEVRELIKKLREDLK

SEQ ID NO: 14375 - protein, 178 aa, Artificial Sequence
  Synthetic sequence.
DEARELVKELEDLIREITKTVRRLLEESEELIKRIDDAVDDLRRADEDLNREIKEEIEKGKSKESLEALIERLKESLERVKRTIEKLIRDLERLNEKLRRDVESLVAELEKILSKIKRGGLDERILRRDHMVLHEYVNAAGITLKRSEDETDKLREKAERILEDLERANRRTMDEARR

SEQ ID NO: 14376 - protein, 182 aa, Artificial Sequence
  Synthetic sequence.
DEVREVAERLRRLVDESRKRNEEVIKESEALVDRVRKTNEEVMKRLRELIDKLEKDIRRSGDKETVEKIIREVLSAIDELLKRVERTNAEISKENARLLDEVRKTNEEISRRLAKLLEDIRRGSGDARDHMVLHEYVNAAGITVLRKTEEAVKRSTETNKRLLEASKEVADRLRERIKEAAK

SEQ ID NO: 14377 - protein, 186 aa, Artificial Sequence
  Synthetic sequence.
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGDRDHMVLHEYVNAAGITDIDKLDRESKEAFRATNEEIAKLDEDTARVAERVKKAIEDLAK

SEQ ID NO: 14378 - protein, 185 aa, Artificial Sequence
  Synthetic sequence.
SEIDEVLTRLRKISKDLNETSDRVNERARKIIDDIKKESKRVNDEAREIVERLKREIDKTRDRDVLRRILKEIEDVARRVKEINEELLARVEKVVREVEEINRELVKRSREAVEAVKRLLDRGVSDERDHMVLHEYVNAAGITDRKRLEESTRSVRKLLEELKRELEKSTRSVKALVDELRERVR

SEQ ID NO: 14379 - protein, 178 aa, Artificial Sequence
  Synthetic sequence.
DAAERAKEKLDKILEDLRDVVRASKENLDRLHAENAETLERSKANLDRLLEKVKKDGVPEELLKELERIIRDLKRKHAKLLEDHRKIIEELKREHDRLLKEAEEIVRRIKDELEKGSDDERDIERILRDHMVLHEYVNAAGITLNREVERVSRDTKKKSKELNEELKAVLDEVKRKAD

SEQ ID NO: 14380 - protein, 183 aa, Artificial Sequence
  Synthetic sequence.
SKLEEVEKAVRKVIEDSRRVNEEVNRRSEEVVRELEKVHREVNDASRRVVEKARRVLKGSGDERLAAEVERIIEEIRELNERDRKRVEEIRKEIEDLNRDLNRRSKESEDRLRKLLEDATRGGVTKERDHMVLHEYVNAAGITRRVEDVARKSKELVEDVRRHSEEVVRRVEELVKEVEERVR

SEQ ID NO: 14381 - protein, 183 aa, Artificial Sequence
  Synthetic sequence.
SDVDRVLEEIRKLLEDLKRHSEKVSEENEDLLRANTELNKRVSEDNERLLEELKRLRERGGISEEDLKRALDRVRKTVETVKEENKRSLEDVRRTVETNKRKLERVVEEIKKLIEDAKRRGSGDEEARDHMVLHEYVNAAGITRLLETSDRSLEKVEADLRRLNEELDRSLERAERTIRELAK

SEQ ID NO: 14382 - protein, 185 aa, Artificial Sequence
  Synthetic sequence.
SSVEELLERLRRISEENKRRIEKLLREVEKVLRELKDRHRKLLKRVEEIIRKVKEEIKSGLPEEAVKRVLERVRERVKEVLEEADRLNDEMRRIVTEVEKELDKSDKEVEDAVRDILKKIEEGVRDRRDHMVLHEYVNAAGITNRDRSKKVKEEIRRILEDLTRTTERVKREIAKLLKELEDTAR

SEQ ID NO: 14383 - protein, 186 aa, Artificial Sequence
  Synthetic sequence.
SAEDSIRELLERDERLLEEARKEAKRLNEENERLLERIEETVRRLLEEIKRLLDDIRKKIKGEKLREIEELVRRVKRTIEKLLEEVKKSVEDSSKRIEELLEAVERSVERTKEEIRRLLDEVRKDRKERDHMVLHEYVNAAGITNRRLVKEVIEEVEKLIRDNEKLAEDIEREIRRLLKELDEAAK

SEQ ID NO: 14384 - protein, 182 aa, Artificial Sequence
  Synthetic sequence.
RVEDALRKLLDDVRRLVEEAERRLRTSNDKSRRLVEEAKRRLEESNERSEKLVRDVRRRIRDEDVKRVLEELLKRDHDVVRRVLERIDEMLERNSRLVKRVLEDIRRLLKRVREVVERIKRVRSKVVERDHMVLHEYVNAAGITIEDVLRASEDTIRRLEEIIRKVEEDSKRIIEEIERAAR

SEQ ID NO: 14385 - protein, 184 aa, Artificial Sequence
  Synthetic sequence.
SLEEVIKTVRKLLEEVERRLREVVERAERMLEEVRRRTREVSEEAREMLKDVEKALRDKNVSEEIEEKLRKIKEELERDNEKVNRDNERSVETLRRLLDRVRKEVKDIAKELEERLKEVERKSRDDRIRDHMVLHEYVNAAGITELIEKLREEVEKIVDENRKTVEELRRRNEEIVRRLRREIE

SEQ ID NO: 14386 - protein, 179 aa, Artificial Sequence
  Synthetic sequence.
SSKEVADELRKKAEKVLDELRKIIRELERKNEDSLRRTEEIVRRLEEEAERVLRDLVRTRGEDDRLVREVERLLRELKRRLEELIRRSEELIKRSREEVDRVIRTVEKLLEELDRLLRANKGDIEDLRRDHMVLHEYVNAAGITLAKSSDDTVREDEKLVEELRKDVKRIVRKIKKDLE

SEQ ID NO: 14387 - protein, 183 aa, Artificial Sequence
  Synthetic sequence.
SEIEKLVEDVRKLVEDNLRHSEEVHRRNRRLIEENERKIDELEKRVRKLVEELRELAERGEIREEEARKVLEEIKRLLDEIRRHSEEVLKEIERTLKENLKHSEEVLRRIEERLEDIKRKDKDSERVRRDHMVLHEYVNAAGITSEKLNRESRKRVTRSLEKVDDLVRELEKLARKVLEEVKT

SEQ ID NO: 14388 - protein, 181 aa, Artificial Sequence
  Synthetic sequence.
EEIERALREMRELSRTHKELVEKILRDIAELAKTHERINEDILRKIKKLIDEIADEIRKEDKKEELKRKIDELRRRAEELLKESKEHLKRLEDTVRELIERLKETLKKVEEDLKRILEKLEKSRELDERDHMVLHEYVNAAGITKRVEDEVRRLIRKLEELNRRTEEEVKKLIKKLEDDLK

SEQ ID NO: 14389 - protein, 186 aa, Artificial Sequence
  Synthetic sequence.
SEVDEVRKTLEDLLRRLDEENKDIIRRNKELLDDLDRKVREAIERLKRLLDELRKILEKLKDRETLTRIIEEIEKRARELIKRLRDEIRKIEEESKKSIEDSRKRNDEIRKRLEELIKDLRDKIKDSERDHMVLHEYVNAAGITIERLKEKNKRLEDDSRRVITELRKKLKDLEDRVREEIEELRK

SEQ ID NO: 14390 - protein, 183 aa, Artificial Sequence
  Synthetic sequence.
SEVDEVLERIKRLLERLAEHSDKVVRDIEKLLDDNRKENERLLDKLRRELKRLEEMRRRGDLREELLERVVREVEKEIRDIKRKNKRSVETVEKLVRDDRKELKRALEDVERLIRELETRLKDKEELRRDHMVLHEYVNAAGITLLKKTDEVLKRARETIEDLNRKLDKVLKEVRDKLDRLRD

SEQ ID NO: 14391 - protein, 185 aa, Artificial Sequence
  Synthetic sequence.
DDIERLKREIERLLKEAEKISRDNEERSKELLDRLRKLSEDNKRKIDKLVEELKRLADKIKDKEELTRRLKEVVDRVEKSVRDSERMLREVVREDEESVRRSKTKLEDLLRKVEELVRRLEKKVTDEKRDHMVLHEYVNAAGITDELKRKNDEVHRRSREEVKRLLEENRKLLEDLRRMVREITQ

SEQ ID NO: 14392 - protein, 186 aa, Artificial Sequence
  Synthetic sequence.
KEVEDLERRVKEILDRMKRLIDENRKKIEKSIRELERLIDENRKEVERVKKELKDLKREGGDDARTLRERVRKIIEDVEEHSRRSTEEVRRIHKENKEHSERSSDEIRELLRRVEELIEEVKRRLRDKRDHMVLHEYVNAAGITVRRAHETNERLVDRSRKAVEKAERTNRRLVEEIRKVAEEVRK

SEQ ID NO: 14393 - protein, 186 aa, Artificial Sequence
  Synthetic sequence.
DEIRELEERVRRILDELRRLVERNREVIERSIRELEKLLDRNRRKVEEILRRIDDLTRRGGDDKKTMLDDVRRLLREAEDHSRRSSETAKRIHRENEEHSKDSSRKVRKLIEELRELAKKVEKEITDERDHMVLHEYVNAAGITMREVDRANRELTKTSKKVLEDVDRTNRRLVKEVRDVVERARK

SEQ ID NO: 14394 - protein, 186 aa, Artificial Sequence
  Synthetic sequence.
KEVEDLERTVRTILKRMRELITRNEEEIRRSIEELKKLLKENKDTVRRILEEMKELKKEGGDDKKRLVEEIKRLLDELRENSKRSSDRAKEIHERNKRHSEESSRTIEKLLKELRDLVRDVERKLRDERDHMVLHEYVNAAGITVREADERNKRLTKRSKEVLDEVHRANEEALKEVEEVVRRVTK

SEQ ID NO: 14395 - protein, 179 aa, Artificial Sequence
  Synthetic sequence.
REAEEVERKVEELNRRNRKVLDDARKESEEVVRRNREFLRRLEERVRTILRELDKRKRDGTSEEVIKRLIDRVRKILEDIRRLVDELIKRNERIVEKLTRIVEELIRRNKKLLEDIRRELVKVDEVLRRDHMVLHEYVNAAGITLRELERIHRELIKELKEVLKRLEKDAKEVIERLRT

SEQ ID NO: 14396 - protein, 186 aa, Artificial Sequence
  Synthetic sequence.
SEIEKLIEELRRELEKVKDELERSIEEMDRELDDVRRDSKRLVDEIKRELREVTERTKRGDRPEEVLRKELEDIKRKLRRILEEHHEKIRRIKEKLRRENKRVRDELKRIKDEIDEKVKDVRRKGADERDHMVLHEYVNAAGITLEELLKKHTRVVERVEKALDELDKELERIVREAEKELDRREK

SEQ ID NO: 14397 - protein, 179 aa, Artificial Sequence
  Synthetic sequence.
RLEDEVRKMEKEVREEVKRLEDESRKVLEESRRNLDKLREESKRVLDTVRERIKDLRRRGLDERVLRELLKRVREVHERNRKLLDEVRRASEKVHEDNRRILEEVRKTVKDVVDKLRRVDAKVVKELIRDHMVLHEYVNAAGITSIEEVKEINRRLNEEVKKTIEEVKEIVKEVTERAK

SEQ ID NO: 14398 - protein, 183 aa, Artificial Sequence
  Synthetic sequence.
SIEDEIRKLKEDIKRVLDKVRRDNERLKERLDKVLEDIRRSSEDNNRKLEEVLKRIRDKPVDERLVRKVEEAVKRLKEHNEDSTRRVEEVIRRLKEESEESVRKTEKVARDLERELDEVLTRGGEERVRDHMVLHEYVNAAGITEDKEVADRAEKLLREAEEHNKRSLDESRRVLEELDEEIR

SEQ ID NO: 14399 - protein, 183 aa, Artificial Sequence
  Synthetic sequence.
SIREKIRELEERLEEVLRRIEENSERVLREAERVLKEIKDNSKRNNEKLERALEEIRKLPVEDELVRRVKELVERLKRHNKKSSEDVERVVRELKEELKRSSEEVKKAVDRLKEELEKVLRDGGEREVRDHMVLHEYVNAAGITHNRRVVERLKRLLEELKKHNEDSLRKSEEVLRKLEEDAR

SEQ ID NO: 14400 - protein, 182 aa, Artificial Sequence
  Synthetic sequence.
SIEDLVRELKKKVDEVAEDLRRKVREALERSRENIDRLKKHSEENLRRSEEVVDKLRKETREEEVKDILRRVLELSKRIVEESKEILDRVLELSKKVVDDIEEIIRRVEETVKEVLTRLSRVDDKVVKRDHMVLHEYVNAAGITVEKLIRELEDINRKVNERNRRLAEESRKILDEVEKRVR

SEQ ID NO: 14401 - protein, 185 aa, Artificial Sequence
  Synthetic sequence.
SEAEELLKRLEDRAEEILRRLEEILRTSRKLAEDVLRELEKLLRESERRIREVLEELRGIKDKKELEDVIREVEKELDESLERSRELLKDVLKKLDDNLKESERLVEDIDRELAKILEDLKKAGVPKERDHMVLHEYVNAAGITKRIVDENAKIVEDARRALEKIVKENEEILRRLKKELRELRK

SEQ ID NO: 14402 - protein, 179 aa, Artificial Sequence
  Synthetic sequence.
SEVEELIKRLAKVLKELVDKVRKVIEDTKELLERLKRRSEDHIRKLREVLKEAKDQPIDDEELKEILDRLRKTLEELEEELKKALEDDREEAKRLVDDARRVLKELEEEVREIRERRGESEELDRRIERDHMVLHEYVNAAGITWERVHREVEELLKRLIDENRKVLDEIRKLLEEKSK

SEQ ID NO: 14403 - protein, 184 aa, Artificial Sequence
  Synthetic sequence.
DEIRKVVKEITDLLKASNDKNRKVVEEIRDLLRKSKKLADELVERLRALVEDLRRRIDKSGDKETAEDIVRRIIEELKRILKEIEDLARRINREIERLVEEVERDNRDVNRAIEELLKDIARRGGSEDRDHMVLHEYVNAAGITESMRRVKEDADRVSEANKEVLDRVREEVKRLIEEVRETLR

SEQ ID NO: 14404 - protein, 182 aa, Artificial Sequence
  Synthetic sequence.
DEVREVAERLRRLVDESRKRNEEVIKESEALVDRVRKTNEEVMKRLRELIDKLEKDIRRSGDKETVEKIIREVLSAIDELLKRVERTNAEISKENARLLDEVRKTNEEISRRLAKLLEDIRRGSGDAERDHMVLHEYVNAAGITLRKTEEAVKRSTETNKRLLEASKEVADRLRERIKEAAK

SEQ ID NO: 14405 - protein, 186 aa, Artificial Sequence
  Synthetic sequence.
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGDERDHMVLHEYVNAAGITIDKLDRESKEAFRATNEEIAKLDEDTARVAERVKKAIEDLAK

SEQ ID NO: 14406 - protein, 181 aa, Artificial Sequence
  Synthetic sequence.
DAVEEAEKLIRKVIADSEKLLRDLADLNAKSIRRSEKLVEDDRRANEDVIRKLEELRRNGGSEEELRALLKEVEDTNRASHETNKRLLDEDRALNKEVHDRNEKLLRDIKRLVEEVAKGIDSEELLRRRDHMVLHEYVNAAGITREIKRLLEESERVMKRSSEDIKRTLDDTRRVVEEVRR

SEQ ID NO: 14407 - protein, 185 aa, Artificial Sequence
  Synthetic sequence.
SEIDEVLTRLRKISKDLNETSDRVNERARKIIDDIKKESKRVNDEAREIVERLKREIDKTRDRDVLRRILKEIEDVARRVKEINEELLARVEKVVREVEEINRELVKRSREAVEAVKRLLDRGVSDEDRDHMVLHEYVNAAGITRKRLEESTRSVRKLLEELKRELEKSTRSVKALVDELRERVR

SEQ ID NO: 14408 - protein, 183 aa, Artificial Sequence
  Synthetic sequence.
SDVDRVLEEIRKLLEDLKRHSEKVSEENEDLLRANTELNKRVSEDNERLLEELKRLRERGGISEEDLKRALDRVRKTVETVKEENKRSLEDVRRTVETNKRKLERVVEEIKKLIEDAKRRGSGDEEAKRDHMVLHEYVNAAGITLLETSDRSLEKVEADLRRLNEELDRSLERAERTIRELAK

SEQ ID NO: 14409 - protein, 185 aa, Artificial Sequence
  Synthetic sequence.
SSVEELLERLRRISEENKRRIEKLLREVEKVLRELKDRHRKLLKRVEEIIRKVKEEIKSGLPEEAVKRVLERVRERVKEVLEEADRLNDEMRRIVTEVEKELDKSDKEVEDAVRDILKKIEEGVRDRERDHMVLHEYVNAAGITRDRSKKVKEEIRRILEDLTRTTERVKREIAKLLKELEDTAR

SEQ ID NO: 14410 - protein, 186 aa, Artificial Sequence
  Synthetic sequence.
SAEDSIRELLERDERLLEEARKEAKRLNEENERLLERIEETVRRLLEEIKRLLDDIRKKIKGEKLREIEELVRRVKRTIEKLLEEVKKSVEDSSKRIEELLEAVERSVERTKEEIRRLLDEVRKDRKEERDHMVLHEYVNAAGITRRLVKEVIEEVEKLIRDNEKLAEDIEREIRRLLKELDEAAK

SEQ ID NO: 14411 - protein, 182 aa, Artificial Sequence
  Synthetic sequence.
DEAEKLLKELRDLLEESRKDLERLLKELEDLLEESKRDLERLLEEITELLKRIKETVERRNEREKLEKLLRELKKVVERLKDNLKDNERRNKEAIERVRKKLKDNERENKKVIEDLRAKLKDLEEVKRKRDHMVLHEYVNAAGITKRLEEVEEKSKKIIDDARRALDRIDKELRRVVEETRK

SEQ ID NO: 14412 - protein, 182 aa, Artificial Sequence
  Synthetic sequence.
RVEDALRKLLDDVRRLVEEAERRLRTSNDKSRRLVEEAKRRLEESNERSEKLVRDVRRRIRDEDVKRVLEELLKRDHDVVRRVLERIDEMLERNSRLVKRVLEDIRRLLKRVREVVERIKRVRSKVVEERDHMVLHEYVNAAGITEDVLRASEDTIRRLEEIIRKVEEDSKRIIEEIERAAR

SEQ ID NO: 14413 - protein, 183 aa, Artificial Sequence
  Synthetic sequence.
KVEKRLTDLLKTVADEVKRVEDELRETVRESKEVVDKSRRDLERTVEESEKTVKDAERRVSEDLVRRIRKVLDENREVNDRVVKEDERILEENERVNRKVVEKIRDILRKIEEVVRRAAEEIRDEEVVKRDHMVLHEYVNAAGITADRVRERSKKILTDLKKSSEDVKRESERMLKKLEDEIR

SEQ ID NO: 14414 - protein, 181 aa, Artificial Sequence
  Synthetic sequence.
SEVERVLEDLRRLVRDVEEKLRRIIERDRRLVEEVERENRKTIRKIEELLRKVLEELKDISDKKTIERIVREIIKEARDLVRRNHERNREIVDESRRLVEELRRIVEEIIRRLRELLERVKSGELAERIRDHMVLHEYVNAAGITELEKTSRDLKKRLEELDRELKALVEKVERDLEELRK

SEQ ID NO: 14415 - protein, 180 aa, Artificial Sequence
  Synthetic sequence.
STEEVLDEIRKLHKTLTEDIKRVLREIEELHRRTIEENKEVLDKIREDYKRVIDDVRTKDTPNVEKLLKDLEKSAKENEEHNERTLREDDRVLKEIRRRATELLKANEEMLRRIEEVMRAGKVDAEELLRDHMVLHEYVNAAGITLRKESKRVVDETRKLSEENLEHSERVLRKVEEDLR

SEQ ID NO: 14416 - protein, 183 aa, Artificial Sequence
  Synthetic sequence.
SEIEKLVEDVRKLVEDNLRHSEEVHRRNRRLIEENERKIDELEKRVRKLVEELRELAERGEIREEEARKVLEEIKRLLDEIRRHSEEVLKEIERTLKENLKHSEEVLRRIEERLEDIKRKDKDSERVRTRDHMVLHEYVNAAGITEKLNRESRKRVTRSLEKVDDLVRELEKLARKVLEEVKT

SEQ ID NO: 14417 - protein, 182 aa, Artificial Sequence
  Synthetic sequence.
DELEEVVRRVRELSRTVKEELREVIERVRELSERVKKKLRKVLREVAELHREVMKRVRDSGLDKSKLEKLEDESRRVLDKSREILRKNEEDNRRLNKELEEILKKNEDDNEDVRRKVDEVTRKGKDAEERDHMVLHEYVNAAGITKDALKRVEDRVRESDKSVRELLEENRKVVEDIKRRVD

SEQ ID NO: 14418 - protein, 182 aa, Artificial Sequence
  Synthetic sequence.
SDADRVAEELKKLVEDSRRENERVIEESKRLVKENEDRNRELIERLKKLVDKLRDILEKEKDKKTLDDIVREILERLKRLLEKVEDENRKSHEENKRLLEDVKRKNKRISDELKRLLEEIERRNVDVDKRDHMVLHEYVNAAGITEKTEEVAKKSSEDIKRVADETRRRAEELLKEVDELRK

SEQ ID NO: 14419 - protein, 184 aa, Artificial Sequence
  Synthetic sequence.
ELIKKARKDVEEVRERSERLVDELRKRNKKLADESRRLIDKLRKDVEKVLREIEDLLRKRRTKDVLKEIEDLVRELERELRRVVKESSDKVRKLIRENEKVVEESSRLFRDLVEKLRRVVEERNDKKLMRDHMVLHEYVNAAGITSERDVREINKESERVNEETEREVEDAIRKLREVLRRAKK

SEQ ID NO: 14420 - protein, 186 aa, Artificial Sequence
  Synthetic sequence.
KEVEDLERRVKEILDRMKRLIDENRKKIEKSIRELERLIDENRKEVERVKKELKDLKREGGDDARTLRERVRKIIEDVEEHSRRSTEEVRRIHKENKEHSERSSDEIRELLRRVEELIEEVKRRLRDKERDHMVLHEYVNAAGITRRAHETNERLVDRSRKAVEKAERTNRRLVEEIRKVAEEVRK

SEQ ID NO: 14421 - protein, 186 aa, Artificial Sequence
  Synthetic sequence.
DEIRELEERVRRILDELRRLVERNREVIERSIRELEKLLDRNRRKVEEILRRIDDLTRRGGDDKKTMLDDVRRLLREAEDHSRRSSETAKRIHRENEEHSKDSSRKVRKLIEELRELAKKVEKEITDERRDHMVLHEYVNAAGITREVDRANRELTKTSKKVLEDVDRTNRRLVKEVRDVVERARK

SEQ ID NO: 14422 - protein, 186 aa, Artificial Sequence
  Synthetic sequence.
KEVEDLERTVRTILKRMRELITRNEEEIRRSIEELKKLLKENKDTVRRILEEMKELKKEGGDDKKRLVEEIKRLLDELRENSKRSSDRAKEIHERNKRHSEESSRTIEKLLKELRDLVRDVERKLRDEDRDHMVLHEYVNAAGITREADERNKRLTKRSKEVLDEVHRANEEALKEVEEVVRRVTK

SEQ ID NO: 14423 - protein, 182 aa, Artificial Sequence
  Synthetic sequence.
DLERRLDELLKRIEDRVRELVRTLEESLRELERRVREIIRRLEEHLRRIEKMVRDLKRANKPDKAVKDDVRRLRENADRLNKRVREELKKLREDVKRVNEDVKRELDKLAEEAKDMLRKLREAGIDERVRDHMVLHEYVNAAGITEVSERHKREVDRLEREIEEVSREHKERVEKLLREIER

SEQ ID NO: 14424 - protein, 182 aa, Artificial Sequence
  Synthetic sequence.
SELEKTLEDLKRHSEENKKKLEEDLRDMERNLKENKDRLKKILEEAEKTLKDLERRFREGDIDERELERVRRKMEEIKKRLDENVERNRRKAEDIKRKLDENVKRSEDRVKEIKEDIRRRVRDKDKAEERDHMVLHEYVNAAGITERVKKALDDIVKELEELHERLKRRLEEILRRIAETVR

SEQ ID NO: 14425 - protein, 186 aa, Artificial Sequence
  Synthetic sequence.
SEIEKLIEELRRELEKVKDELERSIEEMDRELDDVRRDSKRLVDEIKRELREVTERTKRGDRPEEVLRKELEDIKRKLRRILEEHHEKIRRIKEKLRRENKRVRDELKRIKDEIDEKVKDVRRKGADEERDHMVLHEYVNAAGITEELLKKHTRVVERVEKALDELDKELERIVREAEKELDRREK

SEQ ID NO: 14426 - protein, 183 aa, Artificial Sequence
  Synthetic sequence.
SIEDEIRKLKEDIKRVLDKVRRDNERLKERLDKVLEDIRRSSEDNNRKLEEVLKRIRDKPVDERLVRKVEEAVKRLKEHNEDSTRRVEEVIRRLKEESEESVRKTEKVARDLERELDEVLTRGGEERVRRDHMVLHEYVNAAGITDKEVADRAEKLLREAEEHNKRSLDESRRVLEELDEEIR

SEQ ID NO: 14427 - protein, 183 aa, Artificial Sequence
  Synthetic sequence.
SIREKIRELEERLEEVLRRIEENSERVLREAERVLKEIKDNSKRNNEKLERALEEIRKLPVEDELVRRVKELVERLKRHNKKSSEDVERVVRELKEELKRSSEEVKKAVDRLKEELEKVLRDGGEREVDRDHMVLHEYVNAAGITNRRVVERLKRLLEELKKHNEDSLRKSEEVLRKLEEDAR

SEQ ID NO: 14428 - protein, 185 aa, Artificial Sequence
  Synthetic sequence.
SEAEELLKRLEDRAEEILRRLEEILRTSRKLAEDVLRELEKLLRESERRIREVLEELRGIKDKKELEDVIREVEKELDESLERSRELLKDVLKKLDDNLKESERLVEDIDRELAKILEDLKKAGVPKEVRDHMVLHEYVNAAGITRIVDENAKIVEDARRALEKIVKENEEILRRLKKELRELRK

SEQ ID NO: 14429 - protein, 186 aa, Artificial Sequence
  Synthetic sequence.
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGDEDRDHMVLHEYVNAAGITDKLDRESKEAFRATNEEIAKLDEDTARVAERVKKAIEDLAK

SEQ ID NO: 14430 - protein, 186 aa, Artificial Sequence
  Synthetic sequence.
SEVDEIIKELERLLAEIARENERIIRESRKLADEVRKRNEDAIRKLEELVARLADAVRRKGSESEEVKKLIEDVLREIERLLKRIEEENREVVKRNSELVERVRAINEEILRRVAELVEKIARDIGDKDRDHMVLHEYVNAAGITKKLDDETRRVIEDTNKKIADLDKATRDVVRKVLEEVKKLEK

SEQ ID NO: 14431 - protein, 181 aa, Artificial Sequence
  Synthetic sequence.
SEIETVRREIEKILDDLRRTVKRIEDEVRKIHEDLRRSLEDSKRNIEEILKDLERAARRDGLDKKVEDDMRKLVEDLKRKHDKLRADNEAVTKELKDRLKKLEDDLARAIEELRRRLDKGLDKEDIDKLRDHMVLHEYVNAAGITELLERYEEIVRRIKELLKDLNREAEEVVRRLKEELR

SEQ ID NO: 14432 - protein, 185 aa, Artificial Sequence
  Synthetic sequence.
SSVEELLERLRRISEENKRRIEKLLREVEKVLRELKDRHRKLLKRVEEIIRKVKEEIKSGLPEEAVKRVLERVRERVKEVLEEADRLNDEMRRIVTEVEKELDKSDKEVEDAVRDILKKIEEGVRDRETRDHMVLHEYVNAAGITDRSKKVKEEIRRILEDLTRTTERVKREIAKLLKELEDTAR

SEQ ID NO: 14433 - protein, 181 aa, Artificial Sequence
  Synthetic sequence.
SEVERVLEDLRRLVRDVEEKLRRIIERDRRLVEEVERENRKTIRKIEELLRKVLEELKDISDKKTIERIVREIIKEARDLVRRNHERNREIVDESRRLVEELRRIVEEIIRRLRELLERVKSGELAERIERDHMVLHEYVNAAGITLEKTSRDLKKRLEELDRELKALVEKVERDLEELRK

SEQ ID NO: 14434 - protein, 187 aa, Artificial Sequence
  Synthetic sequence.
DEEEELRKRLEKLSKEVRELLRRDEEEDRRLNRELEELLKDHERTVRDLSREVEDLLRKARRKVSEEELTRLRKKLRDLEEESKEALRELRRRVEELNKENKKSLDDLERRLKELEDRAREVEKRDRREDRDHMVLHEYVNAAGITAEDLKRNTEDLRRVIKELAERLEELNKRLKREIRRLKEELR

SEQ ID NO: 14435 - protein, 181 aa, Artificial Sequence
  Synthetic sequence.
DEERKLEKSLKDVEDTHRRLLEKNDEDLKELRKRVEDMLRRLEDALRRILEDIEEKLKRIEDDETLKRLRKRVKELLDEIRRRLERLEREVDKRLEEIKERNDRHHEEAKKELKRIRDKIRRDGADEKILRDHMVLHEYVNAAGITSNDEVKELAERLEETIRDLLRRIEEILKEIEERVR

SEQ ID NO: 14436 - protein, 181 aa, Artificial Sequence
  Synthetic sequence.
EEIERALREMRELSRTHKELVEKILRDIAELAKTHERINEDILRKIKKLIDEIADEIRKEDKKEELKRKIDELRRRAEELLKESKEHLKRLEDTVRELIERLKETLKKVEEDLKRILEKLEKSRELDEIARDHMVLHEYVNAAGITVEDEVRRLIRKLEELNRRTEEEVKKLIKKLEDDLK

SEQ ID NO: 14437 - protein, 182 aa, Artificial Sequence
  Synthetic sequence.
DELEEVVRRVRELSRTVKEELREVIERVRELSERVKKKLRKVLREVAELHREVMKRVRDSGLDKSKLEKLEDESRRVLDKSREILRKNEEDNRRLNKELEEILKKNEDDNEDVRRKVDEVTRKGKDAEEVRDHMVLHEYVNAAGITDALKRVEDRVRESDKSVRELLEENRKVVEDIKRRVD

SEQ ID NO: 14438 - protein, 182 aa, Artificial Sequence
  Synthetic sequence.
SDADRVAEELKKLVEDSRRENERVIEESKRLVKENEDRNRELIERLKKLVDKLRDILEKEKDKKTLDDIVREILERLKRLLEKVEDENRKSHEENKRLLEDVKRKNKRISDELKRLLEEIERRNVDVDKVRDHMVLHEYVNAAGITKTEEVAKKSSEDIKRVADETRRRAEELLKEVDELRK

SEQ ID NO: 14439 - protein, 183 aa, Artificial Sequence
  Synthetic sequence.
SEVDEVLERIKRLLERLAEHSDKVVRDIEKLLDDNRKENERLLDKLRRELKRLEEMRRRGDLREELLERVVREVEKEIRDIKRKNKRSVETVEKLVRDDRKELKRALEDVERLIRELETRLKDKEELRRKRDHMVLHEYVNAAGITKKTDEVLKRARETIEDLNRKLDKVLKEVRDKLDRLRD

SEQ ID NO: 14440 - protein, 184 aa, Artificial Sequence
  Synthetic sequence.
ELIKKARKDVEEVRERSERLVDELRKRNKKLADESRRLIDKLRKDVEKVLREIEDLLRKRRTKDVLKEIEDLVRELERELRRVVKESSDKVRKLIRENEKVVEESSRLFRDLVEKLRRVVEERNDKKLMERDHMVLHEYVNAAGITERDVREINKESERVNEETEREVEDAIRKLREVLRRAKK

SEQ ID NO: 14441 - protein, 186 aa, Artificial Sequence
  Synthetic sequence.
KEVEDLERTVRTILKRMRELITRNEEEIRRSIEELKKLLKENKDTVRRILEEMKELKKEGGDDKKRLVEEIKRLLDELRENSKRSSDRAKEIHERNKRHSEESSRTIEKLLKELRDLVRDVERKLRDEDARDHMVLHEYVNAAGITEADERNKRLTKRSKEVLDEVHRANEEALKEVEEVVRRVTK

SEQ ID NO: 14442 - protein, 182 aa, Artificial Sequence
  Synthetic sequence.
SELEKTLEDLKRHSEENKKKLEEDLRDMERNLKENKDRLKKILEEAEKTLKDLERRFREGDIDERELERVRRKMEEIKKRLDENVERNRRKAEDIKRKLDENVKRSEDRVKEIKEDIRRRVRDKDKAEELRDHMVLHEYVNAAGITRVKKALDDIVKELEELHERLKRRLEEILRRIAETVR

SEQ ID NO: 14443 - protein, 183 aa, Artificial Sequence
  Synthetic sequence.
RVDERLDTVLKRVEETVRENKKKNDELLERSKENIDRLKKRLDDLLDKVRREAEKLKREVTKEEVKKIIDEVLKEIEDLLRTVKEELDRALERNREVVEETKRRIDRVLKEIEKLIRDVKRDRKEEVVKERDHMVLHEYVNAAGITKDAERRLRETNERLNEIVKEVEKRIRELSEEVRKRVK

SEQ ID NO: 14444 - protein, 183 aa, Artificial Sequence
  Synthetic sequence.
SVDERLDEVLERVKEDMDRNRRKNDESLREDEENVRRNKKETDESVKRVEERVRELKKRVKDERVKEFLDRVLEEIRKSAEEVKTIIDEVHKESEETVRRTKKIIEEVLRRIEELIRRVKKDRKEEVVKTRDHMVLHEYVNAAGITDEAHKRNKELNERVNRVNKEAHKRNEDLLREAERKVR

SEQ ID NO: 14445 - protein, 183 aa, Artificial Sequence
  Synthetic sequence.
SIEERVRELMRDLERVLKEIREHSKRVIEEAKRVLEEIERNSERNNKELEEVLDEIRKRPVDETLVREVEEAVKKLKEHNKRSSDTVRDAVRKLVERLKESSDRATELVKDLKRKLEEVLRRGGEKELEERDHMVLHEYVNAAGITKEVVDRLKEVLERLKEHNRRSLDESRKVLRELKERIR

SEQ ID NO: 14446 - protein, 185 aa, Artificial Sequence
  Synthetic sequence.
SEAEELLKRLEDRAEEILRRLEEILRTSRKLAEDVLRELEKLLRESERRIREVLEELRGIKDKKELEDVIREVEKELDESLERSRELLKDVLKKLDDNLKESERLVEDIDRELAKILEDLKKAGVPKEVVRDHMVLHEYVNAAGITIVDENAKIVEDARRALEKIVKENEEILRRLKKELRELRK

SEQ ID NO: 14447 - protein, 188 aa, Artificial Sequence
  Synthetic sequence.
SEIEKILKEIEDLARRDEEVSKKIVEDIRRLAKEVEDTSRDIVRKIEELAKRVLDRLRKDGSKEELEKEVREVVKTLEELVKDNHRLIRRAVEEMKRLVEENHRHSREVVKELEDLVRELRKGSGSEDSERDHMVLHEYVNAAGITSEKSNEEVKRTVEELVRRMEESNDRVRDLVRRLVEELKRAVD

SEQ ID NO: 14448 - protein, 186 aa, Artificial Sequence
  Synthetic sequence.
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGDEDKRDHMVLHEYVNAAGITKLDRESKEAFRATNEEIAKLDEDTARVAERVKKAIEDLAK

SEQ ID NO: 14449 - protein, 183 aa, Artificial Sequence
  Synthetic sequence.
SDVDRVLEEIRKLLEDLKRHSEKVSEENEDLLRANTELNKRVSEDNERLLEELKRLRERGGISEEDLKRALDRVRKTVETVKEENKRSLEDVRRTVETNKRKLERVVEEIKKLIEDAKRRGSGDEEAKKKRDHMVLHEYVNAAGITETSDRSLEKVEADLRRLNEELDRSLERAERTIRELAK

SEQ ID NO: 14450 - protein, 182 aa, Artificial Sequence
  Synthetic sequence.
RVEDALRKLLDDVRRLVEEAERRLRTSNDKSRRLVEEAKRRLEESNERSEKLVRDVRRRIRDEDVKRVLEELLKRDHDVVRRVLERIDEMLERNSRLVKRVLEDIRRLLKRVREVVERIKRVRSKVVEEVLRDHMVLHEYVNAAGITVLRASEDTIRRLEEIIRKVEEDSKRIIEEIERAAR

SEQ ID NO: 14451 - protein, 183 aa, Artificial Sequence
  Synthetic sequence.
KVEKRLTDLLKTVADEVKRVEDELRETVRESKEVVDKSRRDLERTVEESEKTVKDAERRVSEDLVRRIRKVLDENREVNDRVVKEDERILEENERVNRKVVEKIRDILRKIEEVVRRAAEEIRDEEVVKKVRDHMVLHEYVNAAGITRVRERSKKILTDLKKSSEDVKRESERMLKKLEDEIR

SEQ ID NO: 14452 - protein, 182 aa, Artificial Sequence
  Synthetic sequence.
SDADRVAEELKKLVEDSRRENERVIEESKRLVKENEDRNRELIERLKKLVDKLRDILEKEKDKKTLDDIVREILERLKRLLEKVEDENRKSHEENKRLLEDVKRKNKRISDELKRLLEEIERRNVDVDKVRRDHMVLHEYVNAAGITTEEVAKKSSEDIKRVADETRRRAEELLKEVDELRK

SEQ ID NO: 14453 - protein, 186 aa, Artificial Sequence
  Synthetic sequence.
SEVDEVRKTLEDLLRRLDEENKDIIRRNKELLDDLDRKVREAIERLKRLLDELRKILEKLKDRETLTRIIEEIEKRARELIKRLRDEIRKIEEESKKSIEDSRKRNDEIRKRLEELIKDLRDKIKDSEELARDHMVLHEYVNAAGITLKEKNKRLEDDSRRVITELRKKLKDLEDRVREEIEELRK

SEQ ID NO: 14454 - protein, 185 aa, Artificial Sequence
  Synthetic sequence.
SAEELLRTIEKRIEDNHRRLEEILEEIARLIEDMLRTDERIVREIKELLKEVLDRVRRAGVPEEVLERVRRELERLKKELEELRRRSEEKVKELKRRLEEIRRKLEEEHRDLRRKLEELRRDLGDKEEVVKRDHMVLHEYVNAAGITAEDLLRRVEEVIRTSKKESKDVLEKIERLLRDLERRTR

SEQ ID NO: 14455 - protein, 183 aa, Artificial Sequence
  Synthetic sequence.
SIEDRIRELEKRLEKVLREIEEHSKKVVREAEKVLREIEENSRRNNKRLEEVLDEIRKRPVDETLVREVEEAVRRLKKHNKDSSDTARKLVEELKKELKESSDRVRKVVEELKDRLRKVLEKGGEEDVRKVRDHMVLHEYVNAAGITDVVRRLKEVLKELRKHNKRSLDESEKVLRELRERIR

SEQ ID NO: 14456 - protein, 188 aa, Artificial Sequence
  Synthetic sequence.
SEIEKILKEIEDLARRDEEVSKKIVEDIRRLAKEVEDTSRDIVRKIEELAKRVLDRLRKDGSKEELEKEVREVVKTLEELVKDNHRLIRRAVEEMKRLVEENHRHSREVVKELEDLVRELRKGSGSEDSERRDHMVLHEYVNAAGITEKSNEEVKRTVEELVRRMEESNDRVRDLVRRLVEELKRAVD

SEQ ID NO: 14457 - protein, 186 aa, Artificial Sequence
  Synthetic sequence.
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGDEDKARDHMVLHEYVNAAGITLDRESKEAFRATNEEIAKLDEDTARVAERVKKAIEDLAK

SEQ ID NO: 14458 - protein, 186 aa, Artificial Sequence
  Synthetic sequence.
SEVDEIIKELERLLAEIARENERIIRESRKLADEVRKRNEDAIRKLEELVARLADAVRRKGSESEEVKKLIEDVLREIERLLKRIEEENREVVKRNSELVERVRAINEEILRRVAELVEKIARDIGDKDEVRDHMVLHEYVNAAGITLDDETRRVIEDTNKKIADLDKATRDVVRKVLEEVKKLEK

SEQ ID NO: 14459 - protein, 185 aa, Artificial Sequence
  Synthetic sequence.
SSVEELLERLRRISEENKRRIEKLLREVEKVLRELKDRHRKLLKRVEEIIRKVKEEIKSGLPEEAVKRVLERVRERVKEVLEEADRLNDEMRRIVTEVEKELDKSDKEVEDAVRDILKKIEEGVRDRETAERDHMVLHEYVNAAGITSKKVKEEIRRILEDLTRTTERVKREIAKLLKELEDTAR

SEQ ID NO: 14460 - protein, 186 aa, Artificial Sequence
  Synthetic sequence.
SAEDSIRELLERDERLLEEARKEAKRLNEENERLLERIEETVRRLLEEIKRLLDDIRKKIKGEKLREIEELVRRVKRTIEKLLEEVKKSVEDSSKRIEELLEAVERSVERTKEEIRRLLDEVRKDRKEELVKRDHMVLHEYVNAAGITVKEVIEEVEKLIRDNEKLAEDIEREIRRLLKELDEAAK

SEQ ID NO: 14461 - protein, 183 aa, Artificial Sequence
  Synthetic sequence.
KVEKRLTDLLKTVADEVKRVEDELRETVRESKEVVDKSRRDLERTVEESEKTVKDAERRVSEDLVRRIRKVLDENREVNDRVVKEDERILEENERVNRKVVEKIRDILRKIEEVVRRAAEEIRDEEVVKKVERDHMVLHEYVNAAGITVRERSKKILTDLKKSSEDVKRESERMLKKLEDEIR

SEQ ID NO: 14462 - protein, 186 aa, Artificial Sequence
  Synthetic sequence.
SEVDEVRKTLEDLLRRLDEENKDIIRRNKELLDDLDRKVREAIERLKRLLDELRKILEKLKDRETLTRIIEEIEKRARELIKRLRDEIRKIEEESKKSIEDSRKRNDEIRKRLEELIKDLRDKIKDSEELARRDHMVLHEYVNAAGITKEKNKRLEDDSRRVITELRKKLKDLEDRVREEIEELRK

SEQ ID NO: 14463 - protein, 183 aa, Artificial Sequence
  Synthetic sequence.
SEVDEVLERIKRLLERLAEHSDKVVRDIEKLLDDNRKENERLLDKLRRELKRLEEMRRRGDLREELLERVVREVEKEIRDIKRKNKRSVETVEKLVRDDRKELKRALEDVERLIRELETRLKDKEELRRKLERDHMVLHEYVNAAGITTDEVLKRARETIEDLNRKLDKVLKEVRDKLDRLRD

SEQ ID NO: 14464 - protein, 185 aa, Artificial Sequence
  Synthetic sequence.
DDIERLKREIERLLKEAEKISRDNEERSKELLDRLRKLSEDNKRKIDKLVEELKRLADKIKDKEELTRRLKEVVDRVEKSVRDSERMLREVVREDEESVRRSKTKLEDLLRKVEELVRRLEKKVTDEKVKRDRDHMVLHEYVNAAGITRKNDEVHRRSREEVKRLLEENRKLLEDLRRMVREITQ

SEQ ID NO: 14465 - protein, 184 aa, Artificial Sequence
  Synthetic sequence.
ELIKKARKDVEEVRERSERLVDELRKRNKKLADESRRLIDKLRKDVEKVLREIEDLLRKRRTKDVLKEIEDLVRELERELRRVVKESSDKVRKLIRENEKVVEESSRLFRDLVEKLRRVVEERNDKKLMEEVRDHMVLHEYVNAAGITDVREINKESERVNEETEREVEDAIRKLREVLRRAKK

SEQ ID NO: 14466 - protein, 184 aa, Artificial Sequence
  Synthetic sequence.
DEIRKVVKEITDLLKASNDKNRKVVEEIRDLLRKSKKLADELVERLRALVEDLRRRIDKSGDKETAEDIVRRIIEELKRILKEIEDLARRINREIERLVEEVERDNRDVNRAIEELLKDIARRGGSEDLKRVRDHMVLHEYVNAAGITRVKEDADRVSEANKEVLDRVREEVKRLIEEVRETLR

SEQ ID NO: 14467 - protein, 186 aa, Artificial Sequence
  Synthetic sequence.
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGDEDKARRDHMVLHEYVNAAGITDRESKEAFRATNEEIAKLDEDTARVAERVKKAIEDLAK

SEQ ID NO: 14468 - protein, 186 aa, Artificial Sequence
  Synthetic sequence.
SEVDEIIKELERLLAEIARENERIIRESRKLADEVRKRNEDAIRKLEELVARLADAVRRKGSESEEVKKLIEDVLREIERLLKRIEEENREVVKRNSELVERVRAINEEILRRVAELVEKIARDIGDKDEVTRDHMVLHEYVNAAGITDDETRRVIEDTNKKIADLDKATRDVVRKVLEEVKKLEK

SEQ ID NO: 14469 - protein, 185 aa, Artificial Sequence
  Synthetic sequence.
SEIDEVLTRLRKISKDLNETSDRVNERARKIIDDIKKESKRVNDEAREIVERLKREIDKTRDRDVLRRILKEIEDVARRVKEINEELLARVEKVVREVEEINRELVKRSREAVEAVKRLLDRGVSDEDKVERRDHMVLHEYVNAAGITEESTRSVRKLLEELKRELEKSTRSVKALVDELRERVR

SEQ ID NO: 14470 - protein, 183 aa, Artificial Sequence
  Synthetic sequence.
SDVDRVLEEIRKLLEDLKRHSEKVSEENEDLLRANTELNKRVSEDNERLLEELKRLRERGGISEEDLKRALDRVRKTVETVKEENKRSLEDVRRTVETNKRKLERVVEEIKKLIEDAKRRGSGDEEAKKKLDRDHMVLHEYVNAAGITSDRSLEKVEADLRRLNEELDRSLERAERTIRELAK

SEQ ID NO: 14471 - protein, 187 aa, Artificial Sequence
  Synthetic sequence.
DEEEELRKRLEKLSKEVRELLRRDEEEDRRLNRELEELLKDHERTVRDLSREVEDLLRKARRKVSEEELTRLRKKLRDLEEESKEALRELRRRVEELNKENKKSLDDLERRLKELEDRAREVEKRDRREDELRRDHMVLHEYVNAAGITLKRNTEDLRRVIKELAERLEELNKRLKREIRRLKEELR

SEQ ID NO: 14472 - protein, 184 aa, Artificial Sequence
  Synthetic sequence.
ELIKKARKDVEEVRERSERLVDELRKRNKKLADESRRLIDKLRKDVEKVLREIEDLLRKRRTKDVLKEIEDLVRELERELRRVVKESSDKVRKLIRENEKVVEESSRLFRDLVEKLRRVVEERNDKKLMEEVERDHMVLHEYVNAAGITVREINKESERVNEETEREVEDAIRKLREVLRRAKK

SEQ ID NO: 14473 - protein, 186 aa, Artificial Sequence
  Synthetic sequence.
KEVEDLERTVRTILKRMRELITRNEEEIRRSIEELKKLLKENKDTVRRILEEMKELKKEGGDDKKRLVEEIKRLLDELRENSKRSSDRAKEIHERNKRHSEESSRTIEKLLKELRDLVRDVERKLRDEDAKRKRDHMVLHEYVNAAGITERNKRLTKRSKEVLDEVHRANEEALKEVEEVVRRVTK

SEQ ID NO: 14474 - protein, 185 aa, Artificial Sequence
  Synthetic sequence.
SAEELLRTIEKRIEDNHRRLEEILEEIARLIEDMLRTDERIVREIKELLKEVLDRVRRAGVPEEVLERVRRELERLKKELEELRRRSEEKVKELKRRLEEIRRKLEEEHRDLRRKLEELRRDLGDKEEVVKKLRDHMVLHEYVNAAGITDLLRRVEEVIRTSKKESKDVLEKIERLLRDLERRTR

SEQ ID NO: 14475 - protein, 185 aa, Artificial Sequence
  Synthetic sequence.
SSVEELLERLRRISEENKRRIEKLLREVEKVLRELKDRHRKLLKRVEEIIRKVKEEIKSGLPEEAVKRVLERVRERVKEVLEEADRLNDEMRRIVTEVEKELDKSDKEVEDAVRDILKKIEEGVRDRETAERARDHMVLHEYVNAAGITKVKEEIRRILEDLTRTTERVKREIAKLLKELEDTAR

SEQ ID NO: 14476 - protein, 185 aa, Artificial Sequence; identical to SEQ ID NO: 14475
  Synthetic sequence.

SEQ ID NO: 14477 - protein, 186 aa, Artificial Sequence
  Synthetic sequence.
SAEDSIRELLERDERLLEEARKEAKRLNEENERLLERIEETVRRLLEEIKRLLDDIRKKIKGEKLREIEELVRRVKRTIEKLLEEVKKSVEDSSKRIEELLEAVERSVERTKEEIRRLLDEVRKDRKEELVKRVRDHMVLHEYVNAAGITEVIEEVEKLIRDNEKLAEDIEREIRRLLKELDEAAK

SEQ ID NO: 14478 - protein, 185 aa, Artificial Sequence
  Synthetic sequence.
DDIERLKREIERLLKEAEKISRDNEERSKELLDRLRKLSEDNKRKIDKLVEELKRLADKIKDKEELTRRLKEVVDRVEKSVRDSERMLREVVREDEESVRRSKTKLEDLLRKVEELVRRLEKKVTDEKVKRDARRDHMVLHEYVNAAGITNDEVHRRSREEVKRLLEENRKLLEDLRRMVREITQ

SEQ ID NO: 14479 - protein, 186 aa, Artificial Sequence
  Synthetic sequence.
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGDEDKARKVRDHMVLHEYVNAAGITESKEAFRATNEEIAKLDEDTARVAERVKKAIEDLAK

SEQ ID NO: 14480 - protein, 186 aa, Artificial Sequence
  Synthetic sequence.
SEVDEIIKELERLLAEIARENERIIRESRKLADEVRKRNEDAIRKLEELVARLADAVRRKGSESEEVKKLIEDVLREIERLLKRIEEENREVVKRNSELVERVRAINEEILRRVAELVEKIARDIGDKDEVTKVRDHMVLHEYVNAAGITETRRVIEDTNKKIADLDKATRDVVRKVLEEVKKLEK

SEQ ID NO: 14481 - protein, 185 aa, Artificial Sequence
  Synthetic sequence.
SEIDEVLTRLRKISKDLNETSDRVNERARKIIDDIKKESKRVNDEAREIVERLKREIDKTRDRDVLRRILKEIEDVARRVKEINEELLARVEKVVREVEEINRELVKRSREAVEAVKRLLDRGVSDEDKVERVVRDHMVLHEYVNAAGITSTRSVRKLLEELKRELEKSTRSVKALVDELRERVR

SEQ ID NO: 14482 - protein, 185 aa, Artificial Sequence
  Synthetic sequence.
SSVEELLERLRRISEENKRRIEKLLREVEKVLRELKDRHRKLLKRVEEIIRKVKEEIKSGLPEEAVKRVLERVRERVKEVLEEADRLNDEMRRIVTEVEKELDKSDKEVEDAVRDILKKIEEGVRDRETAERARRDHMVLHEYVNAAGITVKEEIRRILEDLTRTTERVKREIAKLLKELEDTAR

SEQ ID NO: 14483 - protein, 187 aa, Artificial Sequence
  Synthetic sequence.
SEKETVRDELRKLVETIRKLLEEDKESDKRLADRIRELNEENKEDTERLIRELEKVLEELRKKVSEDELRKLRKRIEDLRRRDEELNKRSREKLEDLNERNKDSLRRIEDELRKLVEEAREVEKRDNDEERLRKLRDHMVLHEYVNAAGITENNKRLRKAIKELLDELRKINKELREVIKKLLDDAR

SEQ ID NO: 14484 - protein, 186 aa, Artificial Sequence
  Synthetic sequence.
DEIRELEERVRRILDELRRLVERNREVIERSIRELEKLLDRNRRKVEEILRRIDDLTRRGGDDKKTMLDDVRRLLREAEDHSRRSSETAKRIHRENEEHSKDSSRKVRKLIEELRELAKKVEKEITDERVKEAIKRDHMVLHEYVNAAGITNRELTKTSKKVLEDVDRTNRRLVKEVRDVVERARK

SEQ ID NO: 14485 - protein, 186 aa, Artificial Sequence
  Synthetic sequence.
KEVEDLERTVRTILKRMRELITRNEEEIRRSIEELKKLLKENKDTVRRILEEMKELKKEGGDDKKRLVEEIKRLLDELRENSKRSSDRAKEIHERNKRHSEESSRTIEKLLKELRDLVRDVERKLRDEDAKRKLDRDHMVLHEYVNAAGITNKRLTKRSKEVLDEVHRANEEALKEVEEVVRRVTK

SEQ ID NO: 14486 - protein, 186 aa, Artificial Sequence
  Synthetic sequence.
SRVEEIIEDLRRLLEEIRKENEDSIRRSKELLDRVKEINDTIIAELERLLKDIEKEVREKGSESEEVKKALRAVLEELEKLLRRVAEINEEVLRRNSKLVEEDERRNREVLKELARLVEELIREIGDEDKARKVARDHMVLHEYVNAAGITSKEAFRATNEEIAKLDEDTARVAERVKKAIEDLAK

SEQ ID NO: 14487 - protein, 187 aa, Artificial Sequence
  Synthetic sequence.
DEEEELRKRLEKLSKEVRELLRRDEEEDRRLNRELEELLKDHERTVRDLSREVEDLLRKARRKVSEEELTRLRKKLRDLEEESKEALRELRRRVEELNKENKKSLDDLERRLKELEDRAREVEKRDRREDELRELLRDHMVLHEYVNAAGITNTEDLRRVIKELAERLEELNKRLKREIRRLKEELR

SEQ ID NO: 14488 - protein, 188 aa, Artificial Sequence
  Synthetic sequence.
SEIEKILKEIEDLARRDEEVSKKIVEDIRRLAKEVEDTSRDIVRKIEELAKRVLDRLRKDGSKEELEKEVREVVKTLEELVKDNHRLIRRAVEEMKRLVEENHRHSREVVKELEDLVRELRKGSGSEDSERLVREVRDHMVLHEYVNAAGITEVKRTVEELVRRMEESNDRVRDLVRRLVEELKRAVD

SEQ ID NO: 14489 - protein, 229 aa, Artificial Sequence
  Synthetic sequence.
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKRDHMVLHEYVNAAGITVEVVRRVIKALKEVLERHVDATREVIERVKRVNKRLLEAVREVVT

SEQ ID NO: 14490 - protein, 229 aa, Artificial Sequence
  Synthetic sequence.
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDRDHMVLHEYVNAAGITEVVRRVIKALKEVLERHVDATREVIERVKRVNKRLLEAVREVVT

SEQ ID NO: 14491 - protein, 231 aa, Artificial Sequence
  Synthetic sequence.
DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRDHMVLHEYVNAAGITVEELRRLHEEIKERLDDVARRSEEELRRIIKKLKEVVKEIRKKLK

SEQ ID NO: 14492 - protein, 231 aa, Artificial Sequence
  Synthetic sequence.
SKEEEVEKVLRKWEEILRRLIEENKRANDKIRREYEELVKEIRRVLEEIKEVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIERDHMVLHEYVNAAGITERLLRVAEEVIRRILKVNTELMRVDERSIRESLKAISEVLKVLDT

SEQ ID NO: 14493 - protein, 231 aa, Artificial Sequence; identical to SEQ ID NO: 14492
  Synthetic sequence.

SEQ ID NO: 14494 - protein, 231 aa, Artificial Sequence
  Synthetic sequence.
SKDEELARLLEELVERWRKIVEDLERDHRRLVKEIRELVERIRKKLEELVDRIRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKERDHMVLHEYVNAAGITVDDVLRIIARILKLLRDLTRRLAEVAKAVHKLLEELLRKLKEDTR

SEQ ID NO: 14495 - protein, 229 aa, Artificial Sequence
  Synthetic sequence.
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDERDHMVLHEYVNAAGITVVRRVIKALKEVLERHVDATREVIERVKRVNKRLLEAVREVVT

SEQ ID NO: 14496 - protein, 231 aa, Artificial Sequence
  Synthetic sequence.
DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRRDHMVLHEYVNAAGITEELRRLHEEIKERLDDVARRSEEELRRIIKKLKEVVKEIRKKLK

SEQ ID NO: 14497 - protein, 231 aa, Artificial Sequence
  Synthetic sequence.
SKEEEVEKVLRKWEEILRRLIEENKRANDKIRREYEELVKEIRRVLEEIKEVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEERDHMVLHEYVNAAGITRLLRVAEEVIRRILKVNTELMRVDERSIRESLKAISEVLKVLDT

SEQ ID NO: 14498 - protein, 231 aa, Artificial Sequence; identical to SEQ ID NO: 14497
  Synthetic sequence.

SEQ ID NO: 14499 - protein, 229 aa, Artificial Sequence
  Synthetic sequence.
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEIRDHMVLHEYVNAAGITVRRVIKALKEVLERHVDATREVIERVKRVNKRLLEAVREVVT

SEQ ID NO: 14500 - protein, 229 aa, Artificial Sequence; identical to SEQ ID NO: 14499
  Synthetic sequence.

SEQ ID NO: 14501 - protein, 231 aa, Artificial Sequence
  Synthetic sequence.
DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKRDHMVLHEYVNAAGITELRRLHEEIKERLDDVARRSEEELRRIIKKLKEVVKEIRKKLK

SEQ ID NO: 14502 - protein, 231 aa, Artificial Sequence; identical to SEQ ID NO: 14501
  Synthetic sequence.

SEQ ID NO: 14503 - protein, 231 aa, Artificial Sequence
  Synthetic sequence.
SKEEEVEKVLRKWEEILRRLIEENKRANDKIRREYEELVKEIRRVLEEIKEVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKRDHMVLHEYVNAAGITLLRVAEEVIRRILKVNTELMRVDERSIRESLKAISEVLKVLDT

SEQ ID NO: 14504 - protein, 231 aa, Artificial Sequence; identical to SEQ ID NO: 14503
  Synthetic sequence.

SEQ ID NO: 14505 - protein, 231 aa, Artificial Sequence
  Synthetic sequence.
SKDEELARLLEELVERWRKIVEDLERDHRRLVKEIRELVERIRKKLEELVDRIRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDRDHMVLHEYVNAAGITDVLRIIARILKLLRDLTRRLAEVAKAVHKLLEELLRKLKEDTR

SEQ ID NO: 14506 - protein, 229 aa, Artificial Sequence
  Synthetic sequence.
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISRDHMVLHEYVNAAGITRRVIKALKEVLERHVDATREVIERVKRVNKRLLEAVREVVT

SEQ ID NO: 14507 - protein, 229 aa, Artificial Sequence; identical to SEQ ID NO: 14506
  Synthetic sequence.

SEQ ID NO: 14508 - protein, 234 aa, Artificial Sequence
  Synthetic sequence.
SAKETIRKLIEENKDIIRKLAEKLKRLLEESERIAEEALRLIKELLERIERALRRVGSGIDEELLKELEKELARLEEELKEILDRVRDLHRRLAEEIRKILEESKKLNEELEDRLRKDGDVEELLELLERVHATDVRLLRELLKLLKKVHEDVVSLLERLLELLKRVLDRIVERDHMVLHEYVNAAGITEREIRRLAKRLKELSDRLEEKIRKIKRELDDLSARLREKIERTRK

SEQ ID NO: 14509 - protein, 231 aa, Artificial Sequence
  Synthetic sequence.
DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGRDHMVLHEYVNAAGITLRRLHEEIKERLDDVARRSEEELRRIIKKLKEVVKEIRKKLK

SEQ ID NO: 14510 - protein, 231 aa, Artificial Sequence; identical to SEQ ID NO: 14509
  Synthetic sequence.

SEQ ID NO: 14511 - protein, 231 aa, Artificial Sequence
  Synthetic sequence.
SKEEEVEKVLRKWEEILRRLIEENKRANDKIRREYEELVKEIRRVLEEIKEVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIRDHMVLHEYVNAAGITLRVAEEVIRRILKVNTELMRVDERSIRESLKAISEVLKVLDT

SEQ ID NO: 14512 - protein, 231 aa, Artificial Sequence; identical to SEQ ID NO: 14511
  Synthetic sequence.

SEQ ID NO: 14513 - protein, 231 aa, Artificial Sequence
  Synthetic sequence.
SKDEELARLLEELVERWRKIVEDLERDHRRLVKEIRELVERIRKKLEELVDRIRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDRRDHMVLHEYVNAAGITVLRIIARILKLLRDLTRRLAEVAKAVHKLLEELLRKLKEDTR

SEQ ID NO: 14514 - protein, 229 aa, Artificial Sequence
  Synthetic sequence.
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGRDHMVLHEYVNAAGITRVIKALKEVLERHVDATREVIERVKRVNKRLLEAVREVVT

SEQ ID NO: 14515 - protein, 234 aa, Artificial Sequence
  Synthetic sequence.
SAKETIRKLIEENKDIIRKLAEKLKRLLEESERIAEEALRLIKELLERIERALRRVGSGIDEELLKELEKELARLEEELKEILDRVRDLHRRLAEEIRKILEESKKLNEELEDRLRKDGDVEELLELLERVHATDVRLLRELLKLLKKVHEDVVSLLERLLELLKRVLDRIVEERDHMVLHEYVNAAGITREIRRLAKRLKELSDRLEEKIRKIKRELDDLSARLREKIERTRK

SEQ ID NO: 14516 - protein, 234 aa, Artificial Sequence; identical to SEQ ID NO: 14515
  Synthetic sequence.

SEQ ID NO: 14517 - protein, 231 aa, Artificial Sequence
  Synthetic sequence.
DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGRDHMVLHEYVNAAGITRRLHEEIKERLDDVARRSEEELRRIIKKLKEVVKEIRKKLK

SEQ ID NO: 14518 - protein, 231 aa, Artificial Sequence; identical to SEQ ID NO: 14517
  Synthetic sequence.

SEQ ID NO: 14519 - protein, 231 aa, Artificial Sequence
  Synthetic sequence.
SKEEEVEKVLRKWEEILRRLIEENKRANDKIRREYEELVKEIRRVLEEIKEVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDRDHMVLHEYVNAAGITRVAEEVIRRILKVNTELMRVDERSIRESLKAISEVLKVLDT

SEQ ID NO: 14520 - protein, 231 aa, Artificial Sequence
  Synthetic sequence.
SKDEELARLLEELVERWRKIVEDLERDHRRLVKEIRELVERIRKKLEELVDRIRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDRERDHMVLHEYVNAAGITLRIIARILKLLRDLTRRLAEVAKAVHKLLEELLRKLKEDTR

SEQ ID NO: 14521 - protein, 229 aa, Artificial Sequence
  Synthetic sequence.
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSRDHMVLHEYVNAAGITVIKALKEVLERHVDATREVIERVKRVNKRLLEAVREVVT

SEQ ID NO: 14522 - protein, 234 aa, Artificial Sequence
  Synthetic sequence.
SAKETIRKLIEENKDIIRKLAEKLKRLLEESERIAEEALRLIKELLERIERALRRVGSGIDEELLKELEKELARLEEELKEILDRVRDLHRRLAEEIRKILEESKKLNEELEDRLRKDGDVEELLELLERVHATDVRLLRELLKLLKKVHEDVVSLLERLLELLKRVLDRIVEELRDHMVLHEYVNAAGITEIRRLAKRLKELSDRLEEKIRKIKRELDDLSARLREKIERTRK

SEQ ID NO: 14523 - protein, 234 aa, Artificial Sequence; identical to SEQ ID NO: 14522
  Synthetic sequence.

SEQ ID NO: 14524 - protein, 231 aa, Artificial Sequence
  Synthetic sequence.
DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVRDHMVLHEYVNAAGITRLHEEIKERLDDVARRSEEELRRIIKKLKEVVKEIRKKLK

SEQ ID NO: 14525 - protein, 231 aa, Artificial Sequence; identical to SEQ ID NO: 14524
  Synthetic sequence.

SEQ ID NO: 14526 - protein, 236 aa, Artificial Sequence
  Synthetic sequence.
STREKAKKVLDTLRADNEDMKRVVEKILRALKRTNERAEKLAREITEEIKRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRDHMVLHEYVNAAGITRRIKEKLRKALEELEREHRELEKELDKLHDESRKEHERIEEELRR

SEQ ID NO: 14527 - protein, 236 aa, Artificial Sequence; identical to SEQ ID NO: 14526
  Synthetic sequence.

SEQ ID NO: 14528 - protein, 231 aa, Artificial Sequence
  Synthetic sequence.
SKEEEVEKVLRKWEEILRRLIEENKRANDKIRREYEELVKEIRRVLEEIKEVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDRDHMVLHEYVNAAGITVAEEVIRRILKVNTELMRVDERSIRESLKAISEVLKVLDT

SEQ ID NO: 14529 - protein, 231 aa, Artificial Sequence
  Synthetic sequence.
SKDEELARLLEELVERWRKIVEDLERDHRRLVKEIRELVERIRKKLEELVDRIRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREERDHMVLHEYVNAAGITRIIARILKLLRDLTRRLAEVAKAVHKLLEELLRKLKEDTR

SEQ ID NO: 14530 - protein, 229 aa, Artificial Sequence
  Synthetic sequence.
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKRDHMVLHEYVNAAGITIKALKEVLERHVDATREVIERVKRVNKRLLEAVREVVT

SEQ ID NO: 14531 - protein, 234 aa, Artificial Sequence
  Synthetic sequence.
SAKETIRKLIEENKDIIRKLAEKLKRLLEESERIAEEALRLIKELLERIERALRRVGSGIDEELLKELEKELARLEEELKEILDRVRDLHRRLAEEIRKILEESKKLNEELEDRLRKDGDVEELLELLERVHATDVRLLRELLKLLKKVHEDVVSLLERLLELLKRVLDRIVEELGRDHMVLHEYVNAAGITIRRLAKRLKELSDRLEEKIRKIKRELDDLSARLREKIERTRK

SEQ ID NO: 14532 - protein, 234 aa, Artificial Sequence; identical to SEQ ID NO: 14531
  Synthetic sequence.

SEQ ID NO: 14533 - protein, 231 aa, Artificial Sequence
  Synthetic sequence.
DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVPRDHMVLHEYVNAAGITLHEEIKERLDDVARRSEEELRRIIKKLKEVVKEIRKKLK

SEQ ID NO: 14534 - protein, 231 aa, Artificial Sequence; identical to SEQ ID NO: 14533
  Synthetic sequence.

SEQ ID NO: 14535 - protein, 236 aa, Artificial Sequence
  Synthetic sequence.
STREKAKKVLDTLRADNEDMKRVVEKILRALKRTNERAEKLAREITEEIKRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRRDHMVLHEYVNAAGITRIKEKLRKALEELEREHRELEKELDKLHDESRKEHERIEEELRR

SEQ ID NO: 14536 - protein, 236 aa, Artificial Sequence; identical to SEQ ID NO: 14535
  Synthetic sequence.

SEQ ID NO: 14537 - protein, 231 aa, Artificial Sequence
  Synthetic sequence.
SKEEEVEKVLRKWEEILRRLIEENKRANDKIRREYEELVKEIRRVLEEIKEVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDERDHMVLHEYVNAAGITAEEVIRRILKVNTELMRVDERSIRESLKAISEVLKVLDT

SEQ ID NO: 14538 - protein, 231 aa, Artificial Sequence; identical to SEQ ID NO: 14537
  Synthetic sequence.

SEQ ID NO: 14539 - protein, 231 aa, Artificial Sequence
  Synthetic sequence.
SKDEELARLLEELVERWRKIVEDLERDHRRLVKEIRELVERIRKKLEELVDRIRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRDHMVLHEYVNAAGITIIARILKLLRDLTRRLAEVAKAVHKLLEELLRKLKEDTR

SEQ ID NO: 14540 - protein, 237 aa, Artificial Sequence
  Synthetic sequence.
REDEVLRDIERLLREIEEKIRRILEESTAELRKVEEEVKRIIERTKRELKAIKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIRDHMVLHEYVNAAGITREHIKALEKLARDLKEILRRHIEALKELARDLAEVIRKLLEDVKR

SEQ ID NO: 14541 - protein, 237 aa, Artificial Sequence; identical to SEQ ID NO: 14540
  Synthetic sequence.

SEQ ID NO: 14542 - protein, 234 aa, Artificial Sequence
  Synthetic sequence.
SAKETIRKLIEENKDIIRKLAEKLKRLLEESERIAEEALRLIKELLERIERALRRVGSGIDEELLKELEKELARLEEELKEILDRVRDLHRRLAEEIRKILEESKKLNEELEDRLRKDGDVEELLELLERVHATDVRLLRELLKLLKKVHEDVVSLLERLLELLKRVLDRIVEELGLRDHMVLHEYVNAAGITRRLAKRLKELSDRLEEKIRKIKRELDDLSARLREKIERTRK

SEQ ID NO: 14543 - protein, 234 aa, Artificial Sequence; identical to SEQ ID NO: 14542
  Synthetic sequence.

SEQ ID NO: 14544 - protein, 238 aa, Artificial Sequence
  Synthetic sequence.
SEAEKIREALETNLRLLEELIKRLKEILDTHNELLRRVIETLERLLKELLELLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTRDHMVLHEYVNAAGITEELEDRLRRLLEKLARDSAELMRELERILDRYARESEELDRRLAE

SEQ ID NO: 14545 - protein, 238 aa, Artificial Sequence; identical to SEQ ID NO: 14544
  Synthetic sequence.

SEQ ID NO: 14546 - protein, 238 aa, Artificial Sequence
  Synthetic sequence.
DADELLRRLAEEVERVIREAEDLLRRWKETIKKVLDDLKRLLDELKKRNEDVIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERDHMVLHEYVNAAGITLDRLRKLLERLREILRENLEALKKTLKRLEDVVREILEDLKRERK

SEQ ID NO: 14547 - protein, 238 aa, Artificial Sequence; identical to SEQ ID NO: 14546
  Synthetic sequence.

SEQ ID NO: 14548 - protein, 231 aa, Artificial Sequence
  Synthetic sequence.
DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVPERDHMVLHEYVNAAGITHEEIKERLDDVARRSEEELRRIIKKLKEVVKEIRKKLK

SEQ ID NO: 14549 - protein, 236 aa, Artificial Sequence
  Synthetic sequence.
STREKAKKVLDTLRADNEDMKRVVEKILRALKRTNERAEKLAREITEEIKRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGRDHMVLHEYVNAAGITIKEKLRKALEELEREHRELEKELDKLHDESRKEHERIEEELRR

SEQ ID NO: 14550 - protein, 236 aa, Artificial Sequence; identical to SEQ ID NO: 14549
  Synthetic sequence.

SEQ ID NO: 14551 - protein, 231 aa, Artificial Sequence
  Synthetic sequence.
SKEEEVEKVLRKWEEILRRLIEENKRANDKIRREYEELVKEIRRVLEEIKEVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDRDHMVLHEYVNAAGITEEVIRRILKVNTELMRVDERSIRESLKAISEVLKVLDT

SEQ ID NO: 14552 - protein, 231 aa, Artificial Sequence
  Synthetic sequence.
SKDEELARLLEELVERWRKIVEDLERDHRRLVKEIRELVERIRKKLEELVDRIRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRRDHMVLHEYVNAAGITIARILKLLRDLTRRLAEVAKAVHKLLEELLRKLKEDTR

SEQ ID NO: 14553 - protein, 238 aa, Artificial Sequence
  Synthetic sequence.
SEIEDVIRRLRKILEDLERVSEKLLREIKKILDEARRLNEEVIKEIKRVLEDAVRVFRDGSGSKEELAKLVEELIRELAKLAKEVDEIHKRIVERLKALVEDAERIHRKIVETLEEIVRGVPSEELKRVVEAIVEVIKEHLKVLADVIRRIIKAIEENAETIKRVLEDIVRVLELVLRDHMVLHEYVNAAGITIKRIEDSLRELEKTVRELLKRIKEASDKVREDVDRLIKELKEAAD

SEQ ID NO: 14554 - protein, 229 aa, Artificial Sequence
  Synthetic sequence.
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVRDHMVLHEYVNAAGITALKEVLERHVDATREVIERVKRVNKRLLEAVREVVT

SEQ ID NO: 14555 - protein, 237 aa, Artificial Sequence
  Synthetic sequence.
REDEVLRDIERLLREIEEKIRRILEESTAELRKVEEEVKRIIERTKRELKAIKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRDHMVLHEYVNAAGITEHIKALEKLARDLKEILRRHIEALKELARDLAEVIRKLLEDVKR

SEQ ID NO: 14556 - protein, 237 aa, Artificial Sequence; identical to SEQ ID NO: 14555
  Synthetic sequence.

SEQ ID NO: 14557 - protein, 232 aa, Artificial Sequence
  Synthetic sequence.
SEKELVDDIRRILEEILRLLRSLLEEVIRLLEENEKLVRRHLKTVIDILRRVAKLLDENGIRTDEADRVLERLEKAHRELLEDYKRALEKIKETLERVLREAEEVVKKIDDALRKLGGSKEVLKRLLEELLRLVEKIAEEIKRLLSELVRVTEELVRTNKELLEEAVRVIRKEVGDDRDHMVLHEYVNAAGITIDDLLKTSRDLVKRVLDLVDEVVKRVEDLVERVKEKIDT

SEQ ID NO: 14558 - protein, 239 aa, Artificial Sequence
  Synthetic sequence.
SDEELLERVERLLRELLDTNRRMLEEVEKELRRLLETNKKTLDDVRRLLKELLDVLETRGVKDEKRLRDIRRRLEEVVRRLDKLHRDIAEDLKRVKERLDRLHERIKRRLEEVVKELRDLKDRGVDERKVLERAAEVLRELLELLRESLEEIERIIRRLLELHKRSTEEAARALEELLRDHMVLHEYVNAAGITEDLLKEDKERLEKIARDIERDLERYARDLKRLEDELREDIERARR

SEQ ID NO: 14559 - protein, 239 aa, Artificial Sequence; identical to SEQ ID NO: 14558
  Synthetic sequence.

SEQ ID NO: 14560 - protein, 234 aa, Artificial Sequence
  Synthetic sequence.
SAKETIRKLIEENKDIIRKLAEKLKRLLEESERIAEEALRLIKELLERIERALRRVGSGIDEELLKELEKELARLEEELKEILDRVRDLHRRLAEEIRKILEESKKLNEELEDRLRKDGDVEELLELLERVHATDVRLLRELLKLLKKVHEDVVSLLERLLELLKRVLDRIVEELGLSRDHMVLHEYVNAAGITRLAKRLKELSDRLEEKIRKIKRELDDLSARLREKIERTRK

SEQ ID NO: 14561 - protein, 234 aa, Artificial Sequence; identical to SEQ ID NO: 14560
  Synthetic sequence.

SEQ ID NO: 14562 - protein, 238 aa, Artificial Sequence
  Synthetic sequence.
SKEDKARELEKRLRDNLKKLEEVVRELAEVLKRNLEKLRRLAEELLRALKRLLDKLRAGGLPKDELEDLRREVEDVLRRLEDLLRKLKKANDESLTRLEELLRRAEEENRRVLTTLRELLRGNGDDRDLARLVARLVEANNRALEELLRLVAKNVEDNNRVLEELLRLVKELAKRLLGRDHMVLHEYVNAAGITELEERARKILRDDERDLRALEKRIRDIIREDREELERLKERARK

SEQ ID NO: 14563 - protein, 238 aa, Artificial Sequence
  Synthetic sequence.
SEAEKIREALETNLRLLEELIKRLKEILDTHNELLRRVIETLERLLKELLELLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKRDHMVLHEYVNAAGITELEDRLRRLLEKLARDSAELMRELERILDRYARESEELDRRLAE

SEQ ID NO: 14564 - protein, 238 aa, Artificial Sequence; identical to SEQ ID NO: 14563
  Synthetic sequence.

SEQ ID NO: 14565 - protein, 238 aa, Artificial Sequence
  Synthetic sequence.
DADELLRRLAEEVERVIREAEDLLRRWKETIKKVLDDLKRLLDELKKRNEDVIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERRDHMVLHEYVNAAGITDRLRKLLERLREILRENLEALKKTLKRLEDVVREILEDLKRERK

SEQ ID NO: 14566 - protein, 231 aa, Artificial Sequence
  Synthetic sequence.
DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVPEERDHMVLHEYVNAAGITEEIKERLDDVARRSEEELRRIIKKLKEVVKEIRKKLK

SEQ ID NO: 14567 - protein, 231 aa, Artificial Sequence; identical to SEQ ID NO: 14566
  Synthetic sequence.

SEQ ID NO: 14568 - protein, 236 aa, Artificial Sequence
  Synthetic sequence.
STREKAKKVLDTLRADNEDMKRVVEKILRALKRTNERAEKLAREITEEIKRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDRDHMVLHEYVNAAGITKEKLRKALEELEREHRELEKELDKLHDESRKEHERIEEELRR

SEQ ID NO: 14569 - protein, 239 aa, Artificial Sequence
  Synthetic sequence.
SERELIERWLELHKEILRLIRELVERLLKLHREILDTIKKLIRELLELLEDIARKLGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERDHMVLHEYVNAAGITEDILEKVERTLKKLLDDSARMAEEVKKTLKELLERSEKVAEDVRK

SEQ ID NO: 14570 - protein, 231 aa, Artificial Sequence
  Synthetic sequence.
SKDEELARLLEELVERWRKIVEDLERDHRRLVKEIRELVERIRKKLEELVDRIRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRRRDHMVLHEYVNAAGITARILKLLRDLTRRLAEVAKAVHKLLEELLRKLKEDTR

SEQ ID NO: 14571 - protein, 238 aa, Artificial Sequence
  Synthetic sequence.
SEIEDVIRRLRKILEDLERVSEKLLREIKKILDEARRLNEEVIKEIKRVLEDAVRVFRDGSGSKEELAKLVEELIRELAKLAKEVDEIHKRIVERLKALVEDAERIHRKIVETLEEIVRGVPSEELKRVVEAIVEVIKEHLKVLADVIRRIIKAIEENAETIKRVLEDIVRVLELVLRRDHMVLHEYVNAAGITKRIEDSLRELEKTVRELLKRIKEASDKVREDVDRLIKELKEAAD

SEQ ID NO: 14572 - protein, 238 aa, Artificial Sequence; identical to SEQ ID NO: 14571
  Synthetic sequence.

SEQ ID NO: 14573 - protein, 237 aa, Artificial Sequence
  Synthetic sequence.
KEKEDALKKLEDLARKSREDLERVLRKHKKILDKIEELLKRVLDEHKKIVDDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDRDHMVLHEYVNAAGITKSKEILERIERAIDELLKVSEEILKLSEDASEELLKILREFAK

SEQ ID NO: 14574 - protein, 229 aa, Artificial Sequence
  Synthetic sequence.
SKEERLREVAEKHKKDLEDIVKRVDEAAKETARRLEEILKRLEEVLKKILDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLRDHMVLHEYVNAAGITLKEVLERHVDATREVIERVKRVNKRLLEAVREVVT

SEQ ID NO: 14575 - protein, 237 aa, Artificial Sequence
  Synthetic sequence.
REDEVLRDIERLLREIEEKIRRILEESTAELRKVEEEVKRIIERTKRELKAIKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRRDHMVLHEYVNAAGITHIKALEKLARDLKEILRRHIEALKELARDLAEVIRKLLEDVKR

SEQ ID NO: 14576 - protein, 234 aa, Artificial Sequence
  Synthetic sequence.
SAKETIRKLIEENKDIIRKLAEKLKRLLEESERIAEEALRLIKELLERIERALRRVGSGIDEELLKELEKELARLEEELKEILDRVRDLHRRLAEEIRKILEESKKLNEELEDRLRKDGDVEELLELLERVHATDVRLLRELLKLLKKVHEDVVSLLERLLELLKRVLDRIVEELGLSDRDHMVLHEYVNAAGITLAKRLKELSDRLEEKIRKIKRELDDLSARLREKIERTRK

SEQ ID NO: 14577 - protein, 238 aa, Artificial Sequence
  Synthetic sequence.
SEAEKIREALETNLRLLEELIKRLKEILDTHNELLRRVIETLERLLKELLELLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKRDHMVLHEYVNAAGITLEDRLRRLLEKLARDSAELMRELERILDRYARESEELDRRLAE

SEQ ID NO: 14578 - protein, 238 aa, Artificial Sequence; identical to SEQ ID NO: 14577
  Synthetic sequence.

SEQ ID NO: 14579 - protein, 240 aa, Artificial Sequence
  Synthetic sequence.
SDKEEIKRRVEKTARDLETEHDKIKKRLEDTVRDIKRELDELLEKYERVLRKIEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKRDHMVLHEYVNAAGITLDVVRRILEALAKLIKELLEALEEVLRRNKELIRELLRVLDEALK

SEQ ID NO: 14580 - protein, 240 aa, Artificial Sequence; identical to SEQ ID NO: 14579
  Synthetic sequence.

SEQ ID NO: 14581 - protein, 231 aa, Artificial Sequence
  Synthetic sequence.
DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVPEEIRDHMVLHEYVNAAGITEIKERLDDVARRSEEELRRIIKKLKEVVKEIRKKLK

SEQ ID NO: 14582 - protein, 231 aa, Artificial Sequence; identical to SEQ ID NO: 14581
  Synthetic sequence.

SEQ ID NO: 14583 - protein, 236 aa, Artificial Sequence
  Synthetic sequence.
STREKAKKVLDTLRADNEDMKRVVEKILRALKRTNERAEKLAREITEEIKRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVRDHMVLHEYVNAAGITEKLRKALEELEREHRELEKELDKLHDESRKEHERIEEELRR

SEQ ID NO: 14584 - protein, 236 aa, Artificial Sequence; identical to SEQ ID NO: 14583
  Synthetic sequence.

SEQ ID NO: 14585 - protein, 239 aa, Artificial Sequence
  Synthetic sequence.
SERELIERWLELHKEILRLIRELVERLLKLHREILDTIKKLIRELLELLEDIARKLGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERRDHMVLHEYVNAAGITDILEKVERTLKKLLDDSARMAEEVKKTLKELLERSEKVAEDVRK

SEQ ID NO: 14586 - protein, 237 aa, Artificial Sequence
  Synthetic sequence.
KEKEDALKKLEDLARKSREDLERVLRKHKKILDKIEELLKRVLDEHKKIVDDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDERDHMVLHEYVNAAGITSKEILERIERAIDELLKVSEEILKLSEDASEELLKILREFAK

SEQ ID NO: 14587 - protein, 237 aa, Artificial Sequence; identical to SEQ ID NO: 14586
  Synthetic sequence.

SEQ ID NO: 14588 - protein, 240 aa, Artificial Sequence
  Synthetic sequence.
DREKSVRDIEEDLKRVLDKLRRRVETSKEELKKVLKADKENADELEKTLRDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKRDHMVLHEYVNAAGITKRLLDNLKENTDRLKEVIDRNLADLRDLAEELRAVIERLLEDARR

SEQ ID NO: 14589 - protein, 237 aa, Artificial Sequence
  Synthetic sequence.
REDEVLRDIERLLREIEEKIRRILEESTAELRKVEEEVKRIIERTKRELKAIKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGRDHMVLHEYVNAAGITIKALEKLARDLKEILRRHIEALKELARDLAEVIRKLLEDVKR

SEQ ID NO: 14590 - protein, 237 aa, Artificial Sequence; identical to SEQ ID NO: 14589
  Synthetic sequence.

SEQ ID NO: 14591 - protein, 237 aa, Artificial Sequence
  Synthetic sequence.
SREDLLRSLAELIETILRKSSELLDRLLKLVREHSETSERLIRELKKILEDILKLIKGGISEDDVRRIVKEAKDELRRSVEEVKKSVDDLKEELKRSLREVRELVKSIADALEEIVRRSSGLGEVIKKLLELLRRLLEVHERTIRLLAELLERHLEVHEESIRLLLRLLEELLELVERKRDHMVLHEYVNAAGITLRDHKAKNDKILRDVEEVLRRHLEELARILKDVKKVLDEARK

SEQ ID NO: 14592 - protein, 239 aa, Artificial Sequence
  Synthetic sequence.
SAEDLVRRVKDLVDKLEDKLRKVVRTNERLWEEIRKRLEELVRRNKELWDALVEKLKAGDKDKDELIEEAKSLEDESNALVEKLVRDIERVLAESNKLLDTLAKEIEEVLEEIVELVERGSGSDKEAREKLEDIKARLKEVLKKLREESKRIIDELRRLLEEYKRLVKEIRDRIEEVRKRDHMVLHEYVNAAGITKVLKELVEELEKLVRDHNRVVEEVVRELVELLSRAVEVIKEVVK

SEQ ID NO: 14593 - protein, 240 aa, Artificial Sequence
  Synthetic sequence.
DKDKRLEELLKRLKELNDKTFEELERILEELKRANEASLREAERILEELRARIEGGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGRDHMVLHEYVNAAGITRDLLRLLEEDSRTNSEVVKRLLDLLREDSKANSEVVKRLLDVLRE

SEQ ID NO: 14594 - protein, 240 aa, Artificial Sequence
  Synthetic sequence.
SKEETLKRLLDELEKRNRETVERLERLLKELEDRNRASLEELEAVLEELERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIRDHMVLHEYVNAAGITRRLIEILRRDVELNLDVAKKLLELLKEDSKLNLDVARELLELLDR

SEQ ID NO: 14595 - protein, 240 aa, Artificial Sequence; identical to SEQ ID NO: 14594
  Synthetic sequence.

SEQ ID NO: 14596 - protein, 238 aa, Artificial Sequence
  Synthetic sequence.
EEDERLTKRVEEIKRENRELLRRLEEEVKELERKSEKIVRDLKEKVDRAKEKLDSGKGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGRDHMVLHEYVNAAGITLKLVEKLIRRNLRLLEELLRLVREILRTSNEILEEILKDARR

SEQ ID NO: 14597 - protein, 234 aa, Artificial Sequence
  Synthetic sequence.
SAKETIRKLIEENKDIIRKLAEKLKRLLEESERIAEEALRLIKELLERIERALRRVGSGIDEELLKELEKELARLEEELKEILDRVRDLHRRLAEEIRKILEESKKLNEELEDRLRKDGDVEELLELLERVHATDVRLLRELLKLLKKVHEDVVSLLERLLELLKRVLDRIVEELGLSDKRDHMVLHEYVNAAGITAKRLKELSDRLEEKIRKIKRELDDLSARLREKIERTRK

SEQ ID NO: 14598 - protein, 234 aa, Artificial Sequence; identical to SEQ ID NO: 14597
  Synthetic sequence.

SEQ ID NO: 14599 - protein, 238 aa, Artificial Sequence
  Synthetic sequence.
SEAEKIREALETNLRLLEELIKRLKEILDTHNELLRRVIETLERLLKELLELLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGRDHMVLHEYVNAAGITEDRLRRLLEKLARDSAELMRELERILDRYARESEELDRRLAE

SEQ ID NO: 14600 - protein, 238 aa, Artificial Sequence; identical to SEQ ID NO: 14599
  Synthetic sequence.

SEQ ID NO: 14601 - protein, 240 aa, Artificial Sequence
  Synthetic sequence.
SDKEEIKRRVEKTARDLETEHDKIKKRLEDTVRDIKRELDELLEKYERVLRKIEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDRDHMVLHEYVNAAGITDVVRRILEALAKLIKELLEALEEVLRRNKELIRELLRVLDEALK

SEQ ID NO: 14602 - protein, 240 aa, Artificial Sequence; identical to SEQ ID NO: 14601
  Synthetic sequence.

SEQ ID NO: 14603 - protein, 238 aa, Artificial Sequence
  Synthetic sequence.
DADELLRRLAEEVERVIREAEDLLRRWKETIKKVLDDLKRLLDELKKRNEDVIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRRDHMVLHEYVNAAGITLRKLLERLREILRENLEALKKTLKRLEDVVREILEDLKRERK

SEQ ID NO: 14604 - protein, 238 aa, Artificial Sequence; identical to SEQ ID NO: 14603
  Synthetic sequence.

SEQ ID NO: 14605 - protein, 231 aa, Artificial Sequence
  Synthetic sequence.
DKAEVLREALKLLKDLLEELIKIHEESLKRILDLIDTLVKVHEDALRALKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVPEEIDRDHMVLHEYVNAAGITIKERLDDVARRSEEELRRIIKKLKEVVKEIRKKLK

SEQ ID NO: 14606 - protein, 236 aa, Artificial Sequence
  Synthetic sequence.
STREKAKKVLDTLRADNEDMKRVVEKILRALKRTNERAEKLAREITEEIKRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPRDHMVLHEYVNAAGITKLRKALEELEREHRELEKELDKLHDESRKEHERIEEELRR

SEQ ID NO: 14607 - protein, 236 aa, Artificial Sequence; identical to SEQ ID NO: 14606
  Synthetic sequence.

SEQ ID NO: 14608 - protein, 239 aa, Artificial Sequence
  Synthetic sequence.
SERELIERWLELHKEILRLIRELVERLLKLHREILDTIKKLIRELLELLEDIARKLGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERTRDHMVLHEYVNAAGITILEKVERTLKKLLDDSARMAEEVKKTLKELLERSEKVAEDVRK

SEQ ID NO: 14609 - protein, 231 aa, Artificial Sequence
  Synthetic sequence.
SKEEEVEKVLRKWEEILRRLIEENKRANDKIRREYEELVKEIRRVLEEIKEVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDVVRRDHMVLHEYVNAAGITIRRILKVNTELMRVDERSIRESLKAISEVLKVLDT

SEQ ID NO: 14610 - protein, 231 aa, Artificial Sequence; identical to SEQ ID NO: 14609
  Synthetic sequence.

SEQ ID NO: 14611 - protein, 231 aa, Artificial Sequence
  Synthetic sequence.
SKDEELARLLEELVERWRKIVEDLERDHRRLVKEIRELVERIRKKLEELVDRIRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRRILRDHMVLHEYVNAAGITILKLLRDLTRRLAEVAKAVHKLLEELLRKLKEDTR

SEQ ID NO: 14612 - protein, 238 aa, Artificial Sequence
  Synthetic sequence.
SEIEDVIRRLRKILEDLERVSEKLLREIKKILDEARRLNEEVIKEIKRVLEDAVRVFRDGSGSKEELAKLVEELIRELAKLAKEVDEIHKRIVERLKALVEDAERIHRKIVETLEEIVRGVPSEELKRVVEAIVEVIKEHLKVLADVIRRIIKAIEENAETIKRVLEDIVRVLELVLRGERDHMVLHEYVNAAGITIEDSLRELEKTVRELLKRIKEASDKVREDVDRLIKELKEAAD

SEQ ID NO: 14613 - protein, 238 aa, Artificial Sequence; identical to SEQ ID NO: 14612
  Synthetic sequence.

SEQ ID NO: 14614 - protein, 237 aa, Artificial Sequence
  Synthetic sequence.
KEKEDALKKLEDLARKSREDLERVLRKHKKILDKIEELLKRVLDEHKKIVDDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEERDHMVLHEYVNAAGITKEILERIERAIDELLKVSEEILKLSEDASEELLKILREFAK

SEQ ID NO: 14615 - protein, 241 aa, Artificial Sequence
  Synthetic sequence.
SEKELLKEILDRIRELLEDDNRLLKRIVDEIRKLLEEWLRVHKEILERIKELLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDERDHMVLHEYVNAAGITLEDLARDTRRVIEEAKRLLKEWRDRNKEVADTLKKLLEDLIRKIR

SEQ ID NO: 14616 - protein, 241 aa, Artificial Sequence; identical to SEQ ID NO: 14615
  Synthetic sequence.

SEQ ID NO: 14617 - protein, 240 aa, Artificial Sequence
  Synthetic sequence.
DREKSVRDIEEDLKRVLDKLRRRVETSKEELKKVLKADKENADELEKTLRDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTRDHMVLHEYVNAAGITRLLDNLKENTDRLKEVIDRNLADLRDLAEELRAVIERLLEDARR

SEQ ID NO: 14618 - protein, 241 aa, Artificial Sequence
  Synthetic sequence.
SAEEAVEKLVRIARAIVKINEDLSREVVRILREIVRLNEETTRLLVEIAREVVKVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGRDHMVLHEYVNAAGITEKVLDDSAKELEKLKRELERLLEESRRKLEKLKRDLERVLEETRR

SEQ ID NO: 14619 - protein, 241 aa, Artificial Sequence; identical to SEQ ID NO: 14618
  Synthetic sequence.

SEQ ID NO: 14620 - protein, 237 aa, Artificial Sequence
  Synthetic sequence.
REDEVLRDIERLLREIEEKIRRILEESTAELRKVEEEVKRIIERTKRELKAIKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLRDHMVLHEYVNAAGITKALEKLARDLKEILRRHIEALKELARDLAEVIRKLLEDVKR

SEQ ID NO: 14621 - protein, 239 aa, Artificial Sequence
  Synthetic sequence.
SAEDLVRRVKDLVDKLEDKLRKVVRTNERLWEEIRKRLEELVRRNKELWDALVEKLKAGDKDKDELIEEAKSLEDESNALVEKLVRDIERVLAESNKLLDTLAKEIEEVLEEIVELVERGSGSDKEAREKLEDIKARLKEVLKKLREESKRIIDELRRLLEEYKRLVKEIRDRIEEVRKRRDHMVLHEYVNAAGITVLKELVEELEKLVRDHNRVVEEVVRELVELLSRAVEVIKEVVK

SEQ ID NO: 14622 - protein, 240 aa, Artificial Sequence
  Synthetic sequence.
DKDKRLEELLKRLKELNDKTFEELERILEELKRANEASLREAERILEELRARIEGGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSRDHMVLHEYVNAAGITDLLRLLEEDSRTNSEVVKRLLDLLREDSKANSEVVKRLLDVLRE

SEQ ID NO: 14623 - protein, 240 aa, Artificial Sequence
  Synthetic sequence.
SKEETLKRLLDELEKRNRETVERLERLLKELEDRNRASLEELEAVLEELERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGRDHMVLHEYVNAAGITRLIEILRRDVELNLDVAKKLLELLKEDSKLNLDVARELLELLDR

SEQ ID NO: 14624 - protein, 241 aa, Artificial Sequence
  Synthetic sequence.
SADEALEELVRRLLEVLKTVLERTKELSRDDLRVVKEVLRIIEELVKRLLKVIRDGLDDADRVLEEVERVIREAKREVKRWEEVVRKVVEDSRRLIERVLAEVEEVIKEAKRLLDERKSGGSREVIEELLSLLREIVRHHKEVSDEHLKLSAELVKRILDVVEETLRLATEIVRRIKEGGRDHMVLHEYVNAAGITKRRVERLLEDIERLLAELEKLNEDVLRENKALLEDLERRVRERKK

SEQ ID NO: 14625 - protein, 239 aa, Artificial Sequence
  Synthetic sequence.
SDEELLERVERLLRELLDTNRRMLEEVEKELRRLLETNKKTLDDVRRLLKELLDVLETRGVKDEKRLRDIRRRLEEVVRRLDKLHRDIAEDLKRVKERLDRLHERIKRRLEEVVKELRDLKDRGVDERKVLERAAEVLRELLELLRESLEEIERIIRRLLELHKRSTEEAARALEELLRGLRDHMVLHEYVNAAGITLKEDKERLEKIARDIERDLERYARDLKRLEDELREDIERARR

SEQ ID NO: 14626 - protein, 239 aa, Artificial Sequence; identical to SEQ ID NO: 14625
  Synthetic sequence.

SEQ ID NO: 14627 - protein, 238 aa, Artificial Sequence
  Synthetic sequence.
SEAEKIREALETNLRLLEELIKRLKEILDTHNELLRRVIETLERLLKELLELLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGARDHMVLHEYVNAAGITDRLRRLLEKLARDSAELMRELERILDRYARESEELDRRLAE

SEQ ID NO: 14628 - protein, 238 aa, Artificial Sequence; identical to SEQ ID NO: 14627
  Synthetic sequence.

SEQ ID NO: 14629 - protein, 242 aa, Artificial Sequence
  Synthetic sequence.
SEKERLMRLLDKLKDLNRRLVERIKELLDKALELHKKLVKELRELLERLKELVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNRDHMVLHEYVNAAGITEDDLRKIERDAEREYKKLKDELEELTERYRREIRKLKEELKADRK

SEQ ID NO: 14630 - protein, 242 aa, Artificial Sequence; identical to SEQ ID NO: 14629
  Synthetic sequence.

SEQ ID NO: 14631 - protein, 238 aa, Artificial Sequence
  Synthetic sequence.
DADELLRRLAEEVERVIREAEDLLRRWKETIKKVLDDLKRLLDELKKRNEDVIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRDHMVLHEYVNAAGITRKLLERLREILRENLEALKKTLKRLEDVVREILEDLKRERK

SEQ ID NO: 14632 - protein, 238 aa, Artificial Sequence; identical to SEQ ID NO: 14631
  Synthetic sequence.

SEQ ID NO: 14633 - protein, 236 aa, Artificial Sequence
  Synthetic sequence.
STREKAKKVLDTLRADNEDMKRVVEKILRALKRTNERAEKLAREITEEIKRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPERDHMVLHEYVNAAGITLRKALEELEREHRELEKELDKLHDESRKEHERIEEELRR

SEQ ID NO: 14634 - protein, 239 aa, Artificial Sequence
  Synthetic sequence.
SERELIERWLELHKEILRLIRELVERLLKLHREILDTIKKLIRELLELLEDIARKLGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERTDRDHMVLHEYVNAAGITLEKVERTLKKLLDDSARMAEEVKKTLKELLERSEKVAEDVRK

SEQ ID NO: 14635 - protein, 237 aa, Artificial Sequence
  Synthetic sequence.
KEKEDALKKLEDLARKSREDLERVLRKHKKILDKIEELLKRVLDEHKKIVDDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELRDHMVLHEYVNAAGITEILERIERAIDELLKVSEEILKLSEDASEELLKILREFAK

SEQ ID NO: 14636 - protein, 237 aa, Artificial Sequence; identical to SEQ ID NO: 14635
  Synthetic sequence.

SEQ ID NO: 14637 - protein, 241 aa, Artificial Sequence
  Synthetic sequence.
SEKELLKEILDRIRELLEDDNRLLKRIVDEIRKLLEEWLRVHKEILERIKELLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDRDHMVLHEYVNAAGITEDLARDTRRVIEEAKRLLKEWRDRNKEVADTLKKLLEDLIRKIR

SEQ ID NO: 14638 - protein, 240 aa, Artificial Sequence
  Synthetic sequence.
DREKSVRDIEEDLKRVLDKLRRRVETSKEELKKVLKADKENADELEKTLRDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGRDHMVLHEYVNAAGITLLDNLKENTDRLKEVIDRNLADLRDLAEELRAVIERLLEDARR

SEQ ID NO: 14639 - protein, 241 aa, Artificial Sequence
  Synthetic sequence.
SAEEAVEKLVRIARAIVKINEDLSREVVRILREIVRLNEETTRLLVEIAREVVKVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVRDHMVLHEYVNAAGITKVLDDSAKELEKLKRELERLLEESRRKLEKLKRDLERVLEETRR

SEQ ID NO: 14640 - protein, 241 aa, Artificial Sequence; identical to SEQ ID NO: 14639
  Synthetic sequence.

SEQ ID NO: 14641 - protein, 239 aa, Artificial Sequence
  Synthetic sequence.
SAEDLVRRVKDLVDKLEDKLRKVVRTNERLWEEIRKRLEELVRRNKELWDALVEKLKAGDKDKDELIEEAKSLEDESNALVEKLVRDIERVLAESNKLLDTLAKEIEEVLEEIVELVERGSGSDKEAREKLEDIKARLKEVLKKLREESKRIIDELRRLLEEYKRLVKEIRDRIEEVRKRNRDHMVLHEYVNAAGITLKELVEELEKLVRDHNRVVEEVVRELVELLSRAVEVIKEVVK

SEQ ID NO: 14642 - protein, 239 aa, Artificial Sequence; identical to SEQ ID NO: 14641
  Synthetic sequence.

SEQ ID NO: 14643 - protein, 240 aa, Artificial Sequence
  Synthetic sequence.
DKDKRLEELLKRLKELNDKTFEELERILEELKRANEASLREAERILEELRARIEGGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDRDHMVLHEYVNAAGITLLRLLEEDSRTNSEVVKRLLDLLREDSKANSEVVKRLLDVLRE

SEQ ID NO: 14644 - protein, 240 aa, Artificial Sequence
  Synthetic sequence.
SKEETLKRLLDELEKRNRETVERLERLLKELEDRNRASLEELEAVLEELERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSRDHMVLHEYVNAAGITLIEILRRDVELNLDVAKKLLELLKEDSKLNLDVARELLELLDR

SEQ ID NO: 14645 - protein, 240 aa, Artificial Sequence; identical to SEQ ID NO: 14644
  Synthetic sequence.

SEQ ID NO: 14646 - protein, 239 aa, Artificial Sequence
  Synthetic sequence.
SDEELLERVERLLRELLDTNRRMLEEVEKELRRLLETNKKTLDDVRRLLKELLDVLETRGVKDEKRLRDIRRRLEEVVRRLDKLHRDIAEDLKRVKERLDRLHERIKRRLEEVVKELRDLKDRGVDERKVLERAAEVLRELLELLRESLEEIERIIRRLLELHKRSTEEAARALEELLRGLERDHMVLHEYVNAAGITKEDKERLEKIARDIERDLERYARDLKRLEDELREDIERARR

SEQ ID NO: 14647 - protein, 239 aa, Artificial Sequence; identical to SEQ ID NO: 14646
  Synthetic sequence.

SEQ ID NO: 14648 - protein, 238 aa, Artificial Sequence
  Synthetic sequence.
EEDERLTKRVEEIKRENRELLRRLEEEVKELERKSEKIVRDLKEKVDRAKEKLDSGKGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDRDHMVLHEYVNAAGITLVEKLIRRNLRLLEELLRLVREILRTSNEILEEILKDARR

SEQ ID NO: 14649 - protein, 238 aa, Artificial Sequence
  Synthetic sequence.
SEAEKIREALETNLRLLEELIKRLKEILDTHNELLRRVIETLERLLKELLELLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPRDHMVLHEYVNAAGITRLRRLLEKLARDSAELMRELERILDRYARESEELDRRLAE

SEQ ID NO: 14650 - protein, 238 aa, Artificial Sequence; identical to SEQ ID NO: 14649
  Synthetic sequence.

SEQ ID NO: 14651 - protein, 242 aa, Artificial Sequence
  Synthetic sequence.
SEKERLMRLLDKLKDLNRRLVERIKELLDKALELHKKLVKELRELLERLKELVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVRDHMVLHEYVNAAGITDDLRKIERDAEREYKKLKDELEELTERYRREIRKLKEELKADRK

SEQ ID NO: 14652 - protein, 242 aa, Artificial Sequence; identical to SEQ ID NO: 14651
  Synthetic sequence.

SEQ ID NO: 14653 - protein, 240 aa, Artificial Sequence
  Synthetic sequence.
SDKEEIKRRVEKTARDLETEHDKIKKRLEDTVRDIKRELDELLEKYERVLRKIEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRDHMVLHEYVNAAGITVRRILEALAKLIKELLEALEEVLRRNKELIRELLRVLDEALK

SEQ ID NO: 14654 - protein, 240 aa, Artificial Sequence; identical to SEQ ID NO: 14653
  Synthetic sequence.

SEQ ID NO: 14655 - protein, 238 aa, Artificial Sequence
  Synthetic sequence.
DADELLRRLAEEVERVIREAEDLLRRWKETIKKVLDDLKRLLDELKKRNEDVIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRRDHMVLHEYVNAAGITKLLERLREILRENLEALKKTLKRLEDVVREILEDLKRERK

SEQ ID NO: 14656 - protein, 236 aa, Artificial Sequence
  Synthetic sequence.
STREKAKKVLDTLRADNEDMKRVVEKILRALKRTNERAEKLAREITEEIKRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDRDHMVLHEYVNAAGITRKALEELEREHRELEKELDKLHDESRKEHERIEEELRR

SEQ ID NO: 14657 - protein, 236 aa, Artificial Sequence; identical to SEQ ID NO: 14656
  Synthetic sequence.

SEQ ID NO: 14658 - protein, 243 aa, Artificial Sequence
  Synthetic sequence.
DLERVVEDIVDKAKRLLDKNLEVLKRIVDEVLRLLERLLRESRKVVKRVKEIIEELVRDEKELRRVKRALEEVLRRHEEIAKELKERLRKVAKEAEEKHKKLVEDLKRVVDEVRKKLSGPLDREKVLEVLDELVTIIAKLLDENIKVLEEVIRVIAELLERLLDSHRRLIDIIAKLLEGLRPRDHMVLHEYVNAAGITKRDSEKVVDDLKKELERIKREVKRLIEENARTLADIKRAVDEARK

SEQ ID NO: 14659 - protein, 239 aa, Artificial Sequence
  Synthetic sequence.
SERELIERWLELHKEILRLIRELVERLLKLHREILDTIKKLIRELLELLEDIARKLGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERTDDRDHMVLHEYVNAAGITEKVERTLKKLLDDSARMAEEVKKTLKELLERSEKVAEDVRK

SEQ ID NO: 14660 - protein, 238 aa, Artificial Sequence
  Synthetic sequence.
SEIEDVIRRLRKILEDLERVSEKLLREIKKILDEARRLNEEVIKEIKRVLEDAVRVFRDGSGSKEELAKLVEELIRELAKLAKEVDEIHKRIVERLKALVEDAERIHRKIVETLEEIVRGVPSEELKRVVEAIVEVIKEHLKVLADVIRRIIKAIEENAETIKRVLEDIVRVLELVLRGEGSRDHMVLHEYVNAAGITDSLRELEKTVRELLKRIKEASDKVREDVDRLIKELKEAAD

SEQ ID NO: 14661 - protein, 237 aa, Artificial Sequence
  Synthetic sequence.
KEKEDALKKLEDLARKSREDLERVLRKHKKILDKIEELLKRVLDEHKKIVDDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELARDHMVLHEYVNAAGITILERIERAIDELLKVSEEILKLSEDASEELLKILREFAK

SEQ ID NO: 14662 - protein, 241 aa, Artificial Sequence
  Synthetic sequence.
SEKELLKEILDRIRELLEDDNRLLKRIVDEIRKLLEEWLRVHKEILERIKELLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDARDHMVLHEYVNAAGITDLARDTRRVIEEAKRLLKEWRDRNKEVADTLKKLLEDLIRKIR

SEQ ID NO: 14663 - protein, 240 aa, Artificial Sequence
  Synthetic sequence.
DREKSVRDIEEDLKRVLDKLRRRVETSKEELKKVLKADKENADELEKTLRDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIRDHMVLHEYVNAAGITLDNLKENTDRLKEVIDRNLADLRDLAEELRAVIERLLEDARR

SEQ ID NO: 14664 - protein, 240 aa, Artificial Sequence; identical to SEQ ID NO: 14663
  Synthetic sequence.

SEQ ID NO: 14665 - protein, 241 aa, Artificial Sequence
  Synthetic sequence.
SAEEAVEKLVRIARAIVKINEDLSREVVRILREIVRLNEETTRLLVEIAREVVKVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVSRDHMVLHEYVNAAGITVLDDSAKELEKLKRELERLLEESRRKLEKLKRDLERVLEETRR

SEQ ID NO: 14666 - protein, 241 aa, Artificial Sequence; identical to SEQ ID NO: 14665
  Synthetic sequence.

SEQ ID NO: 14667 - protein, 237 aa, Artificial Sequence
  Synthetic sequence.
REDEVLRDIERLLREIEEKIRRILEESTAELRKVEEEVKRIIERTKRELKAIKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDERDHMVLHEYVNAAGITLEKLARDLKEILRRHIEALKELARDLAEVIRKLLEDVKR

SEQ ID NO: 14668 - protein, 237 aa, Artificial Sequence; identical to SEQ ID NO: 14667
  Synthetic sequence.

SEQ ID NO: 14669 - protein, 243 aa, Artificial Sequence
  Synthetic sequence.
SEAERLADEVRKAVKKSEEDNETLVREVEKAVRELKKNNKTWVDEVRKLMKRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGRDHMVLHEYVNAAGITLEIIEELVRLNNEILERLLKIVRELHKDNIKILEDLLRIIEEVLR

SEQ ID NO: 14670 - protein, 243 aa, Artificial Sequence; identical to SEQ ID NO: 14669
  Synthetic sequence.

SEQ ID NO: 14671 - protein, 239 aa, Artificial Sequence
  Synthetic sequence.
SAEDLVRRVKDLVDKLEDKLRKVVRTNERLWEEIRKRLEELVRRNKELWDALVEKLKAGDKDKDELIEEAKSLEDESNALVEKLVRDIERVLAESNKLLDTLAKEIEEVLEEIVELVERGSGSDKEAREKLEDIKARLKEVLKKLREESKRIIDELRRLLEEYKRLVKEIRDRIEEVRKRNSRDHMVLHEYVNAAGITKELVEELEKLVRDHNRVVEEVVRELVELLSRAVEVIKEVVK

SEQ ID NO: 14672 - protein, 243 aa, Artificial Sequence
  Synthetic sequence.
SRVEELKKLIEDILRISREVVERIARVAEDIHRINRRVLDDLRKLIEDILRTVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRDHMVLHEYVNAAGITKEDLDRILEEYRRLLEEIKRKLEEILRRVEELHRRLRRKLEEIDR

SEQ ID NO: 14673 - protein, 243 aa, Artificial Sequence; identical to SEQ ID NO: 14672
  Synthetic sequence.

SEQ ID NO: 14674 - protein, 240 aa, Artificial Sequence
  Synthetic sequence.
DKDKRLEELLKRLKELNDKTFEELERILEELKRANEASLREAERILEELRARIEGGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKRDHMVLHEYVNAAGITLRLLEEDSRTNSEVVKRLLDLLREDSKANSEVVKRLLDVLRE

SEQ ID NO: 14675 - protein, 240 aa, Artificial Sequence
  Synthetic sequence.
SKEETLKRLLDELEKRNRETVERLERLLKELEDRNRASLEELEAVLEELERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSERDHMVLHEYVNAAGITIEILRRDVELNLDVAKKLLELLKEDSKLNLDVARELLELLDR

SEQ ID NO: 14676 - protein, 240 aa, Artificial Sequence; identical to SEQ ID NO: 14675
  Synthetic sequence.

SEQ ID NO: 14677 - protein, 243 aa, Artificial Sequence
  Synthetic sequence.
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDERDHMVLHEYVNAAGITLRELNEITKDLEAKLEKLLRDLNELTKALEEELKRLLDELKKRTD

SEQ ID NO: 14678 - protein, 243 aa, Artificial Sequence; identical to SEQ ID NO: 14677
  Synthetic sequence.

SEQ ID NO: 14679 - protein, 243 aa, Artificial Sequence
  Synthetic sequence.
SEAERTKESLKKVLKALVDLNRELLRKLEENMRELTKLNEEVKRALKEVLDKVREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRDHMVLHEYVNAAGITKELADRYREEVRKSKDKLRSILEDYKRKVDELKERLRELIEEVET

SEQ ID NO: 14680 - protein, 243 aa, Artificial Sequence; identical to SEQ ID NO: 14679
  Synthetic sequence.

SEQ ID NO: 14681 - protein, 238 aa, Artificial Sequence
  Synthetic sequence.
EEDERLTKRVEEIKRENRELLRRLEEEVKELERKSEKIVRDLKEKVDRAKEKLDSGKGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKRDHMVLHEYVNAAGITVEKLIRRNLRLLEELLRLVREILRTSNEILEEILKDARR

SEQ ID NO: 14682 - protein, 234 aa, Artificial Sequence
  Synthetic sequence.
SAKETIRKLIEENKDIIRKLAEKLKRLLEESERIAEEALRLIKELLERIERALRRVGSGIDEELLKELEKELARLEEELKEILDRVRDLHRRLAEEIRKILEESKKLNEELEDRLRKDGDVEELLELLERVHATDVRLLRELLKLLKKVHEDVVSLLERLLELLKRVLDRIVEELGLSDKELERDHMVLHEYVNAAGITLKELSDRLEEKIRKIKRELDDLSARLREKIERTRK

SEQ ID NO: 14683 - protein, 234 aa, Artificial Sequence; identical to SEQ ID NO: 14682
  Synthetic sequence.

SEQ ID NO: 14684 - protein, 238 aa, Artificial Sequence
  Synthetic sequence.
SKEDKARELEKRLRDNLKKLEEVVRELAEVLKRNLEKLRRLAEELLRALKRLLDKLRAGGLPKDELEDLRREVEDVLRRLEDLLRKLKKANDESLTRLEELLRRAEEENRRVLTTLRELLRGNGDDRDLARLVARLVEANNRALEELLRLVAKNVEDNNRVLEELLRLVKELAKRLLGRIRDERDHMVLHEYVNAAGITARKILRDDERDLRALEKRIRDIIREDREELERLKERARK

SEQ ID NO: 14685 - protein, 243 aa, Artificial Sequence
  Synthetic sequence.
KREDILKKLEDIIRDIIDKLRRILEKVKRLNEDIIREIKRLLDESLKTLEDLLKRIADKSRDRELEDILRRVLEKLRRSLDKLRDTLRKLKEETDTVLERAERTLKELKDRLEKLLRDGEKVSEEDLVEALKALIDELRKVLEDVIRVSKELVERLLRALREHLETNKRLVKELLDALRKTTGRDHMVLHEYVNAAGITRRLEEEVERVARELEKAHRDLERDIRRVAEELKKLLKKLRDDRR

SEQ ID NO: 14686 - protein, 244 aa, Artificial Sequence
  Synthetic sequence.
SAEETLRRITEESKRVLEEITKKYEDLERESREVLRKLREDLDRIKRELEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDERDHMVLHEYVNAAGITIRVLEEILKINEELNRKIIKFARENLERNRRVNKKVIEVLREAAR

SEQ ID NO: 14687 - protein, 238 aa, Artificial Sequence
  Synthetic sequence.
SEAEKIREALETNLRLLEELIKRLKEILDTHNELLRRVIETLERLLKELLELLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKRDHMVLHEYVNAAGITLRRLLEKLARDSAELMRELERILDRYARESEELDRRLAE

SEQ ID NO: 14688 - protein, 238 aa, Artificial Sequence; identical to SEQ ID NO: 14687
  Synthetic sequence.

SEQ ID NO: 14689 - protein, 242 aa, Artificial Sequence
  Synthetic sequence.
SEKERLMRLLDKLKDLNRRLVERIKELLDKALELHKKLVKELRELLERLKELVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSRDHMVLHEYVNAAGITDLRKIERDAEREYKKLKDELEELTERYRREIRKLKEELKADRK

SEQ ID NO: 14690 - protein, 242 aa, Artificial Sequence; identical to SEQ ID NO: 14689
  Synthetic sequence.

SEQ ID NO: 14691 - protein, 240 aa, Artificial Sequence
  Synthetic sequence.
SDKEEIKRRVEKTARDLETEHDKIKKRLEDTVRDIKRELDELLEKYERVLRKIEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRRDHMVLHEYVNAAGITRRILEALAKLIKELLEALEEVLRRNKELIRELLRVLDEALK

SEQ ID NO: 14692 - protein, 238 aa, Artificial Sequence
  Synthetic sequence.
DADELLRRLAEEVERVIREAEDLLRRWKETIKKVLDDLKRLLDELKKRNEDVIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKRDHMVLHEYVNAAGITLLERLREILRENLEALKKTLKRLEDVVREILEDLKRERK

SEQ ID NO: 14693 - protein, 236 aa, Artificial Sequence
  Synthetic sequence.
STREKAKKVLDTLRADNEDMKRVVEKILRALKRTNERAEKLAREITEEIKRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDLRDHMVLHEYVNAAGITKALEELEREHRELEKELDKLHDESRKEHERIEEELRR

SEQ ID NO: 14694 - protein, 236 aa, Artificial Sequence; identical to SEQ ID NO: 14693
  Synthetic sequence.

SEQ ID NO: 14695 - protein, 243 aa, Artificial Sequence
  Synthetic sequence.
DLERVVEDIVDKAKRLLDKNLEVLKRIVDEVLRLLERLLRESRKVVKRVKEIIEELVRDEKELRRVKRALEEVLRRHEEIAKELKERLRKVAKEAEEKHKKLVEDLKRVVDEVRKKLSGPLDREKVLEVLDELVTIIAKLLDENIKVLEEVIRVIAELLERLLDSHRRLIDIIAKLLEGLRPGRDHMVLHEYVNAAGITRDSEKVVDDLKKELERIKREVKRLIEENARTLADIKRAVDEARK

SEQ ID NO: 14696 - protein, 243 aa, Artificial Sequence; identical to SEQ ID NO: 14695
  Synthetic sequence.

SEQ ID NO: 14697 - protein, 239 aa, Artificial Sequence
  Synthetic sequence.
SERELIERWLELHKEILRLIRELVERLLKLHREILDTIKKLIRELLELLEDIARKLGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERTDDERDHMVLHEYVNAAGITKVERTLKKLLDDSARMAEEVKKTLKELLERSEKVAEDVRK

SEQ ID NO: 14698 - protein, 237 aa, Artificial Sequence
  Synthetic sequence.
KEKEDALKKLEDLARKSREDLERVLRKHKKILDKIEELLKRVLDEHKKIVDDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELARRDHMVLHEYVNAAGITLERIERAIDELLKVSEEILKLSEDASEELLKILREFAK

SEQ ID NO: 14699 - protein, 241 aa, Artificial Sequence
  Synthetic sequence.
SEKELLKEILDRIRELLEDDNRLLKRIVDEIRKLLEEWLRVHKEILERIKELLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRDHMVLHEYVNAAGITLARDTRRVIEEAKRLLKEWRDRNKEVADTLKKLLEDLIRKIR

SEQ ID NO: 14700 - protein, 241 aa, Artificial Sequence; identical to SEQ ID NO: 14699
  Synthetic sequence.

SEQ ID NO: 14701 - protein, 240 aa, Artificial Sequence
  Synthetic sequence.
DREKSVRDIEEDLKRVLDKLRRRVETSKEELKKVLKADKENADELEKTLRDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKRDHMVLHEYVNAAGITDNLKENTDRLKEVIDRNLADLRDLAEELRAVIERLLEDARR

SEQ ID NO: 14702 - protein, 241 aa, Artificial Sequence
  Synthetic sequence.
SAEEAVEKLVRIARAIVKINEDLSREVVRILREIVRLNEETTRLLVEIAREVVKVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVSERDHMVLHEYVNAAGITLDDSAKELEKLKRELERLLEESRRKLEKLKRDLERVLEETRR

SEQ ID NO: 14703 - protein, 241 aa, Artificial Sequence; identical to SEQ ID NO: 14702
  Synthetic sequence.

SEQ ID NO: 14704 - protein, 237 aa, Artificial Sequence
  Synthetic sequence.
REDEVLRDIERLLREIEEKIRRILEESTAELRKVEEEVKRIIERTKRELKAIKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDRDHMVLHEYVNAAGITEKLARDLKEILRRHIEALKELARDLAEVIRKLLEDVKR

SEQ ID NO: 14705 - protein, 237 aa, Artificial Sequence; identical to SEQ ID NO: 14704
  Synthetic sequence.

SEQ ID NO: 14706 - protein, 243 aa, Artificial Sequence
  Synthetic sequence.
SEAERLADEVRKAVKKSEEDNETLVREVEKAVRELKKNNKTWVDEVRKLMKRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKRDHMVLHEYVNAAGITEIIEELVRLNNEILERLLKIVRELHKDNIKILEDLLRIIEEVLR

SEQ ID NO: 14707 - protein, 243 aa, Artificial Sequence; identical to SEQ ID NO: 14706
  Synthetic sequence.

SEQ ID NO: 14708 - protein, 243 aa, Artificial Sequence
  Synthetic sequence.
SRVEELKKLIEDILRISREVVERIARVAEDIHRINRRVLDDLRKLIEDILRTVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRRDHMVLHEYVNAAGITEDLDRILEEYRRLLEEIKRKLEEILRRVEELHRRLRRKLEEIDR

SEQ ID NO: 14709 - protein, 243 aa, Artificial Sequence; identical to SEQ ID NO: 14708
  Synthetic sequence.

SEQ ID NO: 14710 - protein, 240 aa, Artificial Sequence
  Synthetic sequence.
SKEETLKRLLDELEKRNRETVERLERLLKELEDRNRASLEELEAVLEELERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEERDHMVLHEYVNAAGITEILRRDVELNLDVAKKLLELLKEDSKLNLDVARELLELLDR

SEQ ID NO: 14711 - protein, 240 aa, Artificial Sequence; identical to SEQ ID NO: 14710
  Synthetic sequence.

SEQ ID NO: 14712 - protein, 243 aa, Artificial Sequence
  Synthetic sequence.
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESRDHMVLHEYVNAAGITRELNEITKDLEAKLEKLLRDLNELTKALEEELKRLLDELKKRTD

SEQ ID NO: 14713 - protein, 243 aa, Artificial Sequence; identical to SEQ ID NO: 14712
  Synthetic sequence.

SEQ ID NO: 14714 - protein, 243 aa, Artificial Sequence
  Synthetic sequence.
SEAERTKESLKKVLKALVDLNRELLRKLEENMRELTKLNEEVKRALKEVLDKVREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRRDHMVLHEYVNAAGITELADRYREEVRKSKDKLRSILEDYKRKVDELKERLRELIEEVET

SEQ ID NO: 14715 - protein, 243 aa, Artificial Sequence; identical to SEQ ID NO: 14714
  Synthetic sequence.

SEQ ID NO: 14716 - protein, 241 aa, Artificial Sequence
  Synthetic sequence.
SADEALEELVRRLLEVLKTVLERTKELSRDDLRVVKEVLRIIEELVKRLLKVIRDGLDDADRVLEEVERVIREAKREVKRWEEVVRKVVEDSRRLIERVLAEVEEVIKEAKRLLDERKSGGSREVIEELLSLLREIVRHHKEVSDEHLKLSAELVKRILDVVEETLRLATEIVRRIKEGGNSERDHMVLHEYVNAAGITVERLLEDIERLLAELEKLNEDVLRENKALLEDLERRVRERKK

SEQ ID NO: 14717 - protein, 241 aa, Artificial Sequence; identical to SEQ ID NO: 14716
  Synthetic sequence.

SEQ ID NO: 14718 - protein, 239 aa, Artificial Sequence
  Synthetic sequence.
SDEELLERVERLLRELLDTNRRMLEEVEKELRRLLETNKKTLDDVRRLLKELLDVLETRGVKDEKRLRDIRRRLEEVVRRLDKLHRDIAEDLKRVKERLDRLHERIKRRLEEVVKELRDLKDRGVDERKVLERAAEVLRELLELLRESLEEIERIIRRLLELHKRSTEEAARALEELLRGLEGSRDHMVLHEYVNAAGITDKERLEKIARDIERDLERYARDLKRLEDELREDIERARR

SEQ ID NO: 14719 - protein, 245 aa, Artificial Sequence
  Synthetic sequence.
TEEEVLRKVEKLIKDLLDVLRDLLRASEEVVREALRVLEELIEENKRVIEELSRALSGGSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGRDHMVLHEYVNAAGITEKRHEDLRRELEKLLRDYKRELEEIERALEEIEKTLKRRADETRR

SEQ ID NO: 14720 - protein, 238 aa, Artificial Sequence
  Synthetic sequence.
SKEDKARELEKRLRDNLKKLEEVVRELAEVLKRNLEKLRRLAEELLRALKRLLDKLRAGGLPKDELEDLRREVEDVLRRLEDLLRKLKKANDESLTRLEELLRRAEEENRRVLTTLRELLRGNGDDRDLARLVARLVEANNRALEELLRLVAKNVEDNNRVLEELLRLVKELAKRLLGRIRDEDRDHMVLHEYVNAAGITRKILRDDERDLRALEKRIRDIIREDREELERLKERARK

SEQ ID NO: 14721 - protein, 243 aa, Artificial Sequence
  Synthetic sequence.
KREDILKKLEDIIRDIIDKLRRILEKVKRLNEDIIREIKRLLDESLKTLEDLLKRIADKSRDRELEDILRRVLEKLRRSLDKLRDTLRKLKEETDTVLERAERTLKELKDRLEKLLRDGEKVSEEDLVEALKALIDELRKVLEDVIRVSKELVERLLRALREHLETNKRLVKELLDALRKTTGDRDHMVLHEYVNAAGITRLEEEVERVARELEKAHRDLERDIRRVAEELKKLLKKLRDDRR

SEQ ID NO: 14722 - protein, 243 aa, Artificial Sequence; identical to SEQ ID NO: 14721
  Synthetic sequence.

SEQ ID NO: 14723 - protein, 244 aa, Artificial Sequence
  Synthetic sequence.
SAEETLRRITEESKRVLEEITKKYEDLERESREVLRKLREDLDRIKRELEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRDHMVLHEYVNAAGITRVLEEILKINEELNRKIIKFARENLERNRRVNKKVIEVLREAAR

SEQ ID NO: 14724 - protein, 238 aa, Artificial Sequence
  Synthetic sequence.
SEAEKIREALETNLRLLEELIKRLKEILDTHNELLRRVIETLERLLKELLELLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKERDHMVLHEYVNAAGITRRLLEKLARDSAELMRELERILDRYARESEELDRRLAE

SEQ ID NO: 14725 - protein, 238 aa, Artificial Sequence; identical to SEQ ID NO: 14724
  Synthetic sequence.

SEQ ID NO: 14726 - protein, 242 aa, Artificial Sequence
  Synthetic sequence.
SEKERLMRLLDKLKDLNRRLVERIKELLDKALELHKKLVKELRELLERLKELVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSERDHMVLHEYVNAAGITLRKIERDAEREYKKLKDELEELTERYRREIRKLKEELKADRK

SEQ ID NO: 14727 - protein, 242 aa, Artificial Sequence; identical to SEQ ID NO: 14726
  Synthetic sequence.

SEQ ID NO: 14728 - protein, 240 aa, Artificial Sequence
  Synthetic sequence.
SDKEEIKRRVEKTARDLETEHDKIKKRLEDTVRDIKRELDELLEKYERVLRKIEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLRDHMVLHEYVNAAGITRILEALAKLIKELLEALEEVLRRNKELIRELLRVLDEALK

SEQ ID NO: 14729 - protein, 238 aa, Artificial Sequence
  Synthetic sequence.
DADELLRRLAEEVERVIREAEDLLRRWKETIKKVLDDLKRLLDELKKRNEDVIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKDRDHMVLHEYVNAAGITLERLREILRENLEALKKTLKRLEDVVREILEDLKRERK

SEQ ID NO: 14730 - protein, 236 aa, Artificial Sequence
  Synthetic sequence.
STREKAKKVLDTLRADNEDMKRVVEKILRALKRTNERAEKLAREITEEIKRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDLLRDHMVLHEYVNAAGITALEELEREHRELEKELDKLHDESRKEHERIEEELRR

SEQ ID NO: 14731 - protein, 239 aa, Artificial Sequence
  Synthetic sequence.
SERELIERWLELHKEILRLIRELVERLLKLHREILDTIKKLIRELLELLEDIARKLGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERTDDERRDHMVLHEYVNAAGITVERTLKKLLDDSARMAEEVKKTLKELLERSEKVAEDVRK

SEQ ID NO: 14732 - protein, 241 aa, Artificial Sequence
  Synthetic sequence.
SEKELLKEILDRIRELLEDDNRLLKRIVDEIRKLLEEWLRVHKEILERIKELLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRRDHMVLHEYVNAAGITARDTRRVIEEAKRLLKEWRDRNKEVADTLKKLLEDLIRKIR

SEQ ID NO: 14733 - protein, 241 aa, Artificial Sequence; identical to SEQ ID NO: 14732
  Synthetic sequence.

SEQ ID NO: 14734 - protein, 237 aa, Artificial Sequence
  Synthetic sequence.
REDEVLRDIERLLREIEEKIRRILEESTAELRKVEEEVKRIIERTKRELKAIKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLRDHMVLHEYVNAAGITKLARDLKEILRRHIEALKELARDLAEVIRKLLEDVKR

SEQ ID NO: 14735 - protein, 237 aa, Artificial Sequence; identical to SEQ ID NO: 14734
  Synthetic sequence.

SEQ ID NO: 14736 - protein, 245 aa, Artificial Sequence
  Synthetic sequence.
SEKDEVTRRIRELLKEAEETNREAIERIKRLLDRVREAVEEVAKRSEELLRRLKKVLDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRRDHMVLHEYVNAAGITAESLRLIRELLKEIEKIVKEIIELLERLNDELRKIIEAILETTKK

SEQ ID NO: 14737 - protein, 243 aa, Artificial Sequence
  Synthetic sequence.
SRVEELKKLIEDILRISREVVERIARVAEDIHRINRRVLDDLRKLIEDILRTVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGRDHMVLHEYVNAAGITDLDRILEEYRRLLEEIKRKLEEILRRVEELHRRLRRKLEEIDR

SEQ ID NO: 14738 - protein, 243 aa, Artificial Sequence; identical to SEQ ID NO: 14737
  Synthetic sequence.

SEQ ID NO: 14739 - protein, 243 aa, Artificial Sequence
  Synthetic sequence.
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSRDHMVLHEYVNAAGITELNEITKDLEAKLEKLLRDLNELTKALEEELKRLLDELKKRTD

SEQ ID NO: 14740 - protein, 243 aa, Artificial Sequence; identical to SEQ ID NO: 14739
  Synthetic sequence.

SEQ ID NO: 14741 - protein, 243 aa, Artificial Sequence
  Synthetic sequence.
SEAERTKESLKKVLKALVDLNRELLRKLEENMRELTKLNEEVKRALKEVLDKVREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTRDHMVLHEYVNAAGITLADRYREEVRKSKDKLRSILEDYKRKVDELKERLRELIEEVET

SEQ ID NO: 14742 - protein, 243 aa, Artificial Sequence; identical to SEQ ID NO: 14741
  Synthetic sequence.

SEQ ID NO: 14743 - protein, 238 aa, Artificial Sequence
  Synthetic sequence.
EEDERLTKRVEEIKRENRELLRRLEEEVKELERKSEKIVRDLKEKVDRAKEKLDSGKGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKDVRDHMVLHEYVNAAGITKLIRRNLRLLEELLRLVREILRTSNEILEEILKDARR

SEQ ID NO: 14744 - protein, 245 aa, Artificial Sequence
  Synthetic sequence.
TEEEVLRKVEKLIKDLLDVLRDLLRASEEVVREALRVLEELIEENKRVIEELSRALSGGSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGSRDHMVLHEYVNAAGITKRHEDLRRELEKLLRDYKRELEEIERALEEIEKTLKRRADETRR

SEQ ID NO: 14745 - protein, 245 aa, Artificial Sequence; identical to SEQ ID NO: 14744
  Synthetic sequence.

SEQ ID NO: 14746 - protein, 244 aa, Artificial Sequence
  Synthetic sequence.
SAEETLRRITEESKRVLEEITKKYEDLERESREVLRKLREDLDRIKRELEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRRDHMVLHEYVNAAGITVLEEILKINEELNRKIIKFARENLERNRRVNKKVIEVLREAAR

SEQ ID NO: 14747 - protein, 238 aa, Artificial Sequence
  Synthetic sequence.
SEAEKIREALETNLRLLEELIKRLKEILDTHNELLRRVIETLERLLKELLELLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKEDRDHMVLHEYVNAAGITRLLEKLARDSAELMRELERILDRYARESEELDRRLAE

SEQ ID NO: 14748 - protein, 238 aa, Artificial Sequence; identical to SEQ ID NO: 14747
  Synthetic sequence.

SEQ ID NO: 14749 - protein, 242 aa, Artificial Sequence
  Synthetic sequence.
SEKERLMRLLDKLKDLNRRLVERIKELLDKALELHKKLVKELRELLERLKELVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSEERDHMVLHEYVNAAGITRKIERDAEREYKKLKDELEELTERYRREIRKLKEELKADRK

SEQ ID NO: 14750 - protein, 238 aa, Artificial Sequence
  Synthetic sequence.
DADELLRRLAEEVERVIREAEDLLRRWKETIKKVLDDLKRLLDELKKRNEDVIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKDDRDHMVLHEYVNAAGITERLREILRENLEALKKTLKRLEDVVREILEDLKRERK

SEQ ID NO: 14751 - protein, 236 aa, Artificial Sequence
  Synthetic sequence.
STREKAKKVLDTLRADNEDMKRVVEKILRALKRTNERAEKLAREITEEIKRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDLLRRDHMVLHEYVNAAGITLEELEREHRELEKELDKLHDESRKEHERIEEELRR

SEQ ID NO: 14752 - protein, 236 aa, Artificial Sequence; identical to SEQ ID NO: 14751
  Synthetic sequence.

SEQ ID NO: 14753 - protein, 243 aa, Artificial Sequence
  Synthetic sequence.
DLERVVEDIVDKAKRLLDKNLEVLKRIVDEVLRLLERLLRESRKVVKRVKEIIEELVRDEKELRRVKRALEEVLRRHEEIAKELKERLRKVAKEAEEKHKKLVEDLKRVVDEVRKKLSGPLDREKVLEVLDELVTIIAKLLDENIKVLEEVIRVIAELLERLLDSHRRLIDIIAKLLEGLRPGDERDHMVLHEYVNAAGITSEKVVDDLKKELERIKREVKRLIEENARTLADIKRAVDEARK

SEQ ID NO: 14754 - protein, 239 aa, Artificial Sequence
  Synthetic sequence.
SERELIERWLELHKEILRLIRELVERLLKLHREILDTIKKLIRELLELLEDIARKLGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERTDDERRRDHMVLHEYVNAAGITERTLKKLLDDSARMAEEVKKTLKELLERSEKVAEDVRK

SEQ ID NO: 14755 - protein, 246 aa, Artificial Sequence
  Synthetic sequence.
KEIEETLKELEDLNREMVETNRRVLEETRRLNKETVDRVKATLDELAKMLKKLVDDVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILRDHMVLHEYVNAAGITEEIKRRLKEVIDRYEDELRKLRKEYKEKIDKYERKLEEIERRERT

SEQ ID NO: 14756 - protein, 246 aa, Artificial Sequence
  Synthetic sequence.
SREEIVATLEDLARKILEVVKKLAKEIEDAWREIERAVREILKRLEELWREIEDVVRKKVDSRVAEILETVVKRVVDITRRLIEEAERVVRELVDITRKLITILEEVVRRLVEIVREASKIDDRRELEDMLRKIREVVREVIERLKKLDEDVRRVVEEVIRRLEELNKRLEDVIREVKKRLKELGRDHMVLHEYVNAAGITLERNTRVIKEIIDLLRTVIRIHEKIVEDLIKLLEELLRRLEEATR

SEQ ID NO: 14757 - protein, 237 aa, Artificial Sequence
  Synthetic sequence.
KEKEDALKKLEDLARKSREDLERVLRKHKKILDKIEELLKRVLDEHKKIVDDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELAREVRDHMVLHEYVNAAGITRIERAIDELLKVSEEILKLSEDASEELLKILREFAK

SEQ ID NO: 14758 - protein, 241 aa, Artificial Sequence
  Synthetic sequence.
SEKELLKEILDRIRELLEDDNRLLKRIVDEIRKLLEEWLRVHKEILERIKELLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKRDHMVLHEYVNAAGITRDTRRVIEEAKRLLKEWRDRNKEVADTLKKLLEDLIRKIR

SEQ ID NO: 14759 - protein, 241 aa, Artificial Sequence; identical to SEQ ID NO: 14758
  Synthetic sequence.

SEQ ID NO: 14760 - protein, 246 aa, Artificial Sequence
  Synthetic sequence.
SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGRDHMVLHEYVNAAGITLEAVRRVLEELLKVLAEHLETVRELIERLKRVLEEAIEVVERVAR

SEQ ID NO: 14761 - protein, 246 aa, Artificial Sequence; identical to SEQ ID NO: 14760
  Synthetic sequence.

SEQ ID NO: 14762 - protein, 240 aa, Artificial Sequence
  Synthetic sequence.
DREKSVRDIEEDLKRVLDKLRRRVETSKEELKKVLKADKENADELEKTLRDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSRDHMVLHEYVNAAGITLKENTDRLKEVIDRNLADLRDLAEELRAVIERLLEDARR

SEQ ID NO: 14763 - protein, 240 aa, Artificial Sequence; identical to SEQ ID NO: 14762
  Synthetic sequence.

SEQ ID NO: 14764 - protein, 241 aa, Artificial Sequence
  Synthetic sequence.
SAEEAVEKLVRIARAIVKINEDLSREVVRILREIVRLNEETTRLLVEIAREVVKVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVSEELRDHMVLHEYVNAAGITDSAKELEKLKRELERLLEESRRKLEKLKRDLERVLEETRR

SEQ ID NO: 14765 - protein, 237 aa, Artificial Sequence
  Synthetic sequence.
REDEVLRDIERLLREIEEKIRRILEESTAELRKVEEEVKRIIERTKRELKAIKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLLRDHMVLHEYVNAAGITLARDLKEILRRHIEALKELARDLAEVIRKLLEDVKR

SEQ ID NO: 14766 - protein, 243 aa, Artificial Sequence
  Synthetic sequence.
SEAERLADEVRKAVKKSEEDNETLVREVEKAVRELKKNNKTWVDEVRKLMKRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSERDHMVLHEYVNAAGITIEELVRLNNEILERLLKIVRELHKDNIKILEDLLRIIEEVLR

SEQ ID NO: 14767 - protein, 243 aa, Artificial Sequence; identical to SEQ ID NO: 14766
  Synthetic sequence.

SEQ ID NO: 14768 - protein, 245 aa, Artificial Sequence
  Synthetic sequence.
SEKDEVTRRIRELLKEAEETNREAIERIKRLLDRVREAVEEVAKRSEELLRRLKKVLDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGRDHMVLHEYVNAAGITESLRLIRELLKEIEKIVKEIIELLERLNDELRKIIEAILETTKK

SEQ ID NO: 14769 - protein, 239 aa, Artificial Sequence
  Synthetic sequence.
SAEDLVRRVKDLVDKLEDKLRKVVRTNERLWEEIRKRLEELVRRNKELWDALVEKLKAGDKDKDELIEEAKSLEDESNALVEKLVRDIERVLAESNKLLDTLAKEIEEVLEEIVELVERGSGSDKEAREKLEDIKARLKEVLKKLREESKRIIDELRRLLEEYKRLVKEIRDRIEEVRKRNSEIRRDHMVLHEYVNAAGITVEELEKLVRDHNRVVEEVVRELVELLSRAVEVIKEVVK

SEQ ID NO: 14770 - protein, 243 aa, Artificial Sequence
  Synthetic sequence.
SRVEELKKLIEDILRISREVVERIARVAEDIHRINRRVLDDLRKLIEDILRTVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSRDHMVLHEYVNAAGITLDRILEEYRRLLEEIKRKLEEILRRVEELHRRLRRKLEEIDR

SEQ ID NO: 14771 - protein, 243 aa, Artificial Sequence; identical to SEQ ID NO: 14770
  Synthetic sequence.

SEQ ID NO: 14772 - protein, 240 aa, Artificial Sequence
  Synthetic sequence.
DKDKRLEELLKRLKELNDKTFEELERILEELKRANEASLREAERILEELRARIEGGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKRDHMVLHEYVNAAGITLEEDSRTNSEVVKRLLDLLREDSKANSEVVKRLLDVLRE

SEQ ID NO: 14773 - protein, 240 aa, Artificial Sequence; identical to SEQ ID NO: 14772
  Synthetic sequence.

SEQ ID NO: 14774 - protein, 240 aa, Artificial Sequence
  Synthetic sequence.
SKEETLKRLLDELEKRNRETVERLERLLKELEDRNRASLEELEAVLEELERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKRDHMVLHEYVNAAGITLRRDVELNLDVAKKLLELLKEDSKLNLDVARELLELLDR

SEQ ID NO: 14775 - protein, 240 aa, Artificial Sequence; identical to SEQ ID NO: 14774
  Synthetic sequence.

SEQ ID NO: 14776 - protein, 243 aa, Artificial Sequence
  Synthetic sequence.
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSRRDHMVLHEYVNAAGITLNEITKDLEAKLEKLLRDLNELTKALEEELKRLLDELKKRTD

SEQ ID NO: 14777 - protein, 243 aa, Artificial Sequence; identical to SEQ ID NO: 14776
  Synthetic sequence.

SEQ ID NO: 14778 - protein, 243 aa, Artificial Sequence
  Synthetic sequence.
SEAERTKESLKKVLKALVDLNRELLRKLEENMRELTKLNEEVKRALKEVLDKVREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTERDHMVLHEYVNAAGITADRYREEVRKSKDKLRSILEDYKRKVDELKERLRELIEEVET

SEQ ID NO: 14779 - protein, 243 aa, Artificial Sequence; identical to SEQ ID NO: 14778
  Synthetic sequence.

SEQ ID NO: 14780 - protein, 238 aa, Artificial Sequence
  Synthetic sequence.
EEDERLTKRVEEIKRENRELLRRLEEEVKELERKSEKIVRDLKEKVDRAKEKLDSGKGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKDVLRDHMVLHEYVNAAGITLIRRNLRLLEELLRLVREILRTSNEILEEILKDARR

SEQ ID NO: 14781 - protein, 245 aa, Artificial Sequence
  Synthetic sequence.
TEEEVLRKVEKLIKDLLDVLRDLLRASEEVVREALRVLEELIEENKRVIEELSRALSGGSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGSERDHMVLHEYVNAAGITRHEDLRRELEKLLRDYKRELEEIERALEEIEKTLKRRADETRR

SEQ ID NO: 14782 - protein, 243 aa, Artificial Sequence
  Synthetic sequence.
KREDILKKLEDIIRDIIDKLRRILEKVKRLNEDIIREIKRLLDESLKTLEDLLKRIADKSRDRELEDILRRVLEKLRRSLDKLRDTLRKLKEETDTVLERAERTLKELKDRLEKLLRDGEKVSEEDLVEALKALIDELRKVLEDVIRVSKELVERLLRALREHLETNKRLVKELLDALRKTTGDDERDHMVLHEYVNAAGITEEEVERVARELEKAHRDLERDIRRVAEELKKLLKKLRDDRR

SEQ ID NO: 14783 - protein, 243 aa, Artificial Sequence; identical to SEQ ID NO: 14782
  Synthetic sequence.

SEQ ID NO: 14784 - protein, 244 aa, Artificial Sequence
  Synthetic sequence.
SAEETLRRITEESKRVLEEITKKYEDLERESREVLRKLREDLDRIKRELEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERDHMVLHEYVNAAGITLEEILKINEELNRKIIKFARENLERNRRVNKKVIEVLREAAR

SEQ ID NO: 14785 - protein, 247 aa, Artificial Sequence
  Synthetic sequence.
SEKEELLKLIKRVIELLKRVLEEHLRLVEDVIRRLKELLDSNEKIVREVIEDLKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGRDHMVLHEYVNAAGITREKLKRNLEDVRRVIEDVKRKSARILEEARRLIEEVERELEKIRK

SEQ ID NO: 14786 - protein, 238 aa, Artificial Sequence
  Synthetic sequence.
SEAEKIREALETNLRLLEELIKRLKEILDTHNELLRRVIETLERLLKELLELLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKEDLRDHMVLHEYVNAAGITLLEKLARDSAELMRELERILDRYARESEELDRRLAE

SEQ ID NO: 14787 - protein, 242 aa, Artificial Sequence
  Synthetic sequence.
SEKERLMRLLDKLKDLNRRLVERIKELLDKALELHKKLVKELRELLERLKELVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSEETRDHMVLHEYVNAAGITKIERDAEREYKKLKDELEELTERYRREIRKLKEELKADRK

SEQ ID NO: 14788 - protein, 242 aa, Artificial Sequence; identical to SEQ ID NO: 14787
  Synthetic sequence.

SEQ ID NO: 14789 - protein, 247 aa, Artificial Sequence
  Synthetic sequence.
SEAEDLEELIKELAELLKDVIRKLEKINRRLVKILEDIIRRLKEISKEAEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGRDHMVLHEYVNAAGITLDRLREEHEEVKRRLEEELTRLRETHKKIEKELREALKRVRDRST

SEQ ID NO: 14790 - protein, 247 aa, Artificial Sequence; identical to SEQ ID NO: 14789
  Synthetic sequence.

SEQ ID NO: 14791 - protein, 238 aa, Artificial Sequence
  Synthetic sequence.
DADELLRRLAEEVERVIREAEDLLRRWKETIKKVLDDLKRLLDELKKRNEDVIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKDDLRDHMVLHEYVNAAGITRLREILRENLEALKKTLKRLEDVVREILEDLKRERK

SEQ ID NO: 14792 - protein, 238 aa, Artificial Sequence; identical to SEQ ID NO: 14791
  Synthetic sequence.

SEQ ID NO: 14793 - protein, 247 aa, Artificial Sequence
  Synthetic sequence.
SKAEKLLKDLREALEKVKRRYEELERRLDEVLKEHEEIVKRLLEELEKVLKRIEEGGLPEEELEKLKKLAEKVKELLRELLRLSKELVDRVRELLKRDLDLVRRLVEIALKVLREAREQPNDEKRVEKIKRDLEKKARRVREENERIKRDLKRTADESRKRLEKLLEDLKRELDRLREDLDRGRKDRDHMVLHEYVNAAGITERLLREVIKSHEKLVRTIERLIEESIRVNEELLEVIERLLDRARK

SEQ ID NO: 14794 - protein, 247 aa, Artificial Sequence; identical to SEQ ID NO: 14793
  Synthetic sequence.

SEQ ID NO: 14795 - protein, 243 aa, Artificial Sequence
  Synthetic sequence.
DLERVVEDIVDKAKRLLDKNLEVLKRIVDEVLRLLERLLRESRKVVKRVKEIIEELVRDEKELRRVKRALEEVLRRHEEIAKELKERLRKVAKEAEEKHKKLVEDLKRVVDEVRKKLSGPLDREKVLEVLDELVTIIAKLLDENIKVLEEVIRVIAELLERLLDSHRRLIDIIAKLLEGLRPGDEDRDHMVLHEYVNAAGITEKVVDDLKKELERIKREVKRLIEENARTLADIKRAVDEARK

SEQ ID NO: 14796 - protein, 246 aa, Artificial Sequence
  Synthetic sequence.
KEIEETLKELEDLNREMVETNRRVLEETRRLNKETVDRVKATLDELAKMLKKLVDDVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDRDHMVLHEYVNAAGITEIKRRLKEVIDRYEDELRKLRKEYKEKIDKYERKLEEIERRERT

SEQ ID NO: 14797 - protein, 247 aa, Artificial Sequence
  Synthetic sequence.
RDRDVLRKVKAEIEELVARIEKVSRDALSEVKRLLDENRKIAEDVLRLIESLLRKIRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERRDHMVLHEYVNAAGITAEEMKRVHDDLSRAVEKVVRDVVRVDKELLDELARILRRLEEVIT

SEQ ID NO: 14798 - protein, 237 aa, Artificial Sequence
  Synthetic sequence.
KEKEDALKKLEDLARKSREDLERVLRKHKKILDKIEELLKRVLDEHKKIVDDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELAREVERDHMVLHEYVNAAGITIERAIDELLKVSEEILKLSEDASEELLKILREFAK

SEQ ID NO: 14799 - protein, 237 aa, Artificial Sequence; identical to SEQ ID NO: 14798
  Synthetic sequence.

SEQ ID NO: 14800 - protein, 241 aa, Artificial Sequence
  Synthetic sequence.
SEKELLKEILDRIRELLEDDNRLLKRIVDEIRKLLEEWLRVHKEILERIKELLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKIRDHMVLHEYVNAAGITDTRRVIEEAKRLLKEWRDRNKEVADTLKKLLEDLIRKIR

SEQ ID NO: 14801 - protein, 246 aa, Artificial Sequence
  Synthetic sequence.
SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDRDHMVLHEYVNAAGITEAVRRVLEELLKVLAEHLETVRELIERLKRVLEEAIEVVERVAR

SEQ ID NO: 14802 - protein, 246 aa, Artificial Sequence; identical to SEQ ID NO: 14801
  Synthetic sequence.

SEQ ID NO: 14803 - protein, 240 aa, Artificial Sequence
  Synthetic sequence.
DREKSVRDIEEDLKRVLDKLRRRVETSKEELKKVLKADKENADELEKTLRDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSERDHMVLHEYVNAAGITKENTDRLKEVIDRNLADLRDLAEELRAVIERLLEDARR

SEQ ID NO: 14804 - protein, 240 aa, Artificial Sequence; identical to SEQ ID NO: 14803
  Synthetic sequence.

SEQ ID NO: 14805 - protein, 241 aa, Artificial Sequence
  Synthetic sequence.
SAEEAVEKLVRIARAIVKINEDLSREVVRILREIVRLNEETTRLLVEIAREVVKVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVSEELLRDHMVLHEYVNAAGITSAKELEKLKRELERLLEESRRKLEKLKRDLERVLEETRR

SEQ ID NO: 14806 - protein, 237 aa, Artificial Sequence
  Synthetic sequence.
REDEVLRDIERLLREIEEKIRRILEESTAELRKVEEEVKRIIERTKRELKAIKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLLERDHMVLHEYVNAAGITARDLKEILRRHIEALKELARDLAEVIRKLLEDVKR

SEQ ID NO: 14807 - protein, 237 aa, Artificial Sequence; identical to SEQ ID NO: 14806
  Synthetic sequence.

SEQ ID NO: 14808 - protein, 243 aa, Artificial Sequence
  Synthetic sequence.
SEAERLADEVRKAVKKSEEDNETLVREVEKAVRELKKNNKTWVDEVRKLMKRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEERDHMVLHEYVNAAGITEELVRLNNEILERLLKIVRELHKDNIKILEDLLRIIEEVLR

SEQ ID NO: 14809 - protein, 243 aa, Artificial Sequence; identical to SEQ ID NO: 14808
  Synthetic sequence.

SEQ ID NO: 14810 - protein, 245 aa, Artificial Sequence
  Synthetic sequence.
SEKDEVTRRIRELLKEAEETNREAIERIKRLLDRVREAVEEVAKRSEELLRRLKKVLDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSRDHMVLHEYVNAAGITSLRLIRELLKEIEKIVKEIIELLERLNDELRKIIEAILETTKK

SEQ ID NO: 14811 - protein, 247 aa, Artificial Sequence
  Synthetic sequence.
DEERLAEELERVLDRNRKLLEEALRELRRVIEENRKSVKRLLDELKRVLDELLKVLRELSRGDSDEELRKVIEDLIRKLTKVLDKVRSLVEENIERLARVLEKLERLARENLEDLKKVLDDVDKKLKDRRLVERLAELVRELIEVNKEILEMLKEIVRELLEINRTLLERLKDLVATALEIIKLLARDHMVLHEYVNAAGITRDRLRKLLEDYERAVRRLEDKLRRVRERYEAVLKRIKDKLEETKR

SEQ ID NO: 14812 - protein, 243 aa, Artificial Sequence
  Synthetic sequence.
SRVEELKKLIEDILRISREVVERIARVAEDIHRINRRVLDDLRKLIEDILRTVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVRDHMVLHEYVNAAGITDRILEEYRRLLEEIKRKLEEILRRVEELHRRLRRKLEEIDR

SEQ ID NO: 14813 - protein, 243 aa, Artificial Sequence; identical to SEQ ID NO: 14812
  Synthetic sequence.

SEQ ID NO: 14814 - protein, 240 aa, Artificial Sequence
  Synthetic sequence.
DKDKRLEELLKRLKELNDKTFEELERILEELKRANEASLREAERILEELRARIEGGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKDRDHMVLHEYVNAAGITEEDSRTNSEVVKRLLDLLREDSKANSEVVKRLLDVLRE

SEQ ID NO: 14815 - protein, 240 aa, Artificial Sequence
  Synthetic sequence.
SKEETLKRLLDELEKRNRETVERLERLLKELEDRNRASLEELEAVLEELERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDRDHMVLHEYVNAAGITRRDVELNLDVAKKLLELLKEDSKLNLDVARELLELLDR

SEQ ID NO: 14816 - protein, 243 aa, Artificial Sequence
  Synthetic sequence.
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSRERDHMVLHEYVNAAGITNEITKDLEAKLEKLLRDLNELTKALEEELKRLLDELKKRTD

SEQ ID NO: 14817 - protein, 243 aa, Artificial Sequence; identical to SEQ ID NO: 14816
  Synthetic sequence.

SEQ ID NO: 14818 - protein, 243 aa, Artificial Sequence
  Synthetic sequence.
SEAERTKESLKKVLKALVDLNRELLRKLEENMRELTKLNEEVKRALKEVLDKVREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEERDHMVLHEYVNAAGITDRYREEVRKSKDKLRSILEDYKRKVDELKERLRELIEEVET

SEQ ID NO: 14819 - protein, 243 aa, Artificial Sequence; identical to SEQ ID NO: 14818
  Synthetic sequence.

SEQ ID NO: 14820 - protein, 238 aa, Artificial Sequence
  Synthetic sequence.
EEDERLTKRVEEIKRENRELLRRLEEEVKELERKSEKIVRDLKEKVDRAKEKLDSGKGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKDVLTRDHMVLHEYVNAAGITIRRNLRLLEELLRLVREILRTSNEILEEILKDARR

SEQ ID NO: 14821 - protein, 238 aa, Artificial Sequence; identical to SEQ ID NO: 14820
  Synthetic sequence.

SEQ ID NO: 14822 - protein, 245 aa, Artificial Sequence
  Synthetic sequence.
TEEEVLRKVEKLIKDLLDVLRDLLRASEEVVREALRVLEELIEENKRVIEELSRALSGGSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGSEERDHMVLHEYVNAAGITHEDLRRELEKLLRDYKRELEEIERALEEIEKTLKRRADETRR

SEQ ID NO: 14823 - protein, 245 aa, Artificial Sequence; identical to SEQ ID NO: 14822
  Synthetic sequence.

SEQ ID NO: 14824 - protein, 238 aa, Artificial Sequence
  Synthetic sequence.
SKEDKARELEKRLRDNLKKLEEVVRELAEVLKRNLEKLRRLAEELLRALKRLLDKLRAGGLPKDELEDLRREVEDVLRRLEDLLRKLKKANDESLTRLEELLRRAEEENRRVLTTLRELLRGNGDDRDLARLVARLVEANNRALEELLRLVAKNVEDNNRVLEELLRLVKELAKRLLGRIRDEDLVRRDHMVLHEYVNAAGITLRDDERDLRALEKRIRDIIREDREELERLKERARK

SEQ ID NO: 14825 - protein, 243 aa, Artificial Sequence
  Synthetic sequence.
KREDILKKLEDIIRDIIDKLRRILEKVKRLNEDIIREIKRLLDESLKTLEDLLKRIADKSRDRELEDILRRVLEKLRRSLDKLRDTLRKLKEETDTVLERAERTLKELKDRLEKLLRDGEKVSEEDLVEALKALIDELRKVLEDVIRVSKELVERLLRALREHLETNKRLVKELLDALRKTTGDDEERDHMVLHEYVNAAGITEEVERVARELEKAHRDLERDIRRVAEELKKLLKKLRDDRR

SEQ ID NO: 14826 - protein, 244 aa, Artificial Sequence
  Synthetic sequence.
SAEETLRRITEESKRVLEEITKKYEDLERESREVLRKLREDLDRIKRELEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERRDHMVLHEYVNAAGITEEILKINEELNRKIIKFARENLERNRRVNKKVIEVLREAAR

SEQ ID NO: 14827 - protein, 247 aa, Artificial Sequence
  Synthetic sequence.
SEKEELLKLIKRVIELLKRVLEEHLRLVEDVIRRLKELLDSNEKIVREVIEDLKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGARDHMVLHEYVNAAGITEKLKRNLEDVRRVIEDVKRKSARILEEARRLIEEVERELEKIRK

SEQ ID NO: 14828 - protein, 247 aa, Artificial Sequence; identical to SEQ ID NO: 14827
  Synthetic sequence.

SEQ ID NO: 14829 - protein, 238 aa, Artificial Sequence
  Synthetic sequence.
SEAEKIREALETNLRLLEELIKRLKEILDTHNELLRRVIETLERLLKELLELLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKEDLERDHMVLHEYVNAAGITLEKLARDSAELMRELERILDRYARESEELDRRLAE

SEQ ID NO: 14830 - protein, 238 aa, Artificial Sequence; identical to SEQ ID NO: 14829
  Synthetic sequence.

SEQ ID NO: 14831 - protein, 242 aa, Artificial Sequence
  Synthetic sequence.
SEKERLMRLLDKLKDLNRRLVERIKELLDKALELHKKLVKELRELLERLKELVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSEETVRDHMVLHEYVNAAGITIERDAEREYKKLKDELEELTERYRREIRKLKEELKADRK

SEQ ID NO: 14832 - protein, 242 aa, Artificial Sequence; identical to SEQ ID NO: 14831
  Synthetic sequence.

SEQ ID NO: 14833 - protein, 247 aa, Artificial Sequence
  Synthetic sequence.
SEAEDLEELIKELAELLKDVIRKLEKINRRLVKILEDIIRRLKEISKEAEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKRDHMVLHEYVNAAGITDRLREEHEEVKRRLEEELTRLRETHKKIEKELREALKRVRDRST

SEQ ID NO: 14834 - protein, 247 aa, Artificial Sequence; identical to SEQ ID NO: 14833
  Synthetic sequence.

SEQ ID NO: 14835 - protein, 240 aa, Artificial Sequence
  Synthetic sequence.
SDKEEIKRRVEKTARDLETEHDKIKKRLEDTVRDIKRELDELLEKYERVLRKIEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEERDHMVLHEYVNAAGITEALAKLIKELLEALEEVLRRNKELIRELLRVLDEALK

SEQ ID NO: 14836 - protein, 248 aa, Artificial Sequence
  Synthetic sequence.
DEDRIIEEIARLLEELLRELLELIKKLIETNRRLNEEHERAVRELARLLEELLDRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGRDHMVLHEYVNAAGITRRMIKRLHEDLERKLKESEDELREIEARLEEKIRRLEEKLERKRR

SEQ ID NO: 14837 - protein, 248 aa, Artificial Sequence; identical to SEQ ID NO: 14836
  Synthetic sequence.

SEQ ID NO: 14838 - protein, 238 aa, Artificial Sequence
  Synthetic sequence.
DADELLRRLAEEVERVIREAEDLLRRWKETIKKVLDDLKRLLDELKKRNEDVIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKDDLERDHMVLHEYVNAAGITLREILRENLEALKKTLKRLEDVVREILEDLKRERK

SEQ ID NO: 14839 - protein, 238 aa, Artificial Sequence; identical to SEQ ID NO: 14838
  Synthetic sequence.

SEQ ID NO: 14840 - protein, 243 aa, Artificial Sequence
  Synthetic sequence.
DLERVVEDIVDKAKRLLDKNLEVLKRIVDEVLRLLERLLRESRKVVKRVKEIIEELVRDEKELRRVKRALEEVLRRHEEIAKELKERLRKVAKEAEEKHKKLVEDLKRVVDEVRKKLSGPLDREKVLEVLDELVTIIAKLLDENIKVLEEVIRVIAELLERLLDSHRRLIDIIAKLLEGLRPGDEDLRDHMVLHEYVNAAGITKVVDDLKKELERIKREVKRLIEENARTLADIKRAVDEARK

SEQ ID NO: 14841 - protein, 246 aa, Artificial Sequence
  Synthetic sequence.
KEIEETLKELEDLNREMVETNRRVLEETRRLNKETVDRVKATLDELAKMLKKLVDDVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTRDHMVLHEYVNAAGITIKRRLKEVIDRYEDELRKLRKEYKEKIDKYERKLEEIERRERT

SEQ ID NO: 14842 - protein, 247 aa, Artificial Sequence
  Synthetic sequence.
RDRDVLRKVKAEIEELVARIEKVSRDALSEVKRLLDENRKIAEDVLRLIESLLRKIRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGRDHMVLHEYVNAAGITEEMKRVHDDLSRAVEKVVRDVVRVDKELLDELARILRRLEEVIT

SEQ ID NO: 14843 - protein, 247 aa, Artificial Sequence; identical to SEQ ID NO: 14842
  Synthetic sequence.

SEQ ID NO: 14844 - protein, 246 aa, Artificial Sequence
  Synthetic sequence.
SREEIVATLEDLARKILEVVKKLAKEIEDAWREIERAVREILKRLEELWREIEDVVRKKVDSRVAEILETVVKRVVDITRRLIEEAERVVRELVDITRKLITILEEVVRRLVEIVREASKIDDRRELEDMLRKIREVVREVIERLKKLDEDVRRVVEEVIRRLEELNKRLEDVIREVKKRLKELGLSRDHMVLHEYVNAAGITRNTRVIKEIIDLLRTVIRIHEKIVEDLIKLLEELLRRLEEATR

SEQ ID NO: 14845 - protein, 241 aa, Artificial Sequence
  Synthetic sequence.
SEKELLKEILDRIRELLEDDNRLLKRIVDEIRKLLEEWLRVHKEILERIKELLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKIARDHMVLHEYVNAAGITTRRVIEEAKRLLKEWRDRNKEVADTLKKLLEDLIRKIR

SEQ ID NO: 14846 - protein, 241 aa, Artificial Sequence; identical to SEQ ID NO: 14845
  Synthetic sequence.

SEQ ID NO: 14847 - protein, 246 aa, Artificial Sequence
  Synthetic sequence.
SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSRDHMVLHEYVNAAGITAVRRVLEELLKVLAEHLETVRELIERLKRVLEEAIEVVERVAR

SEQ ID NO: 14848 - protein, 240 aa, Artificial Sequence
  Synthetic sequence.
DREKSVRDIEEDLKRVLDKLRRRVETSKEELKKVLKADKENADELEKTLRDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVRDHMVLHEYVNAAGITENTDRLKEVIDRNLADLRDLAEELRAVIERLLEDARR

SEQ ID NO: 14849 - protein, 240 aa, Artificial Sequence; identical to SEQ ID NO: 14848
  Synthetic sequence.

SEQ ID NO: 14850 - protein, 245 aa, Artificial Sequence
  Synthetic sequence.
SEKDEVTRRIRELLKEAEETNREAIERIKRLLDRVREAVEEVAKRSEELLRRLKKVLDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSGRDHMVLHEYVNAAGITLRLIRELLKEIEKIVKEIIELLERLNDELRKIIEAILETTKK

SEQ ID NO: 14851 - protein, 245 aa, Artificial Sequence; identical to SEQ ID NO: 14850
  Synthetic sequence.

SEQ ID NO: 14852 - protein, 239 aa, Artificial Sequence
  Synthetic sequence.
SAEDLVRRVKDLVDKLEDKLRKVVRTNERLWEEIRKRLEELVRRNKELWDALVEKLKAGDKDKDELIEEAKSLEDESNALVEKLVRDIERVLAESNKLLDTLAKEIEEVLEEIVELVERGSGSDKEAREKLEDIKARLKEVLKKLREESKRIIDELRRLLEEYKRLVKEIRDRIEEVRKRNSEIRVLRDHMVLHEYVNAAGITELEKLVRDHNRVVEEVVRELVELLSRAVEVIKEVVK

SEQ ID NO: 14853 - protein, 247 aa, Artificial Sequence
  Synthetic sequence.
DEERLAEELERVLDRNRKLLEEALRELRRVIEENRKSVKRLLDELKRVLDELLKVLRELSRGDSDEELRKVIEDLIRKLTKVLDKVRSLVEENIERLARVLEKLERLARENLEDLKKVLDDVDKKLKDRRLVERLAELVRELIEVNKEILEMLKEIVRELLEINRTLLERLKDLVATALEIIKLLARRDHMVLHEYVNAAGITDRLRKLLEDYERAVRRLEDKLRRVRERYEAVLKRIKDKLEETKR

SEQ ID NO: 14854 - protein, 243 aa, Artificial Sequence
  Synthetic sequence.
SRVEELKKLIEDILRISREVVERIARVAEDIHRINRRVLDDLRKLIEDILRTVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGRDHMVLHEYVNAAGITRILEEYRRLLEEIKRKLEEILRRVEELHRRLRRKLEEIDR

SEQ ID NO: 14855 - protein, 243 aa, Artificial Sequence; identical to SEQ ID NO: 14854
  Synthetic sequence.

SEQ ID NO: 14856 - protein, 243 aa, Artificial Sequence
  Synthetic sequence.
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREARDHMVLHEYVNAAGITEITKDLEAKLEKLLRDLNELTKALEEELKRLLDELKKRTD

SEQ ID NO: 14857 - protein, 243 aa, Artificial Sequence; identical to SEQ ID NO: 14856
  Synthetic sequence.

SEQ ID NO: 14858 - protein, 243 aa, Artificial Sequence
  Synthetic sequence.
SEAERTKESLKKVLKALVDLNRELLRKLEENMRELTKLNEEVKRALKEVLDKVREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRDHMVLHEYVNAAGITRYREEVRKSKDKLRSILEDYKRKVDELKERLRELIEEVET

SEQ ID NO: 14859 - protein, 243 aa, Artificial Sequence; identical to SEQ ID NO: 14858
  Synthetic sequence.

SEQ ID NO: 14860 - protein, 245 aa, Artificial Sequence
  Synthetic sequence.
TEEEVLRKVEKLIKDLLDVLRDLLRASEEVVREALRVLEELIEENKRVIEELSRALSGGSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGSEEKRDHMVLHEYVNAAGITEDLRRELEKLLRDYKRELEEIERALEEIEKTLKRRADETRR

SEQ ID NO: 14861 - protein, 245 aa, Artificial Sequence; identical to SEQ ID NO: 14860
  Synthetic sequence.

SEQ ID NO: 14862 - protein, 243 aa, Artificial Sequence
  Synthetic sequence.
KREDILKKLEDIIRDIIDKLRRILEKVKRLNEDIIREIKRLLDESLKTLEDLLKRIADKSRDRELEDILRRVLEKLRRSLDKLRDTLRKLKEETDTVLERAERTLKELKDRLEKLLRDGEKVSEEDLVEALKALIDELRKVLEDVIRVSKELVERLLRALREHLETNKRLVKELLDALRKTTGDDEEIRDHMVLHEYVNAAGITEVERVARELEKAHRDLERDIRRVAEELKKLLKKLRDDRR

SEQ ID NO: 14863 - protein, 244 aa, Artificial Sequence
  Synthetic sequence.
SAEETLRRITEESKRVLEEITKKYEDLERESREVLRKLREDLDRIKRELEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLRDHMVLHEYVNAAGITEILKINEELNRKIIKFARENLERNRRVNKKVIEVLREAAR

SEQ ID NO: 14864 - protein, 247 aa, Artificial Sequence
  Synthetic sequence.
SEKEELLKLIKRVIELLKRVLEEHLRLVEDVIRRLKELLDSNEKIVREVIEDLKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASRDHMVLHEYVNAAGITKLKRNLEDVRRVIEDVKRKSARILEEARRLIEEVERELEKIRK

SEQ ID NO: 14865 - protein, 242 aa, Artificial Sequence
  Synthetic sequence.
SEKERLMRLLDKLKDLNRRLVERIKELLDKALELHKKLVKELRELLERLKELVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSEETVRRDHMVLHEYVNAAGITERDAEREYKKLKDELEELTERYRREIRKLKEELKADRK

SEQ ID NO: 14866 - protein, 242 aa, Artificial Sequence; identical to SEQ ID NO: 14865
  Synthetic sequence.

SEQ ID NO: 14867 - protein, 247 aa, Artificial Sequence
  Synthetic sequence.
SEAEDLEELIKELAELLKDVIRKLEKINRRLVKILEDIIRRLKEISKEAEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDRDHMVLHEYVNAAGITRLREEHEEVKRRLEEELTRLRETHKKIEKELREALKRVRDRST

SEQ ID NO: 14868 - protein, 247 aa, Artificial Sequence; identical to SEQ ID NO: 14867
  Synthetic sequence.

SEQ ID NO: 14869 - protein, 248 aa, Artificial Sequence
  Synthetic sequence.
DEDRIIEEIARLLEELLRELLELIKKLIETNRRLNEEHERAVRELARLLEELLDRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVRDHMVLHEYVNAAGITRMIKRLHEDLERKLKESEDELREIEARLEEKIRRLEEKLERKRR

SEQ ID NO: 14870 - protein, 248 aa, Artificial Sequence; identical to SEQ ID NO: 14869
  Synthetic sequence.

SEQ ID NO: 14871 - protein, 247 aa, Artificial Sequence
  Synthetic sequence.
SKAEKLLKDLREALEKVKRRYEELERRLDEVLKEHEEIVKRLLEELEKVLKRIEEGGLPEEELEKLKKLAEKVKELLRELLRLSKELVDRVRELLKRDLDLVRRLVEIALKVLREAREQPNDEKRVEKIKRDLEKKARRVREENERIKRDLKRTADESRKRLEKLLEDLKRELDRLREDLDRGRKDIDRDHMVLHEYVNAAGITLLREVIKSHEKLVRTIERLIEESIRVNEELLEVIERLLDRARK

SEQ ID NO: 14872 - protein, 239 aa, Artificial Sequence
  Synthetic sequence.
SERELIERWLELHKEILRLIRELVERLLKLHREILDTIKKLIRELLELLEDIARKLGLDKEAKDELREIAKRVEDKLEKLERESRKVEEDLKRKLKELTDESDTVEKRVRDVVRRGTQSREEIAEELLRLDRKLLKAVEELLKEILDLNKKLLDDVRAILEETRRVLEKLLDRVRRGERTDDERRTLTRDHMVLHEYVNAAGITLKKLLDDSARMAEEVKKTLKELLERSEKVAEDVRK

SEQ ID NO: 14873 - protein, 246 aa, Artificial Sequence
  Synthetic sequence.
KEIEETLKELEDLNREMVETNRRVLEETRRLNKETVDRVKATLDELAKMLKKLVDDVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTTRDHMVLHEYVNAAGITKRRLKEVIDRYEDELRKLRKEYKEKIDKYERKLEEIERRERT

SEQ ID NO: 14874 - protein, 246 aa, Artificial Sequence
  Synthetic sequence.
SREEIVATLEDLARKILEVVKKLAKEIEDAWREIERAVREILKRLEELWREIEDVVRKKVDSRVAEILETVVKRVVDITRRLIEEAERVVRELVDITRKLITILEEVVRRLVEIVREASKIDDRRELEDMLRKIREVVREVIERLKKLDEDVRRVVEEVIRRLEELNKRLEDVIREVKKRLKELGLSERDHMVLHEYVNAAGITNTRVIKEIIDLLRTVIRIHEKIVEDLIKLLEELLRRLEEATR

SEQ ID NO: 14875 - protein, 241 aa, Artificial Sequence
  Synthetic sequence.
SEKELLKEILDRIRELLEDDNRLLKRIVDEIRKLLEEWLRVHKEILERIKELLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKIAKRDHMVLHEYVNAAGITRRVIEEAKRLLKEWRDRNKEVADTLKKLLEDLIRKIR

SEQ ID NO: 14876 - protein, 241 aa, Artificial Sequence; identical to SEQ ID NO: 14875
  Synthetic sequence.

SEQ ID NO: 14877 - protein, 248 aa, Artificial Sequence
  Synthetic sequence.
SEDELLEKIVRKLAEAVKRIEEELRKSKREIERLVKEIKEKLEDSLARVKETLDRIRETRKGPSDEEVLERLVRTLEELLARHLKLIEDIARELKKLLKEHLDRIETIVRDLKRLLKEILDELERTGLPREALEAVRELVKTVARLLDEVLKNNKKLLDDLKKELDDVLANNKRIVDELARLLERVRRRDHMVLHEYVNAAGITERSIESLERLLELILRVLEYSVASLEELLRRLLEVIKRIVDTTK

SEQ ID NO: 14878 - protein, 246 aa, Artificial Sequence
  Synthetic sequence.
SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSERDHMVLHEYVNAAGITVRRVLEELLKVLAEHLETVRELIERLKRVLEEAIEVVERVAR

SEQ ID NO: 14879 - protein, 246 aa, Artificial Sequence; identical to SEQ ID NO: 14878
  Synthetic sequence.

SEQ ID NO: 14880 - protein, 240 aa, Artificial Sequence
  Synthetic sequence.
DREKSVRDIEEDLKRVLDKLRRRVETSKEELKKVLKADKENADELEKTLRDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVARDHMVLHEYVNAAGITNTDRLKEVIDRNLADLRDLAEELRAVIERLLEDARR

SEQ ID NO: 14881 - protein, 241 aa, Artificial Sequence
  Synthetic sequence.
SAEEAVEKLVRIARAIVKINEDLSREVVRILREIVRLNEETTRLLVEIAREVVKVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVSEELLRRRDHMVLHEYVNAAGITKELEKLKRELERLLEESRRKLEKLKRDLERVLEETRR

SEQ ID NO: 14882 - protein, 243 aa, Artificial Sequence
  Synthetic sequence.
SEAERLADEVRKAVKKSEEDNETLVREVEKAVRELKKNNKTWVDEVRKLMKRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRDHMVLHEYVNAAGITLVRLNNEILERLLKIVRELHKDNIKILEDLLRIIEEVLR

SEQ ID NO: 14883 - protein, 243 aa, Artificial Sequence; identical to SEQ ID NO: 14882
  Synthetic sequence.

SEQ ID NO: 14884 - protein, 243 aa, Artificial Sequence
  Synthetic sequence.
SRVEELKKLIEDILRISREVVERIARVAEDIHRINRRVLDDLRKLIEDILRTVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGDRDHMVLHEYVNAAGITILEEYRRLLEEIKRKLEEILRRVEELHRRLRRKLEEIDR

SEQ ID NO: 14885 - protein, 249 aa, Artificial Sequence
  Synthetic sequence.
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNRDHMVLHEYVNAAGITRKLLEDVKKASEDIVREVERIVRELAKRSDEILKKLEDIVEKLRE

SEQ ID NO: 14886 - protein, 249 aa, Artificial Sequence; identical to SEQ ID NO: 14885
  Synthetic sequence.

SEQ ID NO: 14887 - protein, 240 aa, Artificial Sequence
  Synthetic sequence.
DKDKRLEELLKRLKELNDKTFEELERILEELKRANEASLREAERILEELRARIEGGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKDIIRDHMVLHEYVNAAGITDSRTNSEVVKRLLDLLREDSKANSEVVKRLLDVLRE

SEQ ID NO: 14888 - protein, 240 aa, Artificial Sequence
  Synthetic sequence.
SKEETLKRLLDELEKRNRETVERLERLLKELEDRNRASLEELEAVLEELERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRDHMVLHEYVNAAGITDVELNLDVAKKLLELLKEDSKLNLDVARELLELLDR

SEQ ID NO: 14889 - protein, 243 aa, Artificial Sequence
  Synthetic sequence.
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALRDHMVLHEYVNAAGITITKDLEAKLEKLLRDLNELTKALEEELKRLLDELKKRTD

SEQ ID NO: 14890 - protein, 243 aa, Artificial Sequence
  Synthetic sequence.
SEAERTKESLKKVLKALVDLNRELLRKLEENMRELTKLNEEVKRALKEVLDKVREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRRDHMVLHEYVNAAGITYREEVRKSKDKLRSILEDYKRKVDELKERLRELIEEVET

SEQ ID NO: 14891 - protein, 243 aa, Artificial Sequence; identical to SEQ ID NO: 14890
  Synthetic sequence.

SEQ ID NO: 14892 - protein, 245 aa, Artificial Sequence
  Synthetic sequence.
TEEEVLRKVEKLIKDLLDVLRDLLRASEEVVREALRVLEELIEENKRVIEELSRALSGGSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGSEEKLRDHMVLHEYVNAAGITDLRRELEKLLRDYKRELEEIERALEEIEKTLKRRADETRR

SEQ ID NO: 14893 - protein, 243 aa, Artificial Sequence
  Synthetic sequence.
KREDILKKLEDIIRDIIDKLRRILEKVKRLNEDIIREIKRLLDESLKTLEDLLKRIADKSRDRELEDILRRVLEKLRRSLDKLRDTLRKLKEETDTVLERAERTLKELKDRLEKLLRDGEKVSEEDLVEALKALIDELRKVLEDVIRVSKELVERLLRALREHLETNKRLVKELLDALRKTTGDDEEIKRDHMVLHEYVNAAGITVERVARELEKAHRDLERDIRRVAEELKKLLKKLRDDRR

SEQ ID NO: 14894 - protein, 244 aa, Artificial Sequence
  Synthetic sequence.
SAEETLRRITEESKRVLEEITKKYEDLERESREVLRKLREDLDRIKRELEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARDHMVLHEYVNAAGITILKINEELNRKIIKFARENLERNRRVNKKVIEVLREAAR

SEQ ID NO: 14895 - protein, 250 aa, Artificial Sequence
  Synthetic sequence.
STEEILKRVKEILDELAKELRDIIRESLRTIEELLDELRRILEESERTLEELVKTIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDRDHMVLHEYVNAAGITRTRYEELRRRLRKRVKDYEDKLREIEKKVRRDAERIEEELERAKK

SEQ ID NO: 14896 - protein, 247 aa, Artificial Sequence
  Synthetic sequence.
SEKEELLKLIKRVIELLKRVLEEHLRLVEDVIRRLKELLDSNEKIVREVIEDLKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASERDHMVLHEYVNAAGITLKRNLEDVRRVIEDVKRKSARILEEARRLIEEVERELEKIRK

SEQ ID NO: 14897 - protein, 247 aa, Artificial Sequence; identical to SEQ ID NO: 14896
  Synthetic sequence.

SEQ ID NO: 14898 - protein, 242 aa, Artificial Sequence
  Synthetic sequence.
SEKERLMRLLDKLKDLNRRLVERIKELLDKALELHKKLVKELRELLERLKELVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSEETVRRRDHMVLHEYVNAAGITRDAEREYKKLKDELEELTERYRREIRKLKEELKADRK

SEQ ID NO: 14899 - protein, 247 aa, Artificial Sequence
  Synthetic sequence.
SEAEDLEELIKELAELLKDVIRKLEKINRRLVKILEDIIRRLKEISKEAEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKRDHMVLHEYVNAAGITLREEHEEVKRRLEEELTRLRETHKKIEKELREALKRVRDRST

SEQ ID NO: 14900 - protein, 247 aa, Artificial Sequence; identical to SEQ ID NO: 14899
  Synthetic sequence.

SEQ ID NO: 14901 - protein, 248 aa, Artificial Sequence
  Synthetic sequence.
DEDRIIEEIARLLEELLRELLELIKKLIETNRRLNEEHERAVRELARLLEELLDRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDRDHMVLHEYVNAAGITMIKRLHEDLERKLKESEDELREIEARLEEKIRRLEEKLERKRR

SEQ ID NO: 14902 - protein, 248 aa, Artificial Sequence; identical to SEQ ID NO: 14901
  Synthetic sequence.

SEQ ID NO: 14903 - protein, 247 aa, Artificial Sequence
  Synthetic sequence.
SKAEKLLKDLREALEKVKRRYEELERRLDEVLKEHEEIVKRLLEELEKVLKRIEEGGLPEEELEKLKKLAEKVKELLRELLRLSKELVDRVRELLKRDLDLVRRLVEIALKVLREAREQPNDEKRVEKIKRDLEKKARRVREENERIKRDLKRTADESRKRLEKLLEDLKRELDRLREDLDRGRKDIDERDHMVLHEYVNAAGITLREVIKSHEKLVRTIERLIEESIRVNEELLEVIERLLDRARK

SEQ ID NO: 14904 - protein, 246 aa, Artificial Sequence
  Synthetic sequence.
KEIEETLKELEDLNREMVETNRRVLEETRRLNKETVDRVKATLDELAKMLKKLVDDVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTTGRDHMVLHEYVNAAGITRRLKEVIDRYEDELRKLRKEYKEKIDKYERKLEEIERRERT

SEQ ID NO: 14905 - protein, 246 aa, Artificial Sequence; identical to SEQ ID NO: 14904
  Synthetic sequence.

SEQ ID NO: 14906 - protein, 247 aa, Artificial Sequence
  Synthetic sequence.
RDRDVLRKVKAEIEELVARIEKVSRDALSEVKRLLDENRKIAEDVLRLIESLLRKIRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSERDHMVLHEYVNAAGITMKRVHDDLSRAVEKVVRDVVRVDKELLDELARILRRLEEVIT

SEQ ID NO: 14907 - protein, 241 aa, Artificial Sequence
  Synthetic sequence.
SEKELLKEILDRIRELLEDDNRLLKRIVDEIRKLLEEWLRVHKEILERIKELLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKIAKIRDHMVLHEYVNAAGITRVIEEAKRLLKEWRDRNKEVADTLKKLLEDLIRKIR

SEQ ID NO: 14908 - protein, 241 aa, Artificial Sequence; identical to SEQ ID NO: 14907
  Synthetic sequence.

SEQ ID NO: 14909 - protein, 246 aa, Artificial Sequence
  Synthetic sequence.
SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETRDHMVLHEYVNAAGITRRVLEELLKVLAEHLETVRELIERLKRVLEEAIEVVERVAR

SEQ ID NO: 14910 - protein, 240 aa, Artificial Sequence
  Synthetic sequence.
DREKSVRDIEEDLKRVLDKLRRRVETSKEELKKVLKADKENADELEKTLRDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVAKRDHMVLHEYVNAAGITTDRLKEVIDRNLADLRDLAEELRAVIERLLEDARR

SEQ ID NO: 14911 - protein, 240 aa, Artificial Sequence; identical to SEQ ID NO: 14910
  Synthetic sequence.

SEQ ID NO: 14912 - protein, 241 aa, Artificial Sequence
  Synthetic sequence.
SAEEAVEKLVRIARAIVKINEDLSREVVRILREIVRLNEETTRLLVEIAREVVKVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVSEELLRRLRDHMVLHEYVNAAGITELEKLKRELERLLEESRRKLEKLKRDLERVLEETRR

SEQ ID NO: 14913 - protein, 243 aa, Artificial Sequence
  Synthetic sequence.
SEAERLADEVRKAVKKSEEDNETLVREVEKAVRELKKNNKTWVDEVRKLMKRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRRDHMVLHEYVNAAGITVRLNNEILERLLKIVRELHKDNIKILEDLLRIIEEVLR

SEQ ID NO: 14914 - protein, 243 aa, Artificial Sequence; identical to SEQ ID NO: 14913
  Synthetic sequence.

SEQ ID NO: 14915 - protein, 247 aa, Artificial Sequence
  Synthetic sequence.
DEERLAEELERVLDRNRKLLEEALRELRRVIEENRKSVKRLLDELKRVLDELLKVLRELSRGDSDEELRKVIEDLIRKLTKVLDKVRSLVEENIERLARVLEKLERLARENLEDLKKVLDDVDKKLKDRRLVERLAELVRELIEVNKEILEMLKEIVRELLEINRTLLERLKDLVATALEIIKLLARGDRDHMVLHEYVNAAGITLRKLLEDYERAVRRLEDKLRRVRERYEAVLKRIKDKLEETKR

SEQ ID NO: 14916 - protein, 247 aa, Artificial Sequence; identical to SEQ ID NO: 14915
  Synthetic sequence.

SEQ ID NO: 14917 - protein, 243 aa, Artificial Sequence
  Synthetic sequence.
SRVEELKKLIEDILRISREVVERIARVAEDIHRINRRVLDDLRKLIEDILRTVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGDDRDHMVLHEYVNAAGITLEEYRRLLEEIKRKLEEILRRVEELHRRLRRKLEEIDR

SEQ ID NO: 14918 - protein, 243 aa, Artificial Sequence; identical to SEQ ID NO: 14917
  Synthetic sequence.

SEQ ID NO: 14919 - protein, 249 aa, Artificial Sequence
  Synthetic sequence.
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLRDHMVLHEYVNAAGITKLLEDVKKASEDIVREVERIVRELAKRSDEILKKLEDIVEKLRE

SEQ ID NO: 14920 - protein, 249 aa, Artificial Sequence; identical to SEQ ID NO: 14919
  Synthetic sequence.

SEQ ID NO: 14921 - protein, 240 aa, Artificial Sequence
  Synthetic sequence.
SKEETLKRLLDELEKRNRETVERLERLLKELEDRNRASLEELEAVLEELERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRRDHMVLHEYVNAAGITVELNLDVAKKLLELLKEDSKLNLDVARELLELLDR

SEQ ID NO: 14922 - protein, 240 aa, Artificial Sequence; identical to SEQ ID NO: 14921
  Synthetic sequence.

SEQ ID NO: 14923 - protein, 243 aa, Artificial Sequence
  Synthetic sequence.
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALERDHMVLHEYVNAAGITTKDLEAKLEKLLRDLNELTKALEEELKRLLDELKKRTD

SEQ ID NO: 14924 - protein, 243 aa, Artificial Sequence; identical to SEQ ID NO: 14923
  Synthetic sequence.

SEQ ID NO: 14925 - protein, 243 aa, Artificial Sequence
  Synthetic sequence.
SEAERTKESLKKVLKALVDLNRELLRKLEENMRELTKLNEEVKRALKEVLDKVREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRKRDHMVLHEYVNAAGITREEVRKSKDKLRSILEDYKRKVDELKERLRELIEEVET

SEQ ID NO: 14926 - protein, 241 aa, Artificial Sequence
  Synthetic sequence.
SADEALEELVRRLLEVLKTVLERTKELSRDDLRVVKEVLRIIEELVKRLLKVIRDGLDDADRVLEEVERVIREAKREVKRWEEVVRKVVEDSRRLIERVLAEVEEVIKEAKRLLDERKSGGSREVIEELLSLLREIVRHHKEVSDEHLKLSAELVKRILDVVEETLRLATEIVRRIKEGGNSEDVRRDIRDHMVLHEYVNAAGITDIERLLAELEKLNEDVLRENKALLEDLERRVRERKK

SEQ ID NO: 14927 - protein, 245 aa, Artificial Sequence
  Synthetic sequence.
TEEEVLRKVEKLIKDLLDVLRDLLRASEEVVREALRVLEELIEENKRVIEELSRALSGGSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGSEEKLRRDHMVLHEYVNAAGITLRRELEKLLRDYKRELEEIERALEEIEKTLKRRADETRR

SEQ ID NO: 14928 - protein, 245 aa, Artificial Sequence; identical to SEQ ID NO: 14927
  Synthetic sequence.

SEQ ID NO: 14929 - protein, 243 aa, Artificial Sequence
  Synthetic sequence.
KREDILKKLEDIIRDIIDKLRRILEKVKRLNEDIIREIKRLLDESLKTLEDLLKRIADKSRDRELEDILRRVLEKLRRSLDKLRDTLRKLKEETDTVLERAERTLKELKDRLEKLLRDGEKVSEEDLVEALKALIDELRKVLEDVIRVSKELVERLLRALREHLETNKRLVKELLDALRKTTGDDEEIKRRDHMVLHEYVNAAGITERVARELEKAHRDLERDIRRVAEELKKLLKKLRDDRR

SEQ ID NO: 14930 - protein, 244 aa, Artificial Sequence
  Synthetic sequence.
SAEETLRRITEESKRVLEEITKKYEDLERESREVLRKLREDLDRIKRELEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARRDHMVLHEYVNAAGITLKINEELNRKIIKFARENLERNRRVNKKVIEVLREAAR

SEQ ID NO: 14931 - protein, 250 aa, Artificial Sequence
  Synthetic sequence.
STEEILKRVKEILDELAKELRDIIRESLRTIEELLDELRRILEESERTLEELVKTIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGRDHMVLHEYVNAAGITTRYEELRRRLRKRVKDYEDKLREIEKKVRRDAERIEEELERAKK

SEQ ID NO: 14932 - protein, 247 aa, Artificial Sequence
  Synthetic sequence.
SEKEELLKLIKRVIELLKRVLEEHLRLVEDVIRRLKELLDSNEKIVREVIEDLKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASEDRDHMVLHEYVNAAGITKRNLEDVRRVIEDVKRKSARILEEARRLIEEVERELEKIRK

SEQ ID NO: 14933 - protein, 247 aa, Artificial Sequence; identical to SEQ ID NO: 14932
  Synthetic sequence.

SEQ ID NO: 14934 - protein, 242 aa, Artificial Sequence
  Synthetic sequence.
SEKERLMRLLDKLKDLNRRLVERIKELLDKALELHKKLVKELRELLERLKELVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSEETVRRLRDHMVLHEYVNAAGITDAEREYKKLKDELEELTERYRREIRKLKEELKADRK

SEQ ID NO: 14935 - protein, 247 aa, Artificial Sequence
  Synthetic sequence.
SEAEDLEELIKELAELLKDVIRKLEKINRRLVKILEDIIRRLKEISKEAEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDRDHMVLHEYVNAAGITREEHEEVKRRLEEELTRLRETHKKIEKELREALKRVRDRST

SEQ ID NO: 14936 - protein, 247 aa, Artificial Sequence; identical to SEQ ID NO: 14935
  Synthetic sequence.

SEQ ID NO: 14937 - protein, 248 aa, Artificial Sequence
  Synthetic sequence.
DEEERVKKLLTDLRRLLRKLHEESKKLLDELRKKLRELRRRSEEKLREVERRLREAEKKLPGTRVLKLVADVVKKVLDAIRDLNRKLEEIIDEALKLLEELDDILRRVVEEALRLLKEIKDTKGDREEVKKRVEDILKRLEELVKEYEDRVREIKKRLRRALEELRDEYRKIREDIERVLDELRKGGVPERDHMVLHEYVNAAGITLDENLKMVERLIRELEKVLDDHERKVRRLIEELLEVLDRDAK

SEQ ID NO: 14938 - protein, 248 aa, Artificial Sequence
  Synthetic sequence.
DEDRIIEEIARLLEELLRELLELIKKLIETNRRLNEEHERAVRELARLLEELLDRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDERDHMVLHEYVNAAGITIKRLHEDLERKLKESEDELREIEARLEEKIRRLEEKLERKRR

SEQ ID NO: 14939 - protein, 248 aa, Artificial Sequence; identical to SEQ ID NO: 14938
  Synthetic sequence.

SEQ ID NO: 14940 - protein, 251 aa, Artificial Sequence
  Synthetic sequence.
DEEEKIRTTLDLLRKLLKVLREILEELIRSNKELNERLLRLVEDSDRLLEELLKKLADDGGVDEEALRRIKKRLEDLIRTNREIEERIDRESERLAEELRRILRELEKELRRLIEDLKEVLKRGLPREELLRRLKKVVEDVLRILEEVLRVVDELDKENVRLLREWLERNKEIVEEVIRILEDLIRKGGSRDHMVLHEYVNAAGITREKHAEIAKELERLLRENRRRLEELAREAKKVLDELRKRLEDERR

SEQ ID NO: 14941 - protein, 246 aa, Artificial Sequence
  Synthetic sequence.
SREEIVATLEDLARKILEVVKKLAKEIEDAWREIERAVREILKRLEELWREIEDVVRKKVDSRVAEILETVVKRVVDITRRLIEEAERVVRELVDITRKLITILEEVVRRLVEIVREASKIDDRRELEDMLRKIREVVREVIERLKKLDEDVRRVVEEVIRRLEELNKRLEDVIREVKKRLKELGLSEEARDHMVLHEYVNAAGITRVIKEIIDLLRTVIRIHEKIVEDLIKLLEELLRRLEEATR

SEQ ID NO: 14942 - protein, 241 aa, Artificial Sequence
  Synthetic sequence.
SEKELLKEILDRIRELLEDDNRLLKRIVDEIRKLLEEWLRVHKEILERIKELLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKIAKIIRDHMVLHEYVNAAGITVIEEAKRLLKEWRDRNKEVADTLKKLLEDLIRKIR

SEQ ID NO: 14943 - protein, 246 aa, Artificial Sequence
  Synthetic sequence.
SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETARDHMVLHEYVNAAGITRVLEELLKVLAEHLETVRELIERLKRVLEEAIEVVERVAR

SEQ ID NO: 14944 - protein, 246 aa, Artificial Sequence; identical to SEQ ID NO: 14943
  Synthetic sequence.

SEQ ID NO: 14945 - protein, 245 aa, Artificial Sequence
  Synthetic sequence.
SEKDEVTRRIRELLKEAEETNREAIERIKRLLDRVREAVEEVAKRSEELLRRLKKVLDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSGSKERDHMVLHEYVNAAGITIRELLKEIEKIVKEIIELLERLNDELRKIIEAILETTKK

SEQ ID NO: 14946 - protein, 247 aa, Artificial Sequence
  Synthetic sequence.
DEERLAEELERVLDRNRKLLEEALRELRRVIEENRKSVKRLLDELKRVLDELLKVLRELSRGDSDEELRKVIEDLIRKLTKVLDKVRSLVEENIERLARVLEKLERLARENLEDLKKVLDDVDKKLKDRRLVERLAELVRELIEVNKEILEMLKEIVRELLEINRTLLERLKDLVATALEIIKLLARGDGRDHMVLHEYVNAAGITRKLLEDYERAVRRLEDKLRRVRERYEAVLKRIKDKLEETKR

SEQ ID NO: 14947 - protein, 243 aa, Artificial Sequence
  Synthetic sequence.
SRVEELKKLIEDILRISREVVERIARVAEDIHRINRRVLDDLRKLIEDILRTVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGDDERDHMVLHEYVNAAGITEEYRRLLEEIKRKLEEILRRVEELHRRLRRKLEEIDR

SEQ ID NO: 14948 - protein, 249 aa, Artificial Sequence
  Synthetic sequence.
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDRDHMVLHEYVNAAGITLLEDVKKASEDIVREVERIVRELAKRSDEILKKLEDIVEKLRE

SEQ ID NO: 14949 - protein, 249 aa, Artificial Sequence; identical to SEQ ID NO: 14948
  Synthetic sequence.

SEQ ID NO: 14950 - protein, 243 aa, Artificial Sequence
  Synthetic sequence.
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEERDHMVLHEYVNAAGITKDLEAKLEKLLRDLNELTKALEEELKRLLDELKKRTD

SEQ ID NO: 14951 - protein, 243 aa, Artificial Sequence; identical to SEQ ID NO: 14950
  Synthetic sequence.

SEQ ID NO: 14952 - protein, 243 aa, Artificial Sequence
  Synthetic sequence.
SEAERTKESLKKVLKALVDLNRELLRKLEENMRELTKLNEEVKRALKEVLDKVREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRKIRDHMVLHEYVNAAGITEEVRKSKDKLRSILEDYKRKVDELKERLRELIEEVET

SEQ ID NO: 14953 - protein, 243 aa, Artificial Sequence; identical to SEQ ID NO: 14952
  Synthetic sequence.

SEQ ID NO: 14954 - protein, 241 aa, Artificial Sequence
  Synthetic sequence.
SADEALEELVRRLLEVLKTVLERTKELSRDDLRVVKEVLRIIEELVKRLLKVIRDGLDDADRVLEEVERVIREAKREVKRWEEVVRKVVEDSRRLIERVLAEVEEVIKEAKRLLDERKSGGSREVIEELLSLLREIVRHHKEVSDEHLKLSAELVKRILDVVEETLRLATEIVRRIKEGGNSEDVRRDIERDHMVLHEYVNAAGITIERLLAELEKLNEDVLRENKALLEDLERRVRERKK

SEQ ID NO: 14955 - protein, 245 aa, Artificial Sequence
  Synthetic sequence.
TEEEVLRKVEKLIKDLLDVLRDLLRASEEVVREALRVLEELIEENKRVIEELSRALSGGSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGSEEKLRRRDHMVLHEYVNAAGITRRELEKLLRDYKRELEEIERALEEIEKTLKRRADETRR

SEQ ID NO: 14956 - protein, 245 aa, Artificial Sequence; identical to SEQ ID NO: 14955
  Synthetic sequence.

SEQ ID NO: 14957 - protein, 244 aa, Artificial Sequence
  Synthetic sequence.
SAEETLRRITEESKRVLEEITKKYEDLERESREVLRKLREDLDRIKRELEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARLRDHMVLHEYVNAAGITKINEELNRKIIKFARENLERNRRVNKKVIEVLREAAR

SEQ ID NO: 14958 - protein, 250 aa, Artificial Sequence
  Synthetic sequence.
STEEILKRVKEILDELAKELRDIIRESLRTIEELLDELRRILEESERTLEELVKTIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPRDHMVLHEYVNAAGITRYEELRRRLRKRVKDYEDKLREIEKKVRRDAERIEEELERAKK

SEQ ID NO: 14959 - protein, 247 aa, Artificial Sequence
  Synthetic sequence.
SEKEELLKLIKRVIELLKRVLEEHLRLVEDVIRRLKELLDSNEKIVREVIEDLKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASEDLRDHMVLHEYVNAAGITRNLEDVRRVIEDVKRKSARILEEARRLIEEVERELEKIRK

SEQ ID NO: 14960 - protein, 247 aa, Artificial Sequence; identical to SEQ ID NO: 14959
  Synthetic sequence.

SEQ ID NO: 14961 - protein, 242 aa, Artificial Sequence
  Synthetic sequence.
SEKERLMRLLDKLKDLNRRLVERIKELLDKALELHKKLVKELRELLERLKELVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSEETVRRLRRDHMVLHEYVNAAGITAEREYKKLKDELEELTERYRREIRKLKEELKADRK

SEQ ID NO: 14962 - protein, 242 aa, Artificial Sequence; identical to SEQ ID NO: 14961
  Synthetic sequence.

SEQ ID NO: 14963 - protein, 247 aa, Artificial Sequence
  Synthetic sequence.
SEAEDLEELIKELAELLKDVIRKLEKINRRLVKILEDIIRRLKEISKEAEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDERDHMVLHEYVNAAGITEEHEEVKRRLEEELTRLRETHKKIEKELREALKRVRDRST

SEQ ID NO: 14964 - protein, 247 aa, Artificial Sequence; identical to SEQ ID NO: 14963
  Synthetic sequence.

SEQ ID NO: 14965 - protein, 248 aa, Artificial Sequence
  Synthetic sequence.
DEDRIIEEIARLLEELLRELLELIKKLIETNRRLNEEHERAVRELARLLEELLDRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKRDHMVLHEYVNAAGITKRLHEDLERKLKESEDELREIEARLEEKIRRLEEKLERKRR

SEQ ID NO: 14966 - protein, 248 aa, Artificial Sequence; identical to SEQ ID NO: 14965
  Synthetic sequence.

SEQ ID NO: 14967 - protein, 251 aa, Artificial Sequence
  Synthetic sequence.
DEEEKIRTTLDLLRKLLKVLREILEELIRSNKELNERLLRLVEDSDRLLEELLKKLADDGGVDEEALRRIKKRLEDLIRTNREIEERIDRESERLAEELRRILRELEKELRRLIEDLKEVLKRGLPREELLRRLKKVVEDVLRILEEVLRVVDELDKENVRLLREWLERNKEIVEEVIRILEDLIRKGGSERDHMVLHEYVNAAGITEKHAEIAKELERLLRENRRRLEELAREAKKVLDELRKRLEDERR

SEQ ID NO: 14968 - protein, 246 aa, Artificial Sequence
  Synthetic sequence.
KEIEETLKELEDLNREMVETNRRVLEETRRLNKETVDRVKATLDELAKMLKKLVDDVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTTGGDRDHMVLHEYVNAAGITLKEVIDRYEDELRKLRKEYKEKIDKYERKLEEIERRERT

SEQ ID NO: 14969 - protein, 245 aa, Artificial Sequence
  Synthetic sequence.
DEDELIRKLLEDLKDIVRKILELIERDLRDIERVVRRIVKVIRDDLKKIKEVVDDIARGVPRTEELERVIKRIEELLRTSEEELDRILKEIEELLRESRRRLEEVVSAVEELLRRVEEIVDKGRESKEDVIKLLREVVDDILRLVEEVVRTNLEIIKRILELIERVIRLNLSIIRDILRLLEGTVDSELADRDHMVLHEYVNAAGITLEDVKRAITELRKNSKDILEEVRKLIDELRKRIKEVED

SEQ ID NO: 14970 - protein, 247 aa, Artificial Sequence
  Synthetic sequence.
RDRDVLRKVKAEIEELVARIEKVSRDALSEVKRLLDENRKIAEDVLRLIESLLRKIRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSEEVRDHMVLHEYVNAAGITRVHDDLSRAVEKVVRDVVRVDKELLDELARILRRLEEVIT

SEQ ID NO: 14971 - protein, 243 aa, Artificial Sequence
  Synthetic sequence.
SEAERLADEVRKAVKKSEEDNETLVREVEKAVRELKKNNKTWVDEVRKLMKRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIARDHMVLHEYVNAAGITLNNEILERLLKIVRELHKDNIKILEDLLRIIEEVLR

SEQ ID NO: 14972 - protein, 243 aa, Artificial Sequence; identical to SEQ ID NO: 14971
  Synthetic sequence.

SEQ ID NO: 14973 - protein, 245 aa, Artificial Sequence
  Synthetic sequence.
SEKDEVTRRIRELLKEAEETNREAIERIKRLLDRVREAVEEVAKRSEELLRRLKKVLDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSGSKEDRDHMVLHEYVNAAGITRELLKEIEKIVKEIIELLERLNDELRKIIEAILETTKK

SEQ ID NO: 14974 - protein, 247 aa, Artificial Sequence
  Synthetic sequence.
DEERLAEELERVLDRNRKLLEEALRELRRVIEENRKSVKRLLDELKRVLDELLKVLRELSRGDSDEELRKVIEDLIRKLTKVLDKVRSLVEENIERLARVLEKLERLARENLEDLKKVLDDVDKKLKDRRLVERLAELVRELIEVNKEILEMLKEIVRELLEINRTLLERLKDLVATALEIIKLLARGDGTRDHMVLHEYVNAAGITKLLEDYERAVRRLEDKLRRVRERYEAVLKRIKDKLEETKR

SEQ ID NO: 14975 - protein, 247 aa, Artificial Sequence; identical to SEQ ID NO: 14974
  Synthetic sequence.

SEQ ID NO: 14976 - protein, 243 aa, Artificial Sequence
  Synthetic sequence.
SRVEELKKLIEDILRISREVVERIARVAEDIHRINRRVLDDLRKLIEDILRTVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGDDEVRDHMVLHEYVNAAGITEYRRLLEEIKRKLEEILRRVEELHRRLRRKLEEIDR

SEQ ID NO: 14977 - protein, 249 aa, Artificial Sequence
  Synthetic sequence.
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDERDHMVLHEYVNAAGITLEDVKKASEDIVREVERIVRELAKRSDEILKKLEDIVEKLRE

SEQ ID NO: 14978 - protein, 249 aa, Artificial Sequence; identical to SEQ ID NO: 14977
  Synthetic sequence.

SEQ ID NO: 14979 - protein, 243 aa, Artificial Sequence
  Synthetic sequence.
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEEARDHMVLHEYVNAAGITDLEAKLEKLLRDLNELTKALEEELKRLLDELKKRTD

SEQ ID NO: 14980 - protein, 243 aa, Artificial Sequence; identical to SEQ ID NO: 14979
  Synthetic sequence.

SEQ ID NO: 14981 - protein, 245 aa, Artificial Sequence
  Synthetic sequence.
TEEEVLRKVEKLIKDLLDVLRDLLRASEEVVREALRVLEELIEENKRVIEELSRALSGGSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGSEEKLRRDRDHMVLHEYVNAAGITRELEKLLRDYKRELEEIERALEEIEKTLKRRADETRR

SEQ ID NO: 14982 - protein, 245 aa, Artificial Sequence; identical to SEQ ID NO: 14981
  Synthetic sequence.

SEQ ID NO: 14983 - protein, 244 aa, Artificial Sequence
  Synthetic sequence.
SAEETLRRITEESKRVLEEITKKYEDLERESREVLRKLREDLDRIKRELEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARLLRDHMVLHEYVNAAGITINEELNRKIIKFARENLERNRRVNKKVIEVLREAAR

SEQ ID NO: 14984 - protein, 250 aa, Artificial Sequence
  Synthetic sequence.
STEEILKRVKEILDELAKELRDIIRESLRTIEELLDELRRILEESERTLEELVKTIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPDRDHMVLHEYVNAAGITYEELRRRLRKRVKDYEDKLREIEKKVRRDAERIEEELERAKK

SEQ ID NO: 14985 - protein, 250 aa, Artificial Sequence; identical to SEQ ID NO: 14984
  Synthetic sequence.

SEQ ID NO: 14986 - protein, 247 aa, Artificial Sequence
  Synthetic sequence.
SEKEELLKLIKRVIELLKRVLEEHLRLVEDVIRRLKELLDSNEKIVREVIEDLKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASEDLLRDHMVLHEYVNAAGITNLEDVRRVIEDVKRKSARILEEARRLIEEVERELEKIRK

SEQ ID NO: 14987 - protein, 247 aa, Artificial Sequence; identical to SEQ ID NO: 14986
  Synthetic sequence.

SEQ ID NO: 14988 - protein, 247 aa, Artificial Sequence
  Synthetic sequence.
SEAEDLEELIKELAELLKDVIRKLEKINRRLVKILEDIIRRLKEISKEAEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDEARDHMVLHEYVNAAGITEHEEVKRRLEEELTRLRETHKKIEKELREALKRVRDRST

SEQ ID NO: 14989 - protein, 247 aa, Artificial Sequence; identical to SEQ ID NO: 14988
  Synthetic sequence.

SEQ ID NO: 14990 - protein, 248 aa, Artificial Sequence
  Synthetic sequence.
DEDRIIEEIARLLEELLRELLELIKKLIETNRRLNEEHERAVRELARLLEELLDRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIRDHMVLHEYVNAAGITRLHEDLERKLKESEDELREIEARLEEKIRRLEEKLERKRR

SEQ ID NO: 14991 - protein, 251 aa, Artificial Sequence
  Synthetic sequence.
DEEEKIRTTLDLLRKLLKVLREILEELIRSNKELNERLLRLVEDSDRLLEELLKKLADDGGVDEEALRRIKKRLEDLIRTNREIEERIDRESERLAEELRRILRELEKELRRLIEDLKEVLKRGLPREELLRRLKKVVEDVLRILEEVLRVVDELDKENVRLLREWLERNKEIVEEVIRILEDLIRKGGSESRDHMVLHEYVNAAGITKHAEIAKELERLLRENRRRLEELAREAKKVLDELRKRLEDERR

SEQ ID NO: 14992 - protein, 247 aa, Artificial Sequence
  Synthetic sequence.
SKAEKLLKDLREALEKVKRRYEELERRLDEVLKEHEEIVKRLLEELEKVLKRIEEGGLPEEELEKLKKLAEKVKELLRELLRLSKELVDRVRELLKRDLDLVRRLVEIALKVLREAREQPNDEKRVEKIKRDLEKKARRVREENERIKRDLKRTADESRKRLEKLLEDLKRELDRLREDLDRGRKDIDERVERDHMVLHEYVNAAGITVIKSHEKLVRTIERLIEESIRVNEELLEVIERLLDRARK

SEQ ID NO: 14993 - protein, 243 aa, Artificial Sequence
  Synthetic sequence.
DLERVVEDIVDKAKRLLDKNLEVLKRIVDEVLRLLERLLRESRKVVKRVKEIIEELVRDEKELRRVKRALEEVLRRHEEIAKELKERLRKVAKEAEEKHKKLVEDLKRVVDEVRKKLSGPLDREKVLEVLDELVTIIAKLLDENIKVLEEVIRVIAELLERLLDSHRRLIDIIAKLLEGLRPGDEDLLTELERDHMVLHEYVNAAGITLKKELERIKREVKRLIEENARTLADIKRAVDEARK

SEQ ID NO: 14994 - protein, 246 aa, Artificial Sequence
  Synthetic sequence.
KEIEETLKELEDLNREMVETNRRVLEETRRLNKETVDRVKATLDELAKMLKKLVDDVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTTGGDKRDHMVLHEYVNAAGITKEVIDRYEDELRKLRKEYKEKIDKYERKLEEIERRERT

SEQ ID NO: 14995 - protein, 246 aa, Artificial Sequence
  Synthetic sequence.
SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETAVRRDHMVLHEYVNAAGITLEELLKVLAEHLETVRELIERLKRVLEEAIEVVERVAR

SEQ ID NO: 14996 - protein, 252 aa, Artificial Sequence
  Synthetic sequence.
SLEEITKRLLELVEENLARHEEILRELLELAKRLAKEDRDILEEVLKLIEELLKLLEDNGSSEEDLKRLLKEVIEELRAVVKRVKDKWDEVVKRIEDLVKKLKELHDDTLRKLRELVRKIVTDISESGGEAEKVKRVVEKILELVERLAKVVKESVEKLLEILRELAEVSKRVAEALLRLLEELVRVIRIKDRDHMVLHEYVNAAGITRLLDELEEVHKRVKKELEDIIEENRRVVKRVRDELREIKRELDE

SEQ ID NO: 14997 - protein, 243 aa, Artificial Sequence
  Synthetic sequence.
SEAERLADEVRKAVKKSEEDNETLVREVEKAVRELKKNNKTWVDEVRKLMKRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIRDHMVLHEYVNAAGITNNEILERLLKIVRELHKDNIKILEDLLRIIEEVLR

SEQ ID NO: 14998 - protein, 243 aa, Artificial Sequence; identical to SEQ ID NO: 14997
  Synthetic sequence.

SEQ ID NO: 14999 - protein, 243 aa, Artificial Sequence
  Synthetic sequence.
SRVEELKKLIEDILRISREVVERIARVAEDIHRINRRVLDDLRKLIEDILRTVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGDDEVERDHMVLHEYVNAAGITYRRLLEEIKRKLEEILRRVEELHRRLRRKLEEIDR

SEQ ID NO: 15000 - protein, 249 aa, Artificial Sequence
  Synthetic sequence.
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDRDHMVLHEYVNAAGITEDVKKASEDIVREVERIVRELAKRSDEILKKLEDIVEKLRE

SEQ ID NO: 15001 - protein, 249 aa, Artificial Sequence; identical to SEQ ID NO: 15000
  Synthetic sequence.

SEQ ID NO: 15002 - protein, 243 aa, Artificial Sequence
  Synthetic sequence.
DEEETLRRLLERKVELAKEYLDVSKEVIDRTTKLLDEYLKTSKRIVDATVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEEARRDHMVLHEYVNAAGITLEAKLEKLLRDLNELTKALEEELKRLLDELKKRTD

SEQ ID NO: 15003 - protein, 243 aa, Artificial Sequence; identical to SEQ ID NO: 15002
  Synthetic sequence.

SEQ ID NO: 15004 - protein, 245 aa, Artificial Sequence
  Synthetic sequence.
TEEEVLRKVEKLIKDLLDVLRDLLRASEEVVREALRVLEELIEENKRVIEELSRALSGGSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGSEEKLRRDLRDHMVLHEYVNAAGITELEKLLRDYKRELEEIERALEEIEKTLKRRADETRR

SEQ ID NO: 15005 - protein, 244 aa, Artificial Sequence
  Synthetic sequence.
SAEETLRRITEESKRVLEEITKKYEDLERESREVLRKLREDLDRIKRELEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARLLKRDHMVLHEYVNAAGITNEELNRKIIKFARENLERNRRVNKKVIEVLREAAR

SEQ ID NO: 15006 - protein, 250 aa, Artificial Sequence
  Synthetic sequence.
STEEILKRVKEILDELAKELRDIIRESLRTIEELLDELRRILEESERTLEELVKTIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPDERDHMVLHEYVNAAGITEELRRRLRKRVKDYEDKLREIEKKVRRDAERIEEELERAKK

SEQ ID NO: 15007 - protein, 247 aa, Artificial Sequence
  Synthetic sequence.
SEAEDLEELIKELAELLKDVIRKLEKINRRLVKILEDIIRRLKEISKEAEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDEAERDHMVLHEYVNAAGITHEEVKRRLEEELTRLRETHKKIEKELREALKRVRDRST

SEQ ID NO: 15008 - protein, 247 aa, Artificial Sequence; identical to SEQ ID NO: 15007
  Synthetic sequence.

SEQ ID NO: 15009 - protein, 248 aa, Artificial Sequence
  Synthetic sequence.
DEDRIIEEIARLLEELLRELLELIKKLIETNRRLNEEHERAVRELARLLEELLDRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIARDHMVLHEYVNAAGITLHEDLERKLKESEDELREIEARLEEKIRRLEEKLERKRR

SEQ ID NO: 15010 - protein, 251 aa, Artificial Sequence
  Synthetic sequence.
DEEEKIRTTLDLLRKLLKVLREILEELIRSNKELNERLLRLVEDSDRLLEELLKKLADDGGVDEEALRRIKKRLEDLIRTNREIEERIDRESERLAEELRRILRELEKELRRLIEDLKEVLKRGLPREELLRRLKKVVEDVLRILEEVLRVVDELDKENVRLLREWLERNKEIVEEVIRILEDLIRKGGSESERDHMVLHEYVNAAGITHAEIAKELERLLRENRRRLEELAREAKKVLDELRKRLEDERR

SEQ ID NO: 15011 - protein, 246 aa, Artificial Sequence
  Synthetic sequence.
KEIEETLKELEDLNREMVETNRRVLEETRRLNKETVDRVKATLDELAKMLKKLVDDVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTTGGDKARDHMVLHEYVNAAGITEVIDRYEDELRKLRKEYKEKIDKYERKLEEIERRERT

SEQ ID NO: 15012 - protein, 247 aa, Artificial Sequence
  Synthetic sequence.
RDRDVLRKVKAEIEELVARIEKVSRDALSEVKRLLDENRKIAEDVLRLIESLLRKIRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSEEVVERDHMVLHEYVNAAGITHDDLSRAVEKVVRDVVRVDKELLDELARILRRLEEVIT

SEQ ID NO: 15013 - protein, 246 aa, Artificial Sequence
  Synthetic sequence.
SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETAVRARDHMVLHEYVNAAGITEELLKVLAEHLETVRELIERLKRVLEEAIEVVERVAR

SEQ ID NO: 15014 - protein, 252 aa, Artificial Sequence
  Synthetic sequence.
SLEEITKRLLELVEENLARHEEILRELLELAKRLAKEDRDILEEVLKLIEELLKLLEDNGSSEEDLKRLLKEVIEELRAVVKRVKDKWDEVVKRIEDLVKKLKELHDDTLRKLRELVRKIVTDISESGGEAEKVKRVVEKILELVERLAKVVKESVEKLLEILRELAEVSKRVAEALLRLLEELVRVIRIKDERDHMVLHEYVNAAGITLLDELEEVHKRVKKELEDIIEENRRVVKRVRDELREIKRELDE

SEQ ID NO: 15015 - protein, 249 aa, Artificial Sequence
  Synthetic sequence.
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVRDHMVLHEYVNAAGITDVKKASEDIVREVERIVRELAKRSDEILKKLEDIVEKLRE

SEQ ID NO: 15016 - protein, 249 aa, Artificial Sequence; identical to SEQ ID NO: 15015
  Synthetic sequence.

SEQ ID NO: 15017 - protein, 245 aa, Artificial Sequence
  Synthetic sequence.
TEEEVLRKVEKLIKDLLDVLRDLLRASEEVVREALRVLEELIEENKRVIEELSRALSGGSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGSEEKLRRDLTRDHMVLHEYVNAAGITLEKLLRDYKRELEEIERALEEIEKTLKRRADETRR

SEQ ID NO: 15018 - protein, 245 aa, Artificial Sequence; identical to SEQ ID NO: 15017
  Synthetic sequence.

SEQ ID NO: 15019 - protein, 250 aa, Artificial Sequence
  Synthetic sequence.
STEEILKRVKEILDELAKELRDIIRESLRTIEELLDELRRILEESERTLEELVKTIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPDEVRDHMVLHEYVNAAGITELRRRLRKRVKDYEDKLREIEKKVRRDAERIEEELERAKK

SEQ ID NO: 15020 - protein, 250 aa, Artificial Sequence; identical to SEQ ID NO: 15019
  Synthetic sequence.

SEQ ID NO: 15021 - protein, 247 aa, Artificial Sequence
  Synthetic sequence.
SEKEELLKLIKRVIELLKRVLEEHLRLVEDVIRRLKELLDSNEKIVREVIEDLKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASEDLLRKRDHMVLHEYVNAAGITEDVRRVIEDVKRKSARILEEARRLIEEVERELEKIRK

SEQ ID NO: 15022 - protein, 247 aa, Artificial Sequence
  Synthetic sequence.
SEAEDLEELIKELAELLKDVIRKLEKINRRLVKILEDIIRRLKEISKEAEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDEAERRDHMVLHEYVNAAGITEEVKRRLEEELTRLRETHKKIEKELREALKRVRDRST

SEQ ID NO: 15023 - protein, 247 aa, Artificial Sequence; identical to SEQ ID NO: 15022
  Synthetic sequence.

SEQ ID NO: 15024 - protein, 248 aa, Artificial Sequence
  Synthetic sequence.
DEDRIIEEIARLLEELLRELLELIKKLIETNRRLNEEHERAVRELARLLEELLDRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIAERDHMVLHEYVNAAGITHEDLERKLKESEDELREIEARLEEKIRRLEEKLERKRR

SEQ ID NO: 15025 - protein, 251 aa, Artificial Sequence
  Synthetic sequence.
DEEEKIRTTLDLLRKLLKVLREILEELIRSNKELNERLLRLVEDSDRLLEELLKKLADDGGVDEEALRRIKKRLEDLIRTNREIEERIDRESERLAEELRRILRELEKELRRLIEDLKEVLKRGLPREELLRRLKKVVEDVLRILEEVLRVVDELDKENVRLLREWLERNKEIVEEVIRILEDLIRKGGSESEERDHMVLHEYVNAAGITAEIAKELERLLRENRRRLEELAREAKKVLDELRKRLEDERR

SEQ ID NO: 15026 - protein, 246 aa, Artificial Sequence
  Synthetic sequence.
KEIEETLKELEDLNREMVETNRRVLEETRRLNKETVDRVKATLDELAKMLKKLVDDVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTTGGDKAVRDHMVLHEYVNAAGITVIDRYEDELRKLRKEYKEKIDKYERKLEEIERRERT

SEQ ID NO: 15027 - protein, 246 aa, Artificial Sequence
  Synthetic sequence.
SREEIVATLEDLARKILEVVKKLAKEIEDAWREIERAVREILKRLEELWREIEDVVRKKVDSRVAEILETVVKRVVDITRRLIEEAERVVRELVDITRKLITILEEVVRRLVEIVREASKIDDRRELEDMLRKIREVVREVIERLKKLDEDVRRVVEEVIRRLEELNKRLEDVIREVKKRLKELGLSEEAVKELRDHMVLHEYVNAAGITEIIDLLRTVIRIHEKIVEDLIKLLEELLRRLEEATR

SEQ ID NO: 15028 - protein, 246 aa, Artificial Sequence
  Synthetic sequence.
SEREELLERIKEILKRVKDKLDEDLKRLKEILEKLKEKADRDLEELRRRIEEVREKLERTGRTDELVKEVLDTVRRNLENLKRLVEDILRKLEENVKNLTDLVREILKLITELIKRLEDGGLPKEVLDALRRVLEKLEELLREILERLKRSLEAVKRKIEELLKELERSLDELRRALERIRKEIGDSETAVRAIRDHMVLHEYVNAAGITELLKVLAEHLETVRELIERLKRVLEEAIEVVERVAR

SEQ ID NO: 15029 - protein, 246 aa, Artificial Sequence; identical to SEQ ID NO: 15028
  Synthetic sequence.

SEQ ID NO: 15030 - protein, 252 aa, Artificial Sequence
  Synthetic sequence.
SLEEITKRLLELVEENLARHEEILRELLELAKRLAKEDRDILEEVLKLIEELLKLLEDNGSSEEDLKRLLKEVIEELRAVVKRVKDKWDEVVKRIEDLVKKLKELHDDTLRKLRELVRKIVTDISESGGEAEKVKRVVEKILELVERLAKVVKESVEKLLEILRELAEVSKRVAEALLRLLEELVRVIRIKDERRDHMVLHEYVNAAGITLDELEEVHKRVKKELEDIIEENRRVVKRVRDELREIKRELDE

SEQ ID NO: 15031 - protein, 247 aa, Artificial Sequence
  Synthetic sequence.
DEERLAEELERVLDRNRKLLEEALRELRRVIEENRKSVKRLLDELKRVLDELLKVLRELSRGDSDEELRKVIEDLIRKLTKVLDKVRSLVEENIERLARVLEKLERLARENLEDLKKVLDDVDKKLKDRRLVERLAELVRELIEVNKEILEMLKEIVRELLEINRTLLERLKDLVATALEIIKLLARGDGTEEDRDHMVLHEYVNAAGITEDYERAVRRLEDKLRRVRERYEAVLKRIKDKLEETKR

SEQ ID NO: 15032 - protein, 249 aa, Artificial Sequence
  Synthetic sequence.
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRDHMVLHEYVNAAGITVKKASEDIVREVERIVRELAKRSDEILKKLEDIVEKLRE

SEQ ID NO: 15033 - protein, 249 aa, Artificial Sequence; identical to SEQ ID NO: 15032
  Synthetic sequence.

SEQ ID NO: 15034 - protein, 250 aa, Artificial Sequence
  Synthetic sequence.
STEEILKRVKEILDELAKELRDIIRESLRTIEELLDELRRILEESERTLEELVKTIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPDEVKRDHMVLHEYVNAAGITLRRRLRKRVKDYEDKLREIEKKVRRDAERIEEELERAKK

SEQ ID NO: 15035 - protein, 247 aa, Artificial Sequence
  Synthetic sequence.
SEKEELLKLIKRVIELLKRVLEEHLRLVEDVIRRLKELLDSNEKIVREVIEDLKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASEDLLRKARDHMVLHEYVNAAGITDVRRVIEDVKRKSARILEEARRLIEEVERELEKIRK

SEQ ID NO: 15036 - protein, 247 aa, Artificial Sequence; identical to SEQ ID NO: 15035
  Synthetic sequence.

SEQ ID NO: 15037 - protein, 247 aa, Artificial Sequence
  Synthetic sequence.
SEAEDLEELIKELAELLKDVIRKLEKINRRLVKILEDIIRRLKEISKEAEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDEAERRRDHMVLHEYVNAAGITEVKRRLEEELTRLRETHKKIEKELREALKRVRDRST

SEQ ID NO: 15038 - protein, 247 aa, Artificial Sequence; identical to SEQ ID NO: 15037
  Synthetic sequence.

SEQ ID NO: 15039 - protein, 246 aa, Artificial Sequence
  Synthetic sequence.
KEIEETLKELEDLNREMVETNRRVLEETRRLNKETVDRVKATLDELAKMLKKLVDDVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTTGGDKAVERDHMVLHEYVNAAGITIDRYEDELRKLRKEYKEKIDKYERKLEEIERRERT

SEQ ID NO: 15040 - protein, 252 aa, Artificial Sequence
  Synthetic sequence.
SLEEITKRLLELVEENLARHEEILRELLELAKRLAKEDRDILEEVLKLIEELLKLLEDNGSSEEDLKRLLKEVIEELRAVVKRVKDKWDEVVKRIEDLVKKLKELHDDTLRKLRELVRKIVTDISESGGEAEKVKRVVEKILELVERLAKVVKESVEKLLEILRELAEVSKRVAEALLRLLEELVRVIRIKDERTRDHMVLHEYVNAAGITDELEEVHKRVKKELEDIIEENRRVVKRVRDELREIKRELDE

SEQ ID NO: 15041 - protein, 249 aa, Artificial Sequence
  Synthetic sequence.
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRRDHMVLHEYVNAAGITKKASEDIVREVERIVRELAKRSDEILKKLEDIVEKLRE

SEQ ID NO: 15042 - protein, 249 aa, Artificial Sequence; identical to SEQ ID NO: 15041
  Synthetic sequence.

SEQ ID NO: 15043 - protein, 250 aa, Artificial Sequence
  Synthetic sequence.
STEEILKRVKEILDELAKELRDIIRESLRTIEELLDELRRILEESERTLEELVKTIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPDEVKRRDHMVLHEYVNAAGITRRRLRKRVKDYEDKLREIEKKVRRDAERIEEELERAKK

SEQ ID NO: 15044 - protein, 250 aa, Artificial Sequence; identical to SEQ ID NO: 15043
  Synthetic sequence.

SEQ ID NO: 15045 - protein, 247 aa, Artificial Sequence
  Synthetic sequence.
SEKEELLKLIKRVIELLKRVLEEHLRLVEDVIRRLKELLDSNEKIVREVIEDLKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASEDLLRKAKRDHMVLHEYVNAAGITVRRVIEDVKRKSARILEEARRLIEEVERELEKIRK

SEQ ID NO: 15046 - protein, 247 aa, Artificial Sequence
  Synthetic sequence.
SEAEDLEELIKELAELLKDVIRKLEKINRRLVKILEDIIRRLKEISKEAEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDEAERRRRDHMVLHEYVNAAGITVKRRLEEELTRLRETHKKIEKELREALKRVRDRST

SEQ ID NO: 15047 - protein, 247 aa, Artificial Sequence; identical to SEQ ID NO: 15046
  Synthetic sequence.

SEQ ID NO: 15048 - protein, 248 aa, Artificial Sequence
  Synthetic sequence.
DEDRIIEEIARLLEELLRELLELIKKLIETNRRLNEEHERAVRELARLLEELLDRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIAEEIRDHMVLHEYVNAAGITDLERKLKESEDELREIEARLEEKIRRLEEKLERKRR

SEQ ID NO: 15049 - protein, 251 aa, Artificial Sequence
  Synthetic sequence.
DEEEKIRTTLDLLRKLLKVLREILEELIRSNKELNERLLRLVEDSDRLLEELLKKLADDGGVDEEALRRIKKRLEDLIRTNREIEERIDRESERLAEELRRILRELEKELRRLIEDLKEVLKRGLPREELLRRLKKVVEDVLRILEEVLRVVDELDKENVRLLREWLERNKEIVEEVIRILEDLIRKGGSESEEKVRDHMVLHEYVNAAGITIAKELERLLRENRRRLEELAREAKKVLDELRKRLEDERR

SEQ ID NO: 15050 - protein, 247 aa, Artificial Sequence
  Synthetic sequence.
RDRDVLRKVKAEIEELVARIEKVSRDALSEVKRLLDENRKIAEDVLRLIESLLRKIRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSEEVVEELLRDHMVLHEYVNAAGITLSRAVEKVVRDVVRVDKELLDELARILRRLEEVIT

SEQ ID NO: 15051 - protein, 249 aa, Artificial Sequence
  Synthetic sequence.
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRARDHMVLHEYVNAAGITKASEDIVREVERIVRELAKRSDEILKKLEDIVEKLRE

SEQ ID NO: 15052 - protein, 250 aa, Artificial Sequence
  Synthetic sequence.
STEEILKRVKEILDELAKELRDIIRESLRTIEELLDELRRILEESERTLEELVKTIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPDEVKRRRDHMVLHEYVNAAGITRRLRKRVKDYEDKLREIEKKVRRDAERIEEELERAKK

SEQ ID NO: 15053 - protein, 248 aa, Artificial Sequence
  Synthetic sequence.
DEDRIIEEIARLLEELLRELLELIKKLIETNRRLNEEHERAVRELARLLEELLDRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIAEEIERDHMVLHEYVNAAGITLERKLKESEDELREIEARLEEKIRRLEEKLERKRR

SEQ ID NO: 15054 - protein, 248 aa, Artificial Sequence; identical to SEQ ID NO: 15053
  Synthetic sequence.

SEQ ID NO: 15055 - protein, 252 aa, Artificial Sequence
  Synthetic sequence.
SLEEITKRLLELVEENLARHEEILRELLELAKRLAKEDRDILEEVLKLIEELLKLLEDNGSSEEDLKRLLKEVIEELRAVVKRVKDKWDEVVKRIEDLVKKLKELHDDTLRKLRELVRKIVTDISESGGEAEKVKRVVEKILELVERLAKVVKESVEKLLEILRELAEVSKRVAEALLRLLEELVRVIRIKDERTLRRDHMVLHEYVNAAGITLEEVHKRVKKELEDIIEENRRVVKRVRDELREIKRELDE

SEQ ID NO: 15056 - protein, 249 aa, Artificial Sequence
  Synthetic sequence.
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALRDHMVLHEYVNAAGITASEDIVREVERIVRELAKRSDEILKKLEDIVEKLRE

SEQ ID NO: 15057 - protein, 249 aa, Artificial Sequence; identical to SEQ ID NO: 15056
  Synthetic sequence.

SEQ ID NO: 15058 - protein, 250 aa, Artificial Sequence
  Synthetic sequence.
STEEILKRVKEILDELAKELRDIIRESLRTIEELLDELRRILEESERTLEELVKTIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPDEVKRRLRDHMVLHEYVNAAGITRLRKRVKDYEDKLREIEKKVRRDAERIEEELERAKK

SEQ ID NO: 15059 - protein, 250 aa, Artificial Sequence; identical to SEQ ID NO: 15058
  Synthetic sequence.

SEQ ID NO: 15060 - protein, 251 aa, Artificial Sequence
  Synthetic sequence.
DEEEKIRTTLDLLRKLLKVLREILEELIRSNKELNERLLRLVEDSDRLLEELLKKLADDGGVDEEALRRIKKRLEDLIRTNREIEERIDRESERLAEELRRILRELEKELRRLIEDLKEVLKRGLPREELLRRLKKVVEDVLRILEEVLRVVDELDKENVRLLREWLERNKEIVEEVIRILEDLIRKGGSESEEKVRDRDHMVLHEYVNAAGITKELERLLRENRRRLEELAREAKKVLDELRKRLEDERR

SEQ ID NO: 15061 - protein, 249 aa, Artificial Sequence
  Synthetic sequence.
DAEEVVKRLADVLRENDETIRKVVEDLVRIAEENDRLWKKLVEDIAEILRRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALERDHMVLHEYVNAAGITSEDIVREVERIVRELAKRSDEILKKLEDIVEKLRE

SEQ ID NO: 15062 - protein, 249 aa, Artificial Sequence; identical to SEQ ID NO: 15061
  Synthetic sequence.

SEQ ID NO: 15063 - protein, 250 aa, Artificial Sequence
  Synthetic sequence.
STEEILKRVKEILDELAKELRDIIRESLRTIEELLDELRRILEESERTLEELVKTIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPDEVKRRLERDHMVLHEYVNAAGITLRKRVKDYEDKLREIEKKVRRDAERIEEELERAKK

SEQ ID NO: 15064 - protein, 250 aa, Artificial Sequence; identical to SEQ ID NO: 15063
  Synthetic sequence.

SEQ ID NO: 15065 - protein, 251 aa, Artificial Sequence
  Synthetic sequence.
DEEEKIRTTLDLLRKLLKVLREILEELIRSNKELNERLLRLVEDSDRLLEELLKKLADDGGVDEEALRRIKKRLEDLIRTNREIEERIDRESERLAEELRRILRELEKELRRLIEDLKEVLKRGLPREELLRRLKKVVEDVLRILEEVLRVVDELDKENVRLLREWLERNKEIVEEVIRILEDLIRKGGSESEEKVRDTRDHMVLHEYVNAAGITELERLLRENRRRLEELAREAKKVLDELRKRLEDERR

SEQ ID NO: 15066 - protein, 252 aa, Artificial Sequence
  Synthetic sequence.
SLEEITKRLLELVEENLARHEEILRELLELAKRLAKEDRDILEEVLKLIEELLKLLEDNGSSEEDLKRLLKEVIEELRAVVKRVKDKWDEVVKRIEDLVKKLKELHDDTLRKLRELVRKIVTDISESGGEAEKVKRVVEKILELVERLAKVVKESVEKLLEILRELAEVSKRVAEALLRLLEELVRVIRIKDERTLREVRDHMVLHEYVNAAGITEVHKRVKKELEDIIEENRRVVKRVRDELREIKRELDE

SEQ ID NO: 15067 - protein, 251 aa, Artificial Sequence
  Synthetic sequence.
DEEEKIRTTLDLLRKLLKVLREILEELIRSNKELNERLLRLVEDSDRLLEELLKKLADDGGVDEEALRRIKKRLEDLIRTNREIEERIDRESERLAEELRRILRELEKELRRLIEDLKEVLKRGLPREELLRRLKKVVEDVLRILEEVLRVVDELDKENVRLLREWLERNKEIVEEVIRILEDLIRKGGSESEEKVRDTERDHMVLHEYVNAAGITLERLLRENRRRLEELAREAKKVLDELRKRLEDERR

SEQ ID NO: 15068 - protein, 186 aa, Artificial Sequence
  Synthetic sequence.
SAEDSIRELLERDERLLEEARKEAKRLNEENERRDHMVLHEYVNAAGITKRLLDDIRKKIKGEKLREIEELVRRVKRTIEKLLEEVKKSVEDSSKRIEELLEAVERSVERTKEEIRRLLDEVRKDRKEELVKRVEERIKRLHDENRRLVKEVIEEVEKLIRDNEKLAEDIEREIRRLLKELDEAAK

SEQ ID NO: 15069 - protein, 181 aa, Artificial Sequence
  Synthetic sequence.
SRVERLSAEIKKLIDENRRVAEELLRELEKLLKRDHMVLHEYVNAAGITSRKLEELARAGAPEEDIRRLVEESKELIKRLLRDIERTTREINEVIKRVVETIRRTTDEINRRIEELVRKIDRGEAREDMDRLVRENERLLKKVEDDLRKLSEENKRLVDRARERLARLLEENERLVDERRK

SEQ ID NO: 15070 - protein, 182 aa, Artificial Sequence
  Synthetic sequence.
RVEDALRKLLDDVRRLVEEAERRLRTSNDKSRRRDHMVLHEYVNAAGITEKLVRDVRRRIRDEDVKRVLEELLKRDHDVVRRVLERIDEMLERNSRLVKRVLEDIRRLLKRVREVVERIKRVRSKVVEEVLKELEELIKTAKKIIEDVLRASEDTIRRLEEIIRKVEEDSKRIIEEIERAAR

SEQ ID NO: 15071 - protein, 183 aa, Artificial Sequence
  Synthetic sequence.
KVEKRLTDLLKTVADEVKRVEDELRETVRESKERDHMVLHEYVNAAGITEKTVKDAERRVSEDLVRRIRKVLDENREVNDRVVKEDERILEENERVNRKVVEKIRDILRKIEEVVRRAAEEIRDEEVVKKVEKEIRELLERLKEEADRVRERSKKILTDLKKSSEDVKRESERMLKKLEDEIR

SEQ ID NO: 15072 - protein, 184 aa, Artificial Sequence
  Synthetic sequence.
SLEEVIKTVRKLLEEVERRLREVVERAERMLEERDHMVLHEYVNAAGITKDVEKALRDKNVSEEIEEKLRKIKEELERDNEKVNRDNERSVETLRRLLDRVRKEVKDIAKELEERLKEVERKSRDDRIVEKLLRDAERIVKRLRELIEKLREEVEKIVDENRKTVEELRRRNEEIVRRLRREIE

SEQ ID NO: 15073 - protein, 177 aa, Artificial Sequence
  Synthetic sequence.
KEEEDLEREVKRLEDKVREDAKKLEEVVKTVEKRDHMVLHEYVNAAGITADRVRRLTERKLDEETLRKVKEDLKRTLERLKRENEKSLEELRDILRRLKKENDDTLKELRDELKRLTDSGASEDVIRKMEEIIKRLEEVSREVEKRLRRIIRELERVSKEVLDRLREIIEKLDRDAT

SEQ ID NO: 15074 - protein, 175 aa, Artificial Sequence
  Synthetic sequence.
SELEKVVDDVRRRLDRLLETSEKLLEDATKRLKRDHMVLHEYVNAAGITLERLKTVLERRETDKRELLKENKEILERTRELSERNLKEVEDILREVEEEVRKNLRRIEKVLEEVRRKLRSELLKRVEERIKRVLDESKKILKEIADEVRRVLERDKELLKRLEDKNREVSERIRK

SEQ ID NO: 15075 - protein, 180 aa, Artificial Sequence
  Synthetic sequence.
SKEEVLREIERLHKETIRRIEEVLREATELHKRRDHMVLHEYVNAAGITREVIEDVRRADTPNVEELLRELKDALDKVRDHNRKTLKKNEDVVREIEKEVRELLKEDEDVLRRIEKVMRDGRVDARELLEESRREVERSEKEVERLLRKSRKVVEEVRKLSEENDREVKKILEEVKRRLD

SEQ ID NO: 15076 - protein, 187 aa, Artificial Sequence
  Synthetic sequence.
SEKERLKEELEKLSKEIEDILRDDKRSDDELRRRDHMVLHEYVNAAGITNEELKRMLEEARKRVSEDELRAIKKEIEDLNRRNEESLRAIEEKIKRLNDENRKSLEEIRRRLKRLVEEVDELRKRDNREELLRRLLEKLKRMAEKLKRDIEDNNRKLRKVATELAKEIEDNSEKLREDAKRLSEKIK

SEQ ID NO: 15077 - protein, 177 aa, Artificial Sequence
  Synthetic sequence.
SAIEKVKEVVERVLETVRDSVRRSHEESKRLIDRDHMVLHEYVNAAGITIERVRRKGIPERMVEKLERDLEELLKEIKDTIDRIEEELRTSNRRLKETNDEIAKRLEELLRELSRDRDKDAVEDVLRRIEELIRDLNKKNDDNVRRVKEVIDRAEKLVRDLLREIRKLIEKLIRDTE

SEQ ID NO: 15078 - protein, 177 aa, Artificial Sequence
  Synthetic sequence.
SVLEEVRRRVEELLKTVKESVDRSHERSERLIERDHMVLHEYVNAAGITVERVREKGIPEDRVKRIEDKLREELERLERENRKIEEDLKRSNDELRRENERIAERLEELLRELSRDTNDKVARDVLEEIERLIREANERNKRNLEDVERVIRELNKENERVLREVEKKIEKLIRETE

SEQ ID NO: 15079 - protein, 183 aa, Artificial Sequence
  Synthetic sequence.
KDAEDLERRVRELVEENNRVSKRLAEEVTRLVKRDHMVLHEYVNAAGITAKELLDMKRRGEVREEEVKRVLREIEELLREITEHSKEVLKTIEKLLRDSLEHSRRVLEEIERLLETILRKSKDSERLKKLVDELRETLERSLRENEKVADELRKRAEKSLEDVKRVVDELRKIVDDVLKRVED

SEQ ID NO: 15080 - protein, 183 aa, Artificial Sequence
  Synthetic sequence.
SEIEKLVEDVRKLVEDNLRHSEEVHRRNRRLIERDHMVLHEYVNAAGITVEELRELAERGEIREEEARKVLEEIKRLLDEIRRHSEEVLKEIERTLKENLKHSEEVLRRIEERLEDIKRKDKDSERVRTLVDRLREELKRSLDESEKLNRESRKRVTRSLEKVDDLVRELEKLARKVLEEVKT

SEQ ID NO: 15081 - protein, 181 aa, Artificial Sequence
  Synthetic sequence.
EEIERALREMRELSRTHKELVEKILRDIAELAKRDHMVLHEYVNAAGITIDEIADEIRKEDKKEELKRKIDELRRRAEELLKESKEHLKRLEDTVRELIERLKETLKKVEEDLKRILEKLEKSRELDEIAKDVKRLIDENRELLKRVEDEVRRLIRKLEELNRRTEEEVKKLIKKLEDDLK

SEQ ID NO: 15082 - protein, 174 aa, Artificial Sequence
  Synthetic sequence.
SEIEELEKRIDELLKELRDLSRRIAEEVKRLLERDHMVLHEYVNAAGITLERLKRKGVPEEELRRVEEEVERVVRESRKLNKETEDELRRLLEEIKESNDRVEKRARELKKLLRDGKDVEEVLRRLEKLVREDKERLKKVLKDARDLIKKDKDLNEKLSRELEKLVRELEERAR

SEQ ID NO: 15083 - protein, 174 aa, Artificial Sequence
  Synthetic sequence.
REIEEAAKDLDRLLEENKKLVKEVEEELRRLLKRDHMVLHEYVNAAGITLEELRRRGVPEEELKEVEERARRVIEESRRSSKELEKRLRELLEELRRSTKELEDRLREIKKLLRNGKDVEEVLRRVRKLSRENKEKIRKILEDVKKLSEDNKRRNEELSRRVKTLVDEIKKRAT

SEQ ID NO: 15084 - protein, 178 aa, Artificial Sequence
  Synthetic sequence.
SEIERIERENDRLNEENKKITEDIERELKRLLERDHMVLHEYVNAAGITLRELRKRNGGREEVLKEVEDRLRRIVEEIRRSDKRLEDIAREVKKRIRESDEELRRVSEEITRRLRKVRDEKTLRELLKRSEELSKENKDRLKKLLDDLREVSKKNKEDLKRLLREVREVARKVKERAN

SEQ ID NO: 15085 - protein, 182 aa, Artificial Sequence
  Synthetic sequence.
DEIETVLDEVRRLHEDAKRRLEEMIDEVRKLNERDHMVLHEYVNAAGITLRTVKEEVERAGLDKGKLEELEERLERVREDVERILREIKRRNEKTLEDSERILEENKERNRTVLKKLKELRDRGSDAREALKESRKVVEESRESVRRVLEKNRRVVEESKRLAEELLRRVKKVVDEIRKRVE

SEQ ID NO: 15086 - protein, 174 aa, Artificial Sequence
  Synthetic sequence.
EELERILDKVRKVIEEVRKRLRDDLRTVEKVLKRDHMVLHEYVNAAGITLERVEEAARRGRDRREIKEELKKVLDDLRELLRALEEKNRRVNKENEDSLRKIEEDLRDVLRKLEEEIKGREVLRKVRELLRTIREEVERVLRKSNELSTRIKKRIDDVLETLERLLKELDDKLR

SEQ ID NO: 15087 - protein, 178 aa, Artificial Sequence
  Synthetic sequence.
SSKDEIRRRVEEVVERSDEIVKRSREHVKTVVDRDHMVLHEYVNAAGITVKKLDKIRKDGGSEETLKRVLDELREILKELKEEVKKVKRKLEKVVKENRDTIREVEERNRKILDELRKRGVEERALREVEEISRKSEEKLRRVLKESEDIAKEAEDRLKTVLERVERIADEVLKRLTK

SEQ ID NO: 15088 - protein, 182 aa, Artificial Sequence
  Synthetic sequence.
SDADRVAEELKKLVEDSRRENERVIEESKRLVKRDHMVLHEYVNAAGITVDKLRDILEKEKDKKTLDDIVREILERLKRLLEKVEDENRKSHEENKRLLEDVKRKNKRISDELKRLLEEIERRNVDVDKVRETVKRLLEENKRVMEKTEEVAKKSSEDIKRVADETRRRAEELLKEVDELRK

SEQ ID NO: 15089 - protein, 182 aa, Artificial Sequence
  Synthetic sequence.
DEVDELLKRLRKLVDEVRKENDKMVKESKRLVERDHMVLHEYVNAAGITLEELEKILKDTEDKDTLRKIVEEIKRRLRRLLEELKRIIEKALRDNKKLLDEVRKRNKEISDELRRLLEEIRRRNVRVEDIEREAERLLRENEELLRRSEEVIRRSTEKIKKVLRDAEERAREILKRVEDAAK

SEQ ID NO: 15090 - protein, 175 aa, Artificial Sequence
  Synthetic sequence.
SEVDEVLREAKRIVDEVHKDNERATEESRRLVKRDHMVLHEYVNAAGITVKEVKDANIDEKLVTEILKEIEEALKEAARRNKEVKDRLRELSRRVSERNREILEELKERLDRVRERRKDVKELEREVEKLLKRIEESLRRHRKENKRLLEELDRSLRELAKIVKEVLDEIRERTR

SEQ ID NO: 15091 - protein, 175 aa, Artificial Sequence
  Synthetic sequence.
SEMDDVLKKLAETVKRIIERLKKLTDDSRRLVERDHMVLHEYVNAAGITVRKAEERNIDEKDVRKLLEDLKKKSEEVAERNKRILDTLREISKRAEDEVRKVLKELEKTLKELEDRRPDVRELSEEVKKLLDEVRKALKRHKDENDKLLKEIEDSLRRHKEENDRLLEKLKESTR

SEQ ID NO: 15092 - protein, 186 aa, Artificial Sequence
  Synthetic sequence.
SEVDEVRKTLEDLLRRLDEENKDIIRRNKELLDRDHMVLHEYVNAAGITLDELRKILEKLKDRETLTRIIEEIEKRARELIKRLRDEIRKIEEESKKSIEDSRKRNDEIRKRLEELIKDLRDKIKDSEELARRITELEKRVREVIERLKEKNKRLEDDSRRVITELRKKLKDLEDRVREEIEELRK

SEQ ID NO: 15093 - protein, 186 aa, Artificial Sequence
  Synthetic sequence.
SRVDEVIERLERLLRELDKINRDMIEDDKRLNTRDHMVLHEYVNAAGITLEELEEIRKKLSDEKTLEEIIERVERRLEELIERSKRRNREILERSKELIERSKKTNEEILRRAEELIKRLREEVKDIKEALDKIRRLEERARRVIEELDEKNRRALERSKENVKRLDERNERLRKELEEKVRRLRK

SEQ ID NO: 15094 - protein, 176 aa, Artificial Sequence
  Synthetic sequence.
REAEEAKEEVEELNRRNKKELDDARRRVDELDKRDHMVLHEYVNAAGITVEELERVKEEGRSDDRLREKIERMLKTSADELERLKEENKRALRDLAERLRELIERNRRKLEEITRRTVPDKDVLKRLAELIKESIRELERVLEELAEKIDRSLKELDDVLRKNETDLKRVIEDLKR

SEQ ID NO: 15095 - protein, 179 aa, Artificial Sequence
  Synthetic sequence.
REAEEVERKVEELNRRNRKVLDDARKESEEVVRRDHMVLHEYVNAAGITLRELDKRKRDGTSEEVIKRLIDRVRKILEDIRRLVDELIKRNERIVEKLTRIVEELIRRNKKLLEDIRRELVKVDEVLRRLAEDIERSIRELEKVLRELERIHRELIKELKEVLKRLEKDAKEVIERLRT

SEQ ID NO: 15096 - protein, 174 aa, Artificial Sequence
  Synthetic sequence.
SEEEVLREAAKTVEKLLDEIRRSLEKVSKRVEDRDHMVLHEYVNAAGITRELLEELRKNNVDRTLLEDVRRKLERIEERNEEMNDRSRRKLEELRERNRKILEDIRRTLEDLKRRQLPKDDVERTLREIAKLVDEVDKENKRALRENEERVKTLNRENEEMLKRIEEEVRRATK

SEQ ID NO: 15097 - protein, 183 aa, Artificial Sequence
  Synthetic sequence.
RVDERLDTVLKRVEETVRENKKKNDELLERSKERDHMVLHEYVNAAGITRREAEKLKREVTKEEVKKIIDEVLKEIEDLLRTVKEELDRALERNREVVEETKRRIDRVLKEIEKLIRDVKRDRKEEVVKEVEERIKKLLKEVNDTSKDAERRLRETNERLNEIVKEVEKRIRELSEEVRKRVK

SEQ ID NO: 15098 - protein, 183 aa, Artificial Sequence
  Synthetic sequence.
SVDERLDEVLERVKEDMDRNRRKNDESLREDEERDHMVLHEYVNAAGITEERVRELKKRVKDERVKEFLDRVLEEIRKSAEEVKTIIDEVHKESEETVRRTKKIIEEVLRRIEELIRRVKKDRKEEVVKTVEEDIKRLLKEVNKVSDEAHKRNKELNERVNRVNKEAHKRNEDLLREAERKVR

SEQ ID NO: 15099 - protein, 174 aa, Artificial Sequence
  Synthetic sequence.
SESDEVIRDLARLLDELARHVDDSVRRMDEVVKRDHMVLHEYVNAAGITVKEVEKKPGDERVERMVAEIERLVAEVLEELKKKYEKLKREVEENLRRLEETVRDIVEKARKVTEKGVSKEKIDRIIRELERILEEAKKKHEDVLRRLEDSLRRVAELLKAALDRLREIVDRLRR

SEQ ID NO: 15100 - protein, 172 aa, Artificial Sequence
  Synthetic sequence.
SRAETVLKEVTDKIKKLADSSDELLRRNKENIDRDHMVLHEYVNAAGITIEEIEKGSVDEETLEELIRRVEAELEAHHRELEKNSREDEKRNRDHHAKLEEEMRRVEERLEREGIDDEVVKRVRDLLDTVRRRNEKVNEDVKRMNDKLRRDNEDVIRRVEKLLRELEEKRRT

SEQ ID NO: 15101 - protein, 176 aa, Artificial Sequence
  Synthetic sequence.
SVDEVLKEIEDALRRLKEEVERVLKENEDELRRRDHMVLHEYVNAAGITESLKRGVGESDEVDRVVDEIAKLSAEILEKVKKVVKEIRDSLETVKRRVDDVVRRLKELLDEIKRGSDEKAIRDVAKEIRDRLKELEEEIEEVTRRNLKLLADVEEEIRRVHEKTRRLLETVLRRAT

SEQ ID NO: 15102 - protein, 186 aa, Artificial Sequence
  Synthetic sequence.
SEVDEIIKELERLLAEIARENERIIRESRKLADRDHMVLHEYVNAAGITVARLADAVRRKGSESEEVKKLIEDVLREIERLLKRIEEENREVVKRNSELVERVRAINEEILRRVAELVEKIARDIGDKDEVTKVKKVADDVLAEIKKLDDETRRVIEDTNKKIADLDKATRDVVRKVLEEVKKLEK

SEQ ID NO: 15103 - protein, 181 aa, Artificial Sequence
  Synthetic sequence.
SEVDDVLRRLEELIKTLEDINAKSLEDIKKLIDRDHMVLHEYVNAAGITIRELREAKKGIDSREAEEIAKRVLEELKRTSDDLRKKVERVDEDLRRLLRENHERNKKILRDLERLLRDAARRGVPKEALDRMREEIRRLEEESRKSDETIERLIRELRRRVEEVLKTSTDLIRELEEEVKK

SEQ ID NO: 15104 - protein, 181 aa, Artificial Sequence; identical to SEQ ID NO: 15103
  Synthetic sequence.

SEQ ID NO: 15105 - protein, 234 aa, Artificial Sequence
  Synthetic sequence.
SAKETIRKLIEENKDIIRKLAEKLKRLLEESERRDHMVLHEYVNAAGITERALRRVGSGIDEELLKELEKELARLEEELKEILDRVRDLHRRLAEEIRKILEESKKLNEELEDRLRKDGDVEELLELLERVHATDVRLLRELLKLLKKVHEDVVSLLERLLELLKRVLDRIVEELGLSDKELEKLLEDLEREIRRLAKRLKELSDRLEEKIRKIKRELDDLSARLREKIERTRK

SEQ ID NO: 15106 - protein, 244 aa, Artificial Sequence
  Synthetic sequence.
SAEETLRRITEESKRVLEEITKKYEDLERESRERDHMVLHEYVNAAGITEDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARLLKALADKLIRVLEEILKINEELNRKIIKFARENLERNRRVNKKVIEVLREAAR

SEQ ID NO: 15107 - protein, 238 aa, Artificial Sequence
  Synthetic sequence.
SEAEKIREALETNLRLLEELIKRLKEILDTHNERDHMVLHEYVNAAGITLELLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKEDLERLRRKVEELEDRLRRLLEKLARDSAELMRELERILDRYARESEELDRRLAE

SEQ ID NO: 15108 - protein, 238 aa, Artificial Sequence; identical to SEQ ID NO: 15107
  Synthetic sequence.

SEQ ID NO: 15109 - protein, 242 aa, Artificial Sequence
  Synthetic sequence.
SEKERLMRLLDKLKDLNRRLVERIKELLDKALERDHMVLHEYVNAAGITKELVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSEETVRRLREALKKLEDDLRKIERDAEREYKKLKDELEELTERYRREIRKLKEELKADRK

SEQ ID NO: 15110 - protein, 242 aa, Artificial Sequence; identical to SEQ ID NO: 15109
  Synthetic sequence.

SEQ ID NO: 15111 - protein, 247 aa, Artificial Sequence
  Synthetic sequence.
SEAEDLEELIKELAELLKDVIRKLEKINRRLVKRDHMVLHEYVNAAGITEEELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDEAERRRRELKDKLDRLREEHEEVKRRLEEELTRLRETHKKIEKELREALKRVRDRST

SEQ ID NO: 15112 - protein, 240 aa, Artificial Sequence
  Synthetic sequence.
SDKEEIKRRVEKTARDLETEHDKIKKRLEDTVRRDHMVLHEYVNAAGITLRKIEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALAKLIKELLEALEEVLRRNKELIRELLRVLDEALK

SEQ ID NO: 15113 - protein, 240 aa, Artificial Sequence; identical to SEQ ID NO: 15112
  Synthetic sequence.

SEQ ID NO: 15114 - protein, 248 aa, Artificial Sequence
  Synthetic sequence.
DEEERVKKLLTDLRRLLRKLHEESKKLLDELRKRDHMVLHEYVNAAGITERRLREAEKKLPGTRVLKLVADVVKKVLDAIRDLNRKLEEIIDEALKLLEELDDILRRVVEEALRLLKEIKDTKGDREEVKKRVEDILKRLEELVKEYEDRVREIKKRLRRALEELRDEYRKIREDIERVLDELRKGGVPEELLRVLEELVRTLKKLLDENLKMVERLIRELEKVLDDHERKVRRLIEELLEVLDRDAK

SEQ ID NO: 15115 - protein, 238 aa, Artificial Sequence
  Synthetic sequence.
DADELLRRLAEEVERVIREAEDLLRRWKETIKKRDHMVLHEYVNAAGITEDVIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKDDLEDILRKNLDRLRKLLERLREILRENLEALKKTLKRLEDVVREILEDLKRERK

SEQ ID NO: 15116 - protein, 238 aa, Artificial Sequence; identical to SEQ ID NO: 15115
  Synthetic sequence.

SEQ ID NO: 15117 - protein, 231 aa, Artificial Sequence
  Synthetic sequence.
DKAEVLREALKLLKDLLEELIKIHEESLKRILDRDHMVLHEYVNAAGITKELLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVPEEIDRELKRVVEELRRLHEEIKERLDDVARRSEEELRRIIKKLKEVVKEIRKKLK

SEQ ID NO: 15118 - protein, 236 aa, Artificial Sequence
  Synthetic sequence.
STREKAKKVLDTLRADNEDMKRVVEKILRALKRRDHMVLHEYVNAAGITKRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDLLRKLEEELRRIKEKLRKALEELEREHRELEKELDKLHDESRKEHERIEEELRR

SEQ ID NO: 15119 - protein, 236 aa, Artificial Sequence; identical to SEQ ID NO: 15118
  Synthetic sequence.

SEQ ID NO: 15120 - protein, 247 aa, Artificial Sequence
  Synthetic sequence.
SKAEKLLKDLREALEKVKRRYEELERRLDEVLKRDHMVLHEYVNAAGITLKRIEEGGLPEEELEKLKKLAEKVKELLRELLRLSKELVDRVRELLKRDLDLVRRLVEIALKVLREAREQPNDEKRVEKIKRDLEKKARRVREENERIKRDLKRTADESRKRLEKLLEDLKRELDRLREDLDRGRKDIDERVEELIERLIRIIERLLREVIKSHEKLVRTIERLIEESIRVNEELLEVIERLLDRARK

SEQ ID NO: 15121 - protein, 246 aa, Artificial Sequence
  Synthetic sequence.
KEIEETLKELEDLNREMVETNRRVLEETRRLNKRDHMVLHEYVNAAGITLKKLVDDVRKGPTSEELKRLLAELEELLARVVRRVEELLKKSTDLLERAVKDSADALRRSHEVLKEVASRVKRAKDEGLPREEVLRLLRELLERHAKVLKDIVRVSEKLLREHLKVLREIVEVLEELLERILKVILDTTGGDKAVEELEKALEEIKRRLKEVIDRYEDELRKLRKEYKEKIDKYERKLEEIERRERT

SEQ ID NO: 15122 - protein, 231 aa, Artificial Sequence
  Synthetic sequence.
SKEEEVEKVLRKWEEILRRLIEENKRANDKIRRRDHMVLHEYVNAAGITKEVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDVVRALIEVIERLLRVAEEVIRRILKVNTELMRVDERSIRESLKAISEVLKVLDT

SEQ ID NO: 15123 - protein, 245 aa, Artificial Sequence
  Synthetic sequence.
DEDELIRKLLEDLKDIVRKILELIERDLRDIERRDHMVLHEYVNAAGITKEVVDDIARGVPRTEELERVIKRIEELLRTSEEELDRILKEIEELLRESRRRLEEVVSAVEELLRRVEEIVDKGRESKEDVIKLLREVVDDILRLVEEVVRTNLEIIKRILELIERVIRLNLSIIRDILRLLEGTVDSELADRIRKLIEDLERHTAKVLEDVKRAITELRKNSKDILEEVRKLIDELRKRIKEVED

SEQ ID NO: 15124 - protein, 231 aa, Artificial Sequence
  Synthetic sequence.
SKDEELARLLEELVERWRKIVEDLERDHRRLVKRDHMVLHEYVNAAGITVDRIRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRRILEELKRIVDDVLRIIARILKLLRDLTRRLAEVAKAVHKLLEELLRKLKEDTR

SEQ ID NO: 15125 - protein, 238 aa, Artificial Sequence
  Synthetic sequence.
SEIEDVIRRLRKILEDLERVSEKLLREIKKILDRDHMVLHEYVNAAGITLEDAVRVFRDGSGSKEELAKLVEELIRELAKLAKEVDEIHKRIVERLKALVEDAERIHRKIVETLEEIVRGVPSEELKRVVEAIVEVIKEHLKVLADVIRRIIKAIEENAETIKRVLEDIVRVLELVLRGEGSIEDLVREVERLIKRIEDSLRELEKTVRELLKRIKEASDKVREDVDRLIKELKEAAD

SEQ ID NO: 15126 - protein, 238 aa, Artificial Sequence; identical to SEQ ID NO: 15125
  Synthetic sequence.

SEQ ID NO: 15127 - protein, 246 aa, Artificial Sequence
  Synthetic sequence.
SREEIVATLEDLARKILEVVKKLAKEIEDAWRERDHMVLHEYVNAAGITREIEDVVRKKVDSRVAEILETVVKRVVDITRRLIEEAERVVRELVDITRKLITILEEVVRRLVEIVREASKIDDRRELEDMLRKIREVVREVIERLKKLDEDVRRVVEEVIRRLEELNKRLEDVIREVKKRLKELGLSEEAVKELVELLEEILERNTRVIKEIIDLLRTVIRIHEKIVEDLIKLLEELLRRLEEATR

SEQ ID NO: 15128 - protein, 237 aa, Artificial Sequence
  Synthetic sequence.
KEKEDALKKLEDLARKSREDLERVLRKHKKILDRDHMVLHEYVNAAGITVDDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELAREVERVIKELLDKSKEILERIERAIDELLKVSEEILKLSEDASEELLKILREFAK

SEQ ID NO: 15129 - protein, 229 aa, Artificial Sequence
  Synthetic sequence.
SKEERLREVAEKHKKDLEDIVKRVDEAAKETARRDHMVLHEYVNAAGITLDDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLDILERAVEVVRRVIKALKEVLERHVDATREVIERVKRVNKRLLEAVREVVT

SEQ ID NO: 15130 - protein, 241 aa, Artificial Sequence
  Synthetic sequence.
SEKELLKEILDRIRELLEDDNRLLKRIVDEIRKRDHMVLHEYVNAAGITKELLDRIGAPEDVIRELTRALKETEEDVDRVIRTLEKLLKEVLDAHEEVVRKLDRLLKEVERLVEGGDAEEVVRDLLRVVKEILDESKAVIDELARVVDEILKLLEEVDRKLAKVVKEILEDVLRGSGDDEDAVRKIAKIIEELKRLLEDLARDTRRVIEEAKRLLKEWRDRNKEVADTLKKLLEDLIRKIR

SEQ ID NO: 15131 - protein, 240 aa, Artificial Sequence
  Synthetic sequence.
DREKSVRDIEEDLKRVLDKLRRRVETSKEELKKRDHMVLHEYVNAAGITRDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVAKELDEVIKRLLDNLKENTDRLKEVIDRNLADLRDLAEELRAVIERLLEDARR

SEQ ID NO: 15132 - protein, 252 aa, Artificial Sequence
  Synthetic sequence.
SLEEITKRLLELVEENLARHEEILRELLELAKRRDHMVLHEYVNAAGITEELLKLLEDNGSSEEDLKRLLKEVIEELRAVVKRVKDKWDEVVKRIEDLVKKLKELHDDTLRKLRELVRKIVTDISESGGEAEKVKRVVEKILELVERLAKVVKESVEKLLEILRELAEVSKRVAEALLRLLEELVRVIRIKDERTLREVVRKVLEEAKRLLDELEEVHKRVKKELEDIIEENRRVVKRVRDELREIKRELDE

SEQ ID NO: 15133 - protein, 237 aa, Artificial Sequence
  Synthetic sequence.
REDEVLRDIERLLREIEEKIRRILEESTAELRKRDHMVLHEYVNAAGITKAIKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLLEKIKRVIREHIKALEKLARDLKEILRRHIEALKELARDLAEVIRKLLEDVKR

SEQ ID NO: 15134 - protein, 237 aa, Artificial Sequence; identical to SEQ ID NO: 15133
  Synthetic sequence.

SEQ ID NO: 15135 - protein, 243 aa, Artificial Sequence
  Synthetic sequence.
SEAERLADEVRKAVKKSEEDNETLVREVEKAVRRDHMVLHEYVNAAGITMKRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLNNEILERLLKIVRELHKDNIKILEDLLRIIEEVLR

SEQ ID NO: 15136 - protein, 243 aa, Artificial Sequence; identical to SEQ ID NO: 15135
  Synthetic sequence.

SEQ ID NO: 15137 - protein, 245 aa, Artificial Sequence
  Synthetic sequence.
SEKDEVTRRIRELLKEAEETNREAIERIKRLLDRDHMVLHEYVNAAGITLRRLKKVLDRGLQDDEALLKLLIDALREHNRLSTELIKILIDVLRTILKIIKDVLATNIEIARRILDLVRRLAERGGLDDRLVKEVEKLVRTAERLHRDALRKVKRLVEELEKRLRELVKTDHDLVRRLETLLRRGSGSKEDLLREIARILAESLRLIRELLKEIEKIVKEIIELLERLNDELRKIIEAILETTKK

SEQ ID NO: 15138 - protein, 239 aa, Artificial Sequence
  Synthetic sequence.
SAEDLVRRVKDLVDKLEDKLRKVVRTNERLWEERDHMVLHEYVNAAGITDALVEKLKAGDKDKDELIEEAKSLEDESNALVEKLVRDIERVLAESNKLLDTLAKEIEEVLEEIVELVERGSGSDKEAREKLEDIKARLKEVLKKLREESKRIIDELRRLLEEYKRLVKEIRDRIEEVRKRNSEIRVLVELVRRHNKVLKELVEELEKLVRDHNRVVEEVVRELVELLSRAVEVIKEVVK

SEQ ID NO: 15139 - protein, 232 aa, Artificial Sequence
  Synthetic sequence.
SEKELVDDIRRILEEILRLLRSLLEEVIRLLEERDHMVLHEYVNAAGITRRVAKLLDENGIRTDEADRVLERLEKAHRELLEDYKRALEKIKETLERVLREAEEVVKKIDDALRKLGGSKEVLKRLLEELLRLVEKIAEEIKRLLSELVRVTEELVRTNKELLEEAVRVIRKEVGDDSLVREVEELIKRLEKHIDDLLKTSRDLVKRVLDLVDEVVKRVEDLVERVKEKIDT

SEQ ID NO: 15140 - protein, 243 aa, Artificial Sequence
  Synthetic sequence.
SRVEELKKLIEDILRISREVVERIARVAEDIHRRDHMVLHEYVNAAGITLRTVEEILARKVSGTEAAEALRDTIRRVVDEIRKLLEEHEKRSAELLEEIRKLLEDILRRSERAVEEIRELLKKGVSTKDVLRIIEEILREHLELLERVVRRIEEILRELLKTIEEIVKRIKEILEELKEVLKRGSVGDDEVEREIRRVKEDLDRILEEYRRLLEEIKRKLEEILRRVEELHRRLRRKLEEIDR

SEQ ID NO: 15141 - protein, 243 aa, Artificial Sequence; identical to SEQ ID NO: 15140
  Synthetic sequence.

SEQ ID NO: 15142 - protein, 244 aa, Artificial Sequence
  Synthetic sequence.
DEDRRLEDAVAKLRKEHADIMKKLDDIMRELDERDHMVLHEYVNAAGITKALLTRVLRETREDELLRKVLELLTRLLKLLADVLEENKRLLEDILRLLKELIETNLRLLEEILALLRKVARGPVSEEEAKRLVEEITRLLEASTEEARKLVETIKRLLEESLDKLRSLVEEIERRLRTVLEEIRRRGAPEEIERIIRRVIEVIREILDLVRKVNKKALRVIEEILEDLARVNKKAVDAIDELAK

SEQ ID NO: 15143 - protein, 240 aa, Artificial Sequence
  Synthetic sequence.
DKDKRLEELLKRLKELNDKTFEELERILEELKRRDHMVLHEYVNAAGITRARIEGGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKDIIRTILEVARDLLRLLEEDSRTNSEVVKRLLDLLREDSKANSEVVKRLLDVLRE

SEQ ID NO: 15144 - protein, 240 aa, Artificial Sequence
  Synthetic sequence.
SKEETLKRLLDELEKRNRETVERLERLLKELEDRDHMVLHEYVNAAGITERKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELNLDVAKKLLELLKEDSKLNLDVARELLELLDR

SEQ ID NO: 15145 - protein, 240 aa, Artificial Sequence; identical to SEQ ID NO: 15144
  Synthetic sequence.

SEQ ID NO: 15146 - protein, 243 aa, Artificial Sequence
  Synthetic sequence.
DEEETLRRLLERKVELAKEYLDVSKEVIDRTTKRDHMVLHEYVNAAGITVELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEEARRRLEELLRELNEITKDLEAKLEKLLRDLNELTKALEEELKRLLDELKKRTD

SEQ ID NO: 15147 - protein, 243 aa, Artificial Sequence
  Synthetic sequence.
SEAERTKESLKKVLKALVDLNRELLRKLEENMRRDHMVLHEYVNAAGITLDKVREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRKIVEEILKEIKELADRYREEVRKSKDKLRSILEDYKRKVDELKERLRELIEEVET

SEQ ID NO: 15148 - protein, 243 aa, Artificial Sequence; identical to SEQ ID NO: 15147
  Synthetic sequence.

SEQ ID NO: 15149 - protein, 239 aa, Artificial Sequence
  Synthetic sequence.
SEVEDILRRLAELNKRLIDKLRELIDRIARLNERDHMVLHEYVNAAGITADELIRVVRERGDIPEELLRKLEEELKKIVDELRRLVEEYEKALRDLIKELRKAVEEYRRTLAELVERLRRLEGPEELLKDLAEDVSRNIKAVEEVIRRFEKNVEDNIEVVRRLVDALEKLVRRLESVLRGKGSDEDLKRLLEKLKEDVERVLKEVRDRTAESLKHLEDVIRELEKKTEDSLRHMEERRK

SEQ ID NO: 15150 - protein, 239 aa, Artificial Sequence; identical to SEQ ID NO: 15149
  Synthetic sequence.

SEQ ID NO: 15151 - protein, 186 aa, Artificial Sequence
  Synthetic sequence.
SAEDSIRELLERDERLLEEARKEAKRLNEENERLRDHMVLHEYVNAAGITRLLDDIRKKIKGEKLREIEELVRRVKRTIEKLLEEVKKSVEDSSKRIEELLEAVERSVERTKEEIRRLLDEVRKDRKEELVKRVEERIKRLHDENRRLVKEVIEEVEKLIRDNEKLAEDIEREIRRLLKELDEAAK

SEQ ID NO: 15152 - protein, 182 aa, Artificial Sequence
  Synthetic sequence.
DEAEKLLKELRDLLEESRKDLERLLKELEDLLEERDHMVLHEYVNAAGITKRIKETVERRNEREKLEKLLRELKKVVERLKDNLKDNERRNKEAIERVRKKLKDNERENKKVIEDLRAKLKDLEEVKRKIDRLEEESRRVIEEARKRLEEVEEKSKKIIDDARRALDRIDKELRRVVEETRK

SEQ ID NO: 15153 - protein, 173 aa, Artificial Sequence
  Synthetic sequence.
SLEELLEEARKTVERLIRESERVLRESEERVRRLRDHMVLHEYVNAAGITEVIERVEDEEALKELEKLLREDSKRVKEVLDDLRRDLERNKRRNEKVLRELEELLKRLEELVREGVREEELEKLLREIEERVKEMLKRDEDTLREIERKVKEAVRDSERTLEEIEKRVTEEKT

SEQ ID NO: 15154 - protein, 175 aa, Artificial Sequence
  Synthetic sequence.
SELEKVVDDVRRRLDRLLETSEKLLEDATKRLKDRDHMVLHEYVNAAGITERLKTVLERRETDKRELLKENKEILERTRELSERNLKEVEDILREVEEEVRKNLRRIEKVLEEVRRKLRSELLKRVEERIKRVLDESKKILKEIADEVRRVLERDKELLKRLEDKNREVSERIRK

SEQ ID NO: 15155 - protein, 180 aa, Artificial Sequence
  Synthetic sequence.
SKEEVLREIERLHKETIRRIEEVLREATELHKRLRDHMVLHEYVNAAGITEVIEDVRRADTPNVEELLRELKDALDKVRDHNRKTLKKNEDVVREIEKEVRELLKEDEDVLRRIEKVMRDGRVDARELLEESRREVERSEKEVERLLRKSRKVVEEVRKLSEENDREVKKILEEVKRRLD

SEQ ID NO: 15156 - protein, 180 aa, Artificial Sequence
  Synthetic sequence.
SKEEVLDEMRRLHETTKRDIRRVLKEIEELHERTRDHMVLHEYVNAAGITRVIEDIKRKKTPDVEKLVRRVEEMLKELEKHNKKTTDDDKRVLDEIRRRADELVKEDERVLREIEEVVRAGKVDLKELLDESRRVVKESKEDLDRLLKESRDVVDDTRRKSEKNLRDAERVIREAEEAVR

SEQ ID NO: 15157 - protein, 178 aa, Artificial Sequence
  Synthetic sequence.
DDLERVLKEIKKAADKIREDNKRTADKIRKRVKERDHMVLHEYVNAAGITKEIKERVRGREEARKVIEELKKLVDEVRKRNEKSIEELKKLLKEDRDLMRRVIEELEDLVRRLREEVRDDEALRRVEEEVERLIRDLRRVLKETSDRVRELIDKHRRLSEEVEKDVKRLIDELKKKTD

SEQ ID NO: 15158 - protein, 181 aa, Artificial Sequence
  Synthetic sequence.
DEEETLEDVLRELEERVEKLLRDLTRDLERVEKERDHMVLHEYVNAAGITKRIEELLKRIEDDEKLRRLKEEVRKLVEESRERNKRHHKEVREVLERIRELLERLEKELRRALEEIRDKIRKDGATDEILRKIEELLRRAEEVIRDLERKVRKLERDIRENIKKNHREVREILRKIEEDVR

SEQ ID NO: 15159 - protein, 179 aa, Artificial Sequence
  Synthetic sequence.
SSKEVADELRKKAEKVLDELRKIIRELERKNEDSRDHMVLHEYVNAAGITRVLRDLVRTRGEDDRLVREVERLLRELKRRLEELIRRSEELIKRSREEVDRVIRTVEKLLEELDRLLRANKGDIEDLRRTVDKLVEEIKDLARKLAKSSDDTVREDEKLVEELRKDVKRIVRKIKKDLE

SEQ ID NO: 15160 - protein, 183 aa, Artificial Sequence
  Synthetic sequence.
SEIEKLVEDVRKLVEDNLRHSEEVHRRNRRLIEERDHMVLHEYVNAAGITEELRELAERGEIREEEARKVLEEIKRLLDEIRRHSEEVLKEIERTLKENLKHSEEVLRRIEERLEDIKRKDKDSERVRTLVDRLREELKRSLDESEKLNRESRKRVTRSLEKVDDLVRELEKLARKVLEEVKT

SEQ ID NO: 15161 - protein, 177 aa, Artificial Sequence
  Synthetic sequence.
SEAEKVVEELKKLLREVEKKIRDHTEDVKRILEERDHMVLHEYVNAAGITKELKDKNSDDDTVRKVKEELDRSHEKLREELRKVAKELKESNEELERDLKRLVEEAEDRLRRLKDRVSEKVLRELEKILEDIKRTLDKLLRENRETLKRIEDRLRELLEENRKLLEKIERELRERSR

SEQ ID NO: 15162 - protein, 182 aa, Artificial Sequence
  Synthetic sequence.
DEIETVLDEVRRLHEDAKRRLEEMIDEVRKLNEERDHMVLHEYVNAAGITRTVKEEVERAGLDKGKLEELEERLERVREDVERILREIKRRNEKTLEDSERILEENKERNRTVLKKLKELRDRGSDAREALKESRKVVEESRESVRRVLEKNRRVVEESKRLAEELLRRVKKVVDEIRKRVE

SEQ ID NO: 15163 - protein, 178 aa, Artificial Sequence
  Synthetic sequence.
SSKDEIRRRVEEVVERSDEIVKRSREHVKTVVDERDHMVLHEYVNAAGITKKLDKIRKDGGSEETLKRVLDELREILKELKEEVKKVKRKLEKVVKENRDTIREVEERNRKILDELRKRGVEERALREVEEISRKSEEKLRRVLKESEDIAKEAEDRLKTVLERVERIADEVLKRLTK

SEQ ID NO: 15164 - protein, 182 aa, Artificial Sequence
  Synthetic sequence.
SDADRVAEELKKLVEDSRRENERVIEESKRLVKERDHMVLHEYVNAAGITDKLRDILEKEKDKKTLDDIVREILERLKRLLEKVEDENRKSHEENKRLLEDVKRKNKRISDELKRLLEEIERRNVDVDKVRETVKRLLEENKRVMEKTEEVAKKSSEDIKRVADETRRRAEELLKEVDELRK

SEQ ID NO: 15165 - protein, 182 aa, Artificial Sequence
  Synthetic sequence.
DEVDELLKRLRKLVDEVRKENDKMVKESKRLVEDRDHMVLHEYVNAAGITEELEKILKDTEDKDTLRKIVEEIKRRLRRLLEELKRIIEKALRDNKKLLDEVRKRNKEISDELRRLLEEIRRRNVRVEDIEREAERLLRENEELLRRSEEVIRRSTEKIKKVLRDAEERAREILKRVEDAAK

SEQ ID NO: 15166 - protein, 175 aa, Artificial Sequence
  Synthetic sequence.
SEVDEVLREAKRIVDEVHKDNERATEESRRLVKKRDHMVLHEYVNAAGITKEVKDANIDEKLVTEILKEIEEALKEAARRNKEVKDRLRELSRRVSERNREILEELKERLDRVRERRKDVKELEREVEKLLKRIEESLRRHRKENKRLLEELDRSLRELAKIVKEVLDEIRERTR

SEQ ID NO: 15167 - protein, 178 aa, Artificial Sequence
  Synthetic sequence.
SEEEKLKEVKDRIREVLRKLEEHTDKVKKEVEKVRDHMVLHEYVNAAGITAMLERLRRKKKDAEDLLRELEKIIEEIERELDRVLEENDKMAEEWKKLLDKVLDDNRKSIRDIEKELDDREPTDELVTEVEKLLRDDEETNRDVVKKVREAVKKDADTNRKVIEEVKKVLEDAARRLD

SEQ ID NO: 15168 - protein, 186 aa, Artificial Sequence
  Synthetic sequence.
SEVDEVRKTLEDLLRRLDEENKDIIRRNKELLDDRDHMVLHEYVNAAGITDELRKILEKLKDRETLTRIIEEIEKRARELIKRLRDEIRKIEEESKKSIEDSRKRNDEIRKRLEELIKDLRDKIKDSEELARRITELEKRVREVIERLKEKNKRLEDDSRRVITELRKKLKDLEDRVREEIEELRK

SEQ ID NO: 15169 - protein, 179 aa, Artificial Sequence
  Synthetic sequence.
REDERLEEIARKIKKVVDELVERNKKLTEDNHESRDHMVLHEYVNAAGITEVAKRAIERIRSDKKVVDEVKKLLEDAKKHSKEVIDELRRLNEESKRSSEDTIRRMRKLLRELEETVKAKKGDVEDIERKVEDIIRRLEDLSRRNEEKVRRISEEIKKLSKDNERTIKEIIKEIEERVK

SEQ ID NO: 15170 - protein, 185 aa, Artificial Sequence
  Synthetic sequence.
DDIERLKREIERLLKEAEKISRDNEERSKELLDRRDHMVLHEYVNAAGITEELKRLADKIKDKEELTRRLKEVVDRVEKSVRDSERMLREVVREDEESVRRSKTKLEDLLRKVEELVRRLEKKVTDEKVKRDAREALRKAKKKVDELKRKNDEVHRRSREEVKRLLEENRKLLEDLRRMVREITQ

SEQ ID NO: 15171 - protein, 176 aa, Artificial Sequence
  Synthetic sequence.
REAEEAKEEVEELNRRNKKELDDARRRVDELDKRRDHMVLHEYVNAAGITEELERVKEEGRSDDRLREKIERMLKTSADELERLKEENKRALRDLAERLRELIERNRRKLEEITRRTVPDKDVLKRLAELIKESIRELERVLEELAEKIDRSLKELDDVLRKNETDLKRVIEDLKR

SEQ ID NO: 15172 - protein, 179 aa, Artificial Sequence
  Synthetic sequence.
DEAEKAKRDSEKVVEDNRKMLEDSTRRAERLNEERDHMVLHEYVNAAGITREIDETKRRGTDDEVVKDLIRRVEELLERSRKKLEDLTRDNERVLDESRRRLEKLIRDNERIVKDLTDRVVRVDEVLKRLKEEHRRLIEELEEVLRRNEEIIRRSIEDLERVLDRNRRELEDVIRRLKE

SEQ ID NO: 15173 - protein, 174 aa, Artificial Sequence
  Synthetic sequence.
SEEEVLREAAKTVEKLLDEIRRSLEKVSKRVEDSRDHMVLHEYVNAAGITELLEELRKNNVDRTLLEDVRRKLERIEERNEEMNDRSRRKLEELRERNRKILEDIRRTLEDLKRRQLPKDDVERTLREIAKLVDEVDKENKRALRENEERVKTLNRENEEMLKRIEEEVRRATK

SEQ ID NO: 15174 - protein, 182 aa, Artificial Sequence
  Synthetic sequence.
SELEKTLEDLKRHSEENKKKLEEDLRDMERNLKERDHMVLHEYVNAAGITKDLERRFREGDIDERELERVRRKMEEIKKRLDENVERNRRKAEDIKRKLDENVKRSEDRVKEIKEDIRRRVRDKDKAEELERRLDELVKENREIHERVKKALDDIVKELEELHERLKRRLEEILRRIAETVR

SEQ ID NO: 15175 - protein, 186 aa, Artificial Sequence
  Synthetic sequence.
SEIEKLIEELRRELEKVKDELERSIEEMDRELDDRDHMVLHEYVNAAGITREVTERTKRGDRPEEVLRKELEDIKRKLRRILEEHHEKIRRIKEKLRRENKRVRDELKRIKDEIDEKVKDVRRKGADEELLKRLEEVAEDVKRALEELLKKHTRVVERVEKALDELDKELERIVREAEKELDRREK

SEQ ID NO: 15176 - protein, 179 aa, Artificial Sequence
  Synthetic sequence.
RLEDEVRKMEKEVREEVKRLEDESRKVLEESRRNRDHMVLHEYVNAAGITERIKDLRRRGLDERVLRELLKRVREVHERNRKLLDEVRRASEKVHEDNRRILEEVRKTVKDVVDKLRRVDAKVVKELIDRVRKILEDVEREVKKSIEEVKEINRRLNEEVKKTIEEVKEIVKEVTERAK

SEQ ID NO: 15177 - protein, 183 aa, Artificial Sequence
  Synthetic sequence.
RVDERLDTVLKRVEETVRENKKKNDELLERSKENRDHMVLHEYVNAAGITREAEKLKREVTKEEVKKIIDEVLKEIEDLLRTVKEELDRALERNREVVEETKRRIDRVLKEIEKLIRDVKRDRKEEVVKEVEERIKKLLKEVNDTSKDAERRLRETNERLNEIVKEVEKRIRELSEEVRKRVK

SEQ ID NO: 15178 - protein, 172 aa, Artificial Sequence
  Synthetic sequence.
SRAETVLKEVTDKIKKLADSSDELLRRNKENIDERDHMVLHEYVNAAGITEEIEKGSVDEETLEELIRRVEAELEAHHRELEKNSREDEKRNRDHHAKLEEEMRRVEERLEREGIDDEVVKRVRDLLDTVRRRNEKVNEDVKRMNDKLRRDNEDVIRRVEKLLRELEEKRRT

SEQ ID NO: 15179 - protein, 174 aa, Artificial Sequence
  Synthetic sequence.
KEVEDAVKELEDLLRANEDKTRSIVEDMRASNKDRDHMVLHEYVNAAGITDDLRRAGVPRDSLKRLAEDVERVTRESRELLERVHRADRELIERLKESNERLRRAIEEIRKAIKGGSDIKTLLDRVRKLAEEDAERLDRLRRESEELNERVRRVDKKLLEEIRRKAKKVEDDTR

SEQ ID NO: 15180 - protein, 181 aa, Artificial Sequence
  Synthetic sequence.
SEVDDVLRRLEELIKTLEDINAKSLEDIKKLIDDRDHMVLHEYVNAAGITRELREAKKGIDSREAEEIAKRVLEELKRTSDDLRKKVERVDEDLRRLLRENHERNKKILRDLERLLRDAARRGVPKEALDRMREEIRRLEEESRKSDETIERLIRELRRRVEEVLKTSTDLIRELEEEVKK

SEQ ID NO: 15181 - protein, 245 aa, Artificial Sequence
  Synthetic sequence.
TEEEVLRKVEKLIKDLLDVLRDLLRASEEVVREARDHMVLHEYVNAAGITELSRALSGGSRESVESALAKNEERLKKILEDADRVLDKWRRLLEELSKKAKAVLDEVRKRLEEIKREVPETEKLRTLLTILEEILRALEKIIRDILRINERLLEKLKRILERLRETNREIDERIRKLVEEARGGSEEKLRRDLTETKKELEKRHEDLRRELEKLLRDYKRELEEIERALEEIEKTLKRRADETRR

SEQ ID NO: 15182 - protein, 238 aa, Artificial Sequence
  Synthetic sequence.
SKEDKARELEKRLRDNLKKLEEVVRELAEVLKRNRDHMVLHEYVNAAGITRLLDKLRAGGLPKDELEDLRREVEDVLRRLEDLLRKLKKANDESLTRLEELLRRAEEENRRVLTTLRELLRGNGDDRDLARLVARLVEANNRALEELLRLVAKNVEDNNRVLEELLRLVKELAKRLLGRIRDEDLVRDIRRELKELEERARKILRDDERDLRALEKRIRDIIREDREELERLKERARK

SEQ ID NO: 15183 - protein, 243 aa, Artificial Sequence
  Synthetic sequence.
KREDILKKLEDIIRDIIDKLRRILEKVKRLNEDIRDHMVLHEYVNAAGITDLLKRIADKSRDRELEDILRRVLEKLRRSLDKLRDTLRKLKEETDTVLERAERTLKELKDRLEKLLRDGEKVSEEDLVEALKALIDELRKVLEDVIRVSKELVERLLRALREHLETNKRLVKELLDALRKTTGDDEEIKRLKEELERRHRRLEEEVERVARELEKAHRDLERDIRRVAEELKKLLKKLRDDRR

SEQ ID NO: 15184 - protein, 244 aa, Artificial Sequence
  Synthetic sequence.
SAEETLRRITEESKRVLEEITKKYEDLERESREVRDHMVLHEYVNAAGITDVLTKGGDDKDEVLTVLEKVLDELLKLHRENLRVIKELLRKVLEVDRENLEVLKRLLEKARDLLRRSGRDEKDLKKLEDELRKVKEELEKKHEASKRDIEDLERELDKVTEEVERLLRKLKEELRRAAEGSDEDRERLARLLKALADKLIRVLEEILKINEELNRKIIKFARENLERNRRVNKKVIEVLREAAR

SEQ ID NO: 15185 - protein, 250 aa, Artificial Sequence
  Synthetic sequence.
STEEILKRVKEILDELAKELRDIIRESLRTIEELRDHMVLHEYVNAAGITELVKTIKDGVKDSEELLRRLKRLLEDLRRAHEELLKRLKEAVDEHRDRLRKILEELERVLKELRKRIEELRRSGDRISEKDVLRKLEEVLRKALEILERLLKKIRESARELLKIIEEVLDANIKVMEEALKTIKELLKDGPDEVKRRLEEKERRIRTRYEELRRRLRKRVKDYEDKLREIEKKVRRDAERIEEELERAKK

SEQ ID NO: 15186 - protein, 242 aa, Artificial Sequence
  Synthetic sequence.
SEKERLMRLLDKLKDLNRRLVERIKELLDKALELRDHMVLHEYVNAAGITELVERGGVPEELLTRIDELIKKLEDEARKISKEVKRLIDELKKRLEDIHREVDRLIRELKETLKGVTDKDELLRRVAEVLERIARLSEELIREVKEVLEKIVELSRELLKRVLDVLRRIAELLEDALRKGNVSEETVRRLREALKKLEDDLRKIERDAEREYKKLKDELEELTERYRREIRKLKEELKADRK

SEQ ID NO: 15187 - protein, 240 aa, Artificial Sequence
  Synthetic sequence.
SDKEEIKRRVEKTARDLETEHDKIKKRLEDTVRDRDHMVLHEYVNAAGITRKIEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALAKLIKELLEALEEVLRRNKELIRELLRVLDEALK

SEQ ID NO: 15188 - protein, 240 aa, Artificial Sequence; identical to SEQ ID NO: 15187
  Synthetic sequence.

SEQ ID NO: 15189 - protein, 248 aa, Artificial Sequence
  Synthetic sequence.
DEDRIIEEIARLLEELLRELLELIKKLIETNRRLRDHMVLHEYVNAAGITELLDRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIAEEIERELEELRRMIKRLHEDLERKLKESEDELREIEARLEEKIRRLEEKLERKRR

SEQ ID NO: 15190 - protein, 236 aa, Artificial Sequence
  Synthetic sequence.
STREKAKKVLDTLRADNEDMKRVVEKILRALKRTRDHMVLHEYVNAAGITRILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDLLRKLEEELRRIKEKLRKALEELEREHRELEKELDKLHDESRKEHERIEEELRR

SEQ ID NO: 15191 - protein, 231 aa, Artificial Sequence
  Synthetic sequence.
SKEEEVEKVLRKWEEILRRLIEENKRANDKIRRERDHMVLHEYVNAAGITEVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDVVRALIEVIERLLRVAEEVIRRILKVNTELMRVDERSIRESLKAISEVLKVLDT

SEQ ID NO: 15192 - protein, 247 aa, Artificial Sequence
  Synthetic sequence.
RDRDVLRKVKAEIEELVARIEKVSRDALSEVKRLRDHMVLHEYVNAAGITSLLRKIRDTRGDDEVVKETEEVLRDNHRLLEELIRRLIKVLEEWLRRHKKLLDEIRELLKEILRLVKESGVSEDLLRRLKRVIEELDKKLKESEEKLRRVVEKAKEDLKAVLEEHRKVLEDLKRALEEVREKLRERGSEEVVEELLRMLKRVAEEMKRVHDDLSRAVEKVVRDVVRVDKELLDELARILRRLEEVIT

SEQ ID NO: 15193 - protein, 237 aa, Artificial Sequence
  Synthetic sequence.
KEKEDALKKLEDLARKSREDLERVLRKHKKILDKRDHMVLHEYVNAAGITDDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELAREVERVIKELLDKSKEILERIERAIDELLKVSEEILKLSEDASEELLKILREFAK

SEQ ID NO: 15194 - protein, 240 aa, Artificial Sequence
  Synthetic sequence.
DREKSVRDIEEDLKRVLDKLRRRVETSKEELKKVRDHMVLHEYVNAAGITDVVRELDRGIDSEVLRAVREIVKRLVEVVRRYNELSEKIIRDLVRVNDRVLELLKRIVKRLIDVVRELEKIGDKEKALRRLEEVVKEVKRRIEELLKELEDVHRELVKILEEVNEDLKRVATEVKEIIKTGIKSSEVAKELDEVIKRLLDNLKENTDRLKEVIDRNLADLRDLAEELRAVIERLLEDARR

SEQ ID NO: 15195 - protein, 240 aa, Artificial Sequence; identical to SEQ ID NO: 15194
  Synthetic sequence.

SEQ ID NO: 15196 - protein, 241 aa, Artificial Sequence
  Synthetic sequence.
SAEEAVEKLVRIARAIVKINEDLSREVVRILREIRDHMVLHEYVNAAGITEVVKVVEDGGLSEDVVRKLRKLVKELEDLLKKSNDDIRKLVEDVARRLKESNDEIRRLVERLEELLKRGPGDEELLRLVEELTEELLRTHEEVVKALEKLTADLLELHRELLERVRRLTKRIEEELKRVGVSEELLRRLEELRKRLEKVLDDSAKELEKLKRELERLLEESRRKLEKLKRDLERVLEETRR

SEQ ID NO: 15197 - protein, 237 aa, Artificial Sequence
  Synthetic sequence.
REDEVLRDIERLLREIEEKIRRILEESTAELRKVRDHMVLHEYVNAAGITAIKEDVERKGIDEELRKLLDEVLDKLTKLIERNKRSLERILELIKRIIDENLEVLRDIIRLLEELLKATKDNGVPKDEVIKLVEDVVRRIEELVTRVVARNEKLVKDLDDLAKKNVRENEELLREIDRGLDEDLLEKIKRVIREHIKALEKLARDLKEILRRHIEALKELARDLAEVIRKLLEDVKR

SEQ ID NO: 15198 - protein, 237 aa, Artificial Sequence; identical to SEQ ID NO: 15197
  Synthetic sequence.

SEQ ID NO: 15199 - protein, 243 aa, Artificial Sequence
  Synthetic sequence.
SEAERLADEVRKAVKKSEEDNETLVREVEKAVRERDHMVLHEYVNAAGITKRLVDLLRDGQVSDRDLLKELEEVLRRVLEALAENHERTEEILKRWLDRYAEDIERLRKVLKEVIEALKRGGSDDKRIVDELEEILRRNEDVLDKIAKRLRRLLEEDRRLLERIVRELKRLLDDLDRITKEGKSEELVRIAIEVLKRLLEIIEELVRLNNEILERLLKIVRELHKDNIKILEDLLRIIEEVLR

SEQ ID NO: 15200 - protein, 243 aa, Artificial Sequence; identical to SEQ ID NO: 15199
  Synthetic sequence.

SEQ ID NO: 15201 - protein, 239 aa, Artificial Sequence
  Synthetic sequence.
SAEDLVRRVKDLVDKLEDKLRKVVRTNERLWEEIRDHMVLHEYVNAAGITALVEKLKAGDKDKDELIEEAKSLEDESNALVEKLVRDIERVLAESNKLLDTLAKEIEEVLEEIVELVERGSGSDKEAREKLEDIKARLKEVLKKLREESKRIIDELRRLLEEYKRLVKEIRDRIEEVRKRNSEIRVLVELVRRHNKVLKELVEELEKLVRDHNRVVEEVVRELVELLSRAVEVIKEVVK

SEQ ID NO: 15202 - protein, 249 aa, Artificial Sequence
  Synthetic sequence.
DAEEVVKRLADVLRENDETIRKVVEDLVRIAEENRDHMVLHEYVNAAGITRIVELLRRGGVPEELLDRLAKVVKSIVEKAEKILERLNRVSKAIAEKLKTIVDELNEVSKEIVKRAEDILRKGKDKETVLRALRTLVKEYADLSKEVLERVERIVREYVKLSDEVVKSLAEIVEELIRIIEDLLRKGNLDEDVKRALEELVSRLRKLLEDVKKASEDIVREVERIVRELAKRSDEILKKLEDIVEKLRE

SEQ ID NO: 15203 - protein, 249 aa, Artificial Sequence; identical to SEQ ID NO: 15202
  Synthetic sequence.

SEQ ID NO: 15204 - protein, 240 aa, Artificial Sequence
  Synthetic sequence.
DKDKRLEELLKRLKELNDKTFEELERILEELKRARDHMVLHEYVNAAGITARIEGGNLDKRLAELLKKLLDDLKRLLEEYTRTNEELLKRLRELLERYRETNKKLLDLLRKLLDEARRTGTDEDLLRRLEDILRKYEDEVRRLLKELEDILREYEDTSRRLLEELERIAKEAAERVSRGSDKDVKDIIRTILEVARDLLRLLEEDSRTNSEVVKRLLDLLREDSKANSEVVKRLLDVLRE

SEQ ID NO: 15205 - protein, 240 aa, Artificial Sequence; identical to SEQ ID NO: 15204
  Synthetic sequence.

SEQ ID NO: 15206 - protein, 240 aa, Artificial Sequence
  Synthetic sequence.
SKEETLKRLLDELEKRNRETVERLERLLKELEDRRDHMVLHEYVNAAGITRKIEESGLSKELKDTLARILEELRKLLEEYFRKNEELLRLLRKLLDEYARTNEELLRLLEELLDTARRTGGDSELLKRLEDIAREYEKRVRRLLEKLKDILDKYRKTVEELVRKMEEILKEAKKTISRIGSEEVKDIVRAMEEVIRRLIEILRRDVELNLDVAKKLLELLKEDSKLNLDVARELLELLDR

SEQ ID NO: 15207 - protein, 243 aa, Artificial Sequence
  Synthetic sequence.
DEEETLRRLLERKVELAKEYLDVSKEVIDRTTKLRDHMVLHEYVNAAGITELLERGDLGPDELIKRLAEELERSLRELEEEIKRLKRELEESLKKLKEIIDRLAEEAEKLLAVLKRGEGSEEEALRALASLVRELIEVLRENDERLRDVLRRLIEALRKNNEILERVLRKLVRAAEERGRDESSREALEEARRRLEELLRELNEITKDLEAKLEKLLRDLNELTKALEEELKRLLDELKKRTD

SEQ ID NO: 15208 - protein, 243 aa, Artificial Sequence; identical to SEQ ID NO: 15207
  Synthetic sequence.

SEQ ID NO: 15209 - protein, 243 aa, Artificial Sequence
  Synthetic sequence.
SEAERTKESLKKVLKALVDLNRELLRKLEENMRERDHMVLHEYVNAAGITDKVREGGIVDKDAEREAERLMRELDKSSEDTARETRKLIEESKKSTRRTEEEARKLTETLDRLAKGGLPREDLLRALVRLLEELARLIEEDVRRNAELVKRHIELVERDVAELLRLIKELVDLLADLAEKGSRTEEIRKIVEEILKEIKELADRYREEVRKSKDKLRSILEDYKRKVDELKERLRELIEEVET

SEQ ID NO: 15210 - protein, 243 aa, Artificial Sequence; identical to SEQ ID NO: 15209
  Synthetic sequence.

SEQ ID NO: 15211 - protein, 186 aa, Artificial Sequence
  Synthetic sequence.
SAEDSIRELLERDERLLEEARKEAKRLNEENERLLRDHMVLHEYVNAAGITLLDDIRKKIKGEKLREIEELVRRVKRTIEKLLEEVKKSVEDSSKRIEELLEAVERSVERTKEEIRRLLDEVRKDRKEELVKRVEERIKRLHDENRRLVKEVIEEVEKLIRDNEKLAEDIEREIRRLLKELDEAAK

SEQ ID NO: 15212 - protein, 178 aa, Artificial Sequence
  Synthetic sequence.
DEVEKLLRDLEELDRDIERKVRELLKRNKEVLDDIRDHMVLHEYVNAAGITEVADVIRKTTDKRTVDKLLKELEKILKEVLDRVRRLLEEAKESLDRSREEIERLLEESKTLVDEVRRAGIDKKEVDKIEKHSRDLIERAKRETDRLLEEAERLMREVVDRVRKILEEAKRLIDEARR

SEQ ID NO: 15213 - protein, 182 aa, Artificial Sequence
  Synthetic sequence.
DEAEKLLKELRDLLEESRKDLERLLKELEDLLEESRDHMVLHEYVNAAGITRIKETVERRNEREKLEKLLRELKKVVERLKDNLKDNERRNKEAIERVRKKLKDNERENKKVIEDLRAKLKDLEEVKRKIDRLEEESRRVIEEARKRLEEVEEKSKKIIDDARRALDRIDKELRRVVEETRK

SEQ ID NO: 15214 - protein, 174 aa, Artificial Sequence
  Synthetic sequence.
SRDEKIRDILRRVLKEVRDSTKKVEEDLEDVHRRTRDHMVLHEYVNAAGITRVRDEGASEELKRRMEEVVRRIEELLKKLLKEDRDVVKEIRDKLDETRKEMEEVAERIKDKIRRGDGREKVAEEVKRIADRLIDLNRRIAEEVDKIVRDSIKKVEEIVTEVEKIVEKLIRDVR

SEQ ID NO: 15215 - protein, 173 aa, Artificial Sequence
  Synthetic sequence.
SLEELLEEARKTVERLIRESERVLRESEERVRRLIRDHMVLHEYVNAAGITVIERVEDEEALKELEKLLREDSKRVKEVLDDLRRDLERNKRRNEKVLRELEELLKRLEELVREGVREEELEKLLREIEERVKEMLKRDEDTLREIERKVKEAVRDSERTLEEIEKRVTEEKT

SEQ ID NO: 15216 - protein, 179 aa, Artificial Sequence
  Synthetic sequence.
STREDARRLVERVRKEVKRLLKKNSDLLREVTERVRDHMVLHEYVNAAGITEAKRLKDSDERDVERLLDRARKLVKESEDLIRKLLKDLRELVRRSEKDIDELRKELKRLLDELRARATDKDLERVVREIEKEIRDLIRELEENVKTSEKLIEDLIRELEKSVDESRKRVEELVKELRT

SEQ ID NO: 15217 - protein, 175 aa, Artificial Sequence
  Synthetic sequence.
SELEKVVDDVRRRLDRLLETSEKLLEDATKRLKDSRDHMVLHEYVNAAGITRLKTVLERRETDKRELLKENKEILERTRELSERNLKEVEDILREVEEEVRKNLRRIEKVLEEVRRKLRSELLKRVEERIKRVLDESKKILKEIADEVRRVLERDKELLKRLEDKNREVSERIRK

SEQ ID NO: 15218 - protein, 174 aa, Artificial Sequence
  Synthetic sequence.
SELEKVVKEVADLLRRNLEKSKRVLEEVRRRLEENRDHMVLHEYVNAAGITRILELVREGKDKRDLTRLLEEDDKRVKEALDKSRENNERILKEVRRALRESEEDNRRILKEVREKVDSRLLEELEERVRESIERSRRFIEELEKIVEETLTESEKLARASSEITKTVLDEIRK

SEQ ID NO: 15219 - protein, 180 aa, Artificial Sequence
  Synthetic sequence.
SKEEVLDEMRRLHETTKRDIRRVLKEIEELHERTLRDHMVLHEYVNAAGITVIEDIKRKKTPDVEKLVRRVEEMLKELEKHNKKTTDDDKRVLDEIRRRADELVKEDERVLREIEEVVRAGKVDLKELLDESRRVVKESKEDLDRLLKESRDVVDDTRRKSEKNLRDAERVIREAEEAVR

SEQ ID NO: 15220 - protein, 187 aa, Artificial Sequence
  Synthetic sequence.
DEEEELRKRLEKLSKEVRELLRRDEEEDRRLNRELRDHMVLHEYVNAAGITEVEDLLRKARRKVSEEELTRLRKKLRDLEEESKEALRELRRRVEELNKENKKSLDDLERRLKELEDRAREVEKRDRREDELRELLRRLEDVIRKLAEDLKRNTEDLRRVIKELAERLEELNKRLKREIRRLKEELR

SEQ ID NO: 15221 - protein, 171 aa, Artificial Sequence
  Synthetic sequence.
SEKEKVIKEARELLERLRKRLKDVNDDVTRLLDELRDHMVLHEYVNAAGITRLEEEVPVEDVIRELKRRLEEVDKKNRDILETLKRELDEVSRRTREELEKLRKELEEVEKAGLPAEELKRVADRLRRRLERLVEENERVVKKILDEIRRSVEENKRIVDKVRKDLDERRK

SEQ ID NO: 15222 - protein, 177 aa, Artificial Sequence
  Synthetic sequence.
SVIERVEEEMEKVIRDSERVTKEVEDRAREVHERSRDHMVLHEYVNAAGITELRRAGVDKRILDELRKRIKDSREDLERINEELRRALRKLLEDSKRINEELRKTLEELRKRLERVDDEEEVKKLAEEVRRLVEDSIRKLEELARRVDELVRESIERVDRNVEENKRLVREAIERRR

SEQ ID NO: 15223 - protein, 183 aa, Artificial Sequence
  Synthetic sequence.
SEIEKLVEDVRKLVEDNLRHSEEVHRRNRRLIEENRDHMVLHEYVNAAGITELRELAERGEIREEEARKVLEEIKRLLDEIRRHSEEVLKEIERTLKENLKHSEEVLRRIEERLEDIKRKDKDSERVRTLVDRLREELKRSLDESEKLNRESRKRVTRSLEKVDDLVRELEKLARKVLEEVKT

SEQ ID NO: 15224 - protein, 181 aa, Artificial Sequence
  Synthetic sequence.
EEIERALREMRELSRTHKELVEKILRDIAELAKTHRDHMVLHEYVNAAGITEIADEIRKEDKKEELKRKIDELRRRAEELLKESKEHLKRLEDTVRELIERLKETLKKVEEDLKRILEKLEKSRELDEIAKDVKRLIDENRELLKRVEDEVRRLIRKLEELNRRTEEEVKKLIKKLEDDLK

SEQ ID NO: 15225 - protein, 174 aa, Artificial Sequence
  Synthetic sequence.
REIEEAAKDLDRLLEENKKLVKEVEEELRRLLKENRDHMVLHEYVNAAGITELRRRGVPEEELKEVEERARRVIEESRRSSKELEKRLRELLEELRRSTKELEDRLREIKKLLRNGKDVEEVLRRVRKLSRENKEKIRKILEDVKKLSEDNKRRNEELSRRVKTLVDEIKKRAT

SEQ ID NO: 15226 - protein, 177 aa, Artificial Sequence
  Synthetic sequence.
SEAEKVVEELKKLLREVEKKIRDHTEDVKRILEELRDHMVLHEYVNAAGITELKDKNSDDDTVRKVKEELDRSHEKLREELRKVAKELKESNEELERDLKRLVEEAEDRLRRLKDRVSEKVLRELEKILEDIKRTLDKLLRENRETLKRIEDRLRELLEENRKLLEKIERELRERSR

SEQ ID NO: 15227 - protein, 178 aa, Artificial Sequence
  Synthetic sequence.
SKVEKLEEEIARLVERSRRLVEELKKEVTKVKEKVRDHMVLHEYVNAAGITKLRDIKRRGGSEEVLRRVTEELKKVLEDNRRVIEEVLRDLERILEELKRKAEEVTKRNRDDLKRLRDSGVDEEVLRRVEETSDRSEKELRTVLRDVTEDIKRIAEELKKALEDSTEIIRRAEDELRT

SEQ ID NO: 15228 - protein, 182 aa, Artificial Sequence
  Synthetic sequence.
DEVDELLKRLRKLVDEVRKENDKMVKESKRLVEDLRDHMVLHEYVNAAGITELEKILKDTEDKDTLRKIVEEIKRRLRRLLEELKRIIEKALRDNKKLLDEVRKRNKEISDELRRLLEEIRRRNVRVEDIEREAERLLRENEELLRRSEEVIRRSTEKIKKVLRDAEERAREILKRVEDAAK

SEQ ID NO: 15229 - protein, 186 aa, Artificial Sequence
  Synthetic sequence.
SEVDEVRKTLEDLLRRLDEENKDIIRRNKELLDDLRDHMVLHEYVNAAGITELRKILEKLKDRETLTRIIEEIEKRARELIKRLRDEIRKIEEESKKSIEDSRKRNDEIRKRLEELIKDLRDKIKDSEELARRITELEKRVREVIERLKEKNKRLEDDSRRVITELRKKLKDLEDRVREEIEELRK

SEQ ID NO: 15230 - protein, 183 aa, Artificial Sequence
  Synthetic sequence.
SEVDEVLERIKRLLERLAEHSDKVVRDIEKLLDDNRDHMVLHEYVNAAGITRLEEMRRRGDLREELLERVVREVEKEIRDIKRKNKRSVETVEKLVRDDRKELKRALEDVERLIRELETRLKDKEELRRKLEKVLREAEKVIDELLKKTDEVLKRARETIEDLNRKLDKVLKEVRDKLDRLRD

SEQ ID NO: 15231 - protein, 179 aa, Artificial Sequence
  Synthetic sequence.
KDEETLKRLLEKAKEVVDRLKDENEKVTRDNHESVRDHMVLHEYVNAAGITVARDAIRRVREAKEVVDTAEKLLRDNHEHSRDTVKKARELNETSRRHSERIVEKIEEILEEVERTLRENRGDVRELAKKVEKAIRELEELSRENREAVKRISDEIKRLSDENAKDSERIIKEIDDRVR

SEQ ID NO: 15232 - protein, 185 aa, Artificial Sequence
  Synthetic sequence.
DDIERLKREIERLLKEAEKISRDNEERSKELLDRLRDHMVLHEYVNAAGITELKRLADKIKDKEELTRRLKEVVDRVEKSVRDSERMLREVVREDEESVRRSKTKLEDLLRKVEELVRRLEKKVTDEKVKRDAREALRKAKKKVDELKRKNDEVHRRSREEVKRLLEENRKLLEDLRRMVREITQ

SEQ ID NO: 15233 - protein, 184 aa, Artificial Sequence
  Synthetic sequence.
ELIKKARKDVEEVRERSERLVDELRKRNKKLADESRDHMVLHEYVNAAGITEIEDLLRKRRTKDVLKEIEDLVRELERELRRVVKESSDKVRKLIRENEKVVEESSRLFRDLVEKLRRVVEERNDKKLMEEVERLIKRLEDVNEKSERDVREINKESERVNEETEREVEDAIRKLREVLRRAKK

SEQ ID NO: 15234 - protein, 186 aa, Artificial Sequence
  Synthetic sequence.
KEVEDLERRVKEILDRMKRLIDENRKKIEKSIRELRDHMVLHEYVNAAGITELKDLKREGGDDARTLRERVRKIIEDVEEHSRRSTEEVRRIHKENKEHSERSSDEIRELLRRVEELIEEVKRRLRDKEMEKKLEDIVRRVREVVRRAHETNERLVDRSRKAVEKAERTNRRLVEEIRKVAEEVRK

SEQ ID NO: 15235 - protein, 186 aa, Artificial Sequence
  Synthetic sequence.
KEVEDLERTVRTILKRMRELITRNEEEIRRSIEELRDHMVLHEYVNAAGITEMKELKKEGGDDKKRLVEEIKRLLDELRENSKRSSDRAKEIHERNKRHSEESSRTIEKLLKELRDLVRDVERKLRDEDAKRKLDELTKRVEKVVREADERNKRLTKRSKEVLDEVHRANEEALKEVEEVVRRVTK

SEQ ID NO: 15236 - protein, 185 aa, Artificial Sequence
  Synthetic sequence.
SAEELLRTIEKRIEDNHRRLEEILEEIARLIEDMLRDHMVLHEYVNAAGITVLDRVRRAGVPEEVLERVRRELERLKKELEELRRRSEEKVKELKRRLEEIRRKLEEEHRDLRRKLEELRRDLGDKEEVVKKLVEDVERELERSLREAEDLLRRVEEVIRTSKKESKDVLEKIERLLRDLERRTR

SEQ ID NO: 15237 - protein, 182 aa, Artificial Sequence
  Synthetic sequence.
SELEKTLEDLKRHSEENKKKLEEDLRDMERNLKENRDHMVLHEYVNAAGITDLERRFREGDIDERELERVRRKMEEIKKRLDENVERNRRKAEDIKRKLDENVKRSEDRVKEIKEDIRRRVRDKDKAEELERRLDELVKENREIHERVKKALDDIVKELEELHERLKRRLEEILRRIAETVR

SEQ ID NO: 15238 - protein, 179 aa, Artificial Sequence
  Synthetic sequence.
RLEDEVRKMEKEVREEVKRLEDESRKVLEESRRNLRDHMVLHEYVNAAGITRIKDLRRRGLDERVLRELLKRVREVHERNRKLLDEVRRASEKVHEDNRRILEEVRKTVKDVVDKLRRVDAKVVKELIDRVRKILEDVEREVKKSIEEVKEINRRLNEEVKKTIEEVKEIVKEVTERAK

SEQ ID NO: 15239 - protein, 183 aa, Artificial Sequence
  Synthetic sequence.
SIREKIRELEERLEEVLRRIEENSERVLREAERVLRDHMVLHEYVNAAGITALEEIRKLPVEDELVRRVKELVERLKRHNKKSSEDVERVVRELKEELKRSSEEVKKAVDRLKEELEKVLRDGGEREVDRVIRKLEDVLRKLEEHNRRVVERLKRLLEELKKHNEDSLRKSEEVLRKLEEDAR

SEQ ID NO: 15240 - protein, 174 aa, Artificial Sequence
  Synthetic sequence.
SESDEVIRDLARLLDELARHVDDSVRRMDEVVKRSRDHMVLHEYVNAAGITEVEKKPGDERVERMVAEIERLVAEVLEELKKKYEKLKREVEENLRRLEETVRDIVEKARKVTEKGVSKEKIDRIIRELERILEEAKKKHEDVLRRLEDSLRRVAELLKAALDRLREIVDRLRR

SEQ ID NO: 15241 - protein, 174 aa, Artificial Sequence
  Synthetic sequence.
SESDDVIRKLRELLEELRTHVEKSIRDLRKILEDSRDHMVLHEYVNAAGITEVRKKPGDEEVRKTVEEISRRVAENVKRLEDLYRRMEEEVKKNLDRLRKRVEDIIREVEEARKKGVDEEKLKDLIRKLRDILRRAAEAHKKLIDDARESLERAKREHEKLIDRLKKILEELER

SEQ ID NO: 15242 - protein, 172 aa, Artificial Sequence
  Synthetic sequence.
SRAETVLKEVTDKIKKLADSSDELLRRNKENIDELRDHMVLHEYVNAAGITEIEKGSVDEETLEELIRRVEAELEAHHRELEKNSREDEKRNRDHHAKLEEEMRRVEERLEREGIDDEVVKRVRDLLDTVRRRNEKVNEDVKRMNDKLRRDNEDVIRRVEKLLRELEEKRRT

SEQ ID NO: 15243 - protein, 178 aa, Artificial Sequence
  Synthetic sequence.
SEAEKAKETIDRLADRVRKLLEEIKRSLDDSRRKSRDHMVLHEYVNAAGITEVDAAKRGSVSEEELERLIRKLKKTLDELRRRHEKLVEDLRRNLERIKRRLEELTREMRETLERLAREGLDEEVLRTLEEIIRRLTKELEDVLREYERELRRLEEENKRVIDKTEEEIRRLADRLRR

SEQ ID NO: 15244 - protein, 178 aa, Artificial Sequence; identical to SEQ ID NO: 15243
  Synthetic sequence.

SEQ ID NO: 15245 - protein, 179 aa, Artificial Sequence
  Synthetic sequence.
SEVEELIKRLAKVLKELVDKVRKVIEDTKELLERLRDHMVLHEYVNAAGITEAKDQPIDDEELKEILDRLRKTLEELEEELKKALEDDREEAKRLVDDARRVLKELEEEVREIRERRGESEELDRRIEKVLKEIEEKIREVIKEWERVHREVEELLKRLIDENRKVLDEIRKLLEEKSK

SEQ ID NO: 15246 - protein, 182 aa, Artificial Sequence
  Synthetic sequence.
SELEEIEKKVRELTKRHRELVERVRKTVKELIETNRDHMVLHEYVNAAGITEVRDLERRGEPKEDLKARLEDIIRRLAEDIERVKRETDKLLEELARIIEEVEKEMRETNKELDKEIKDGGLDDKALEEAKRVLAENNEVIKDIKRALDELLKELEKSVRESEERLRRLLEEVKRVIEEVAT

SEQ ID NO: 15247 - protein, 177 aa, Artificial Sequence
  Synthetic sequence.
SSEERLRAVIEDLKRLAEESRKRHKELIDELAKAVRDHMVLHEYVNAAGITVVDDIRRGVSEELLKRIEEVLDEIRKELEENIKRIRKVLDELRRTSEENIARIEKVLRELEDLVRKGGSDADTIIEEVKRVLEELARSTEEVEKRVRDAIEELERSSEELARRIKEVLKRLEEETR

SEQ ID NO: 15248 - protein, 184 aa, Artificial Sequence
  Synthetic sequence.
DEIRKVVKEITDLLKASNDKNRKVVEEIRDLLRKSRDHMVLHEYVNAAGITDLRRRIDKSGDKETAEDIVRRIIEELKRILKEIEDLARRINREIERLVEEVERDNRDVNRAIEELLKDIARRGGSEDLKRVEERAREVSRRNEESMRRVKEDADRVSEANKEVLDRVREEVKRLIEEVRETLR

SEQ ID NO: 15249 - protein, 176 aa, Artificial Sequence
  Synthetic sequence.
STAETVAEEVERVLKHSDDLIKEVEDVNRRVEEEIRDHMVLHEYVNAAGITEVRKGVKGEILAEIEKRLADNSEKVREVAERAKKLLEENTARVKDILRESRKLVKDLLDEVRGTGSEEAAREIIKRLREVNKRTKEKLDELIKHSEEVLERVKRLIDELRKHSEEVLEDLRRRAK

SEQ ID NO: 15250 - protein, 186 aa, Artificial Sequence
  Synthetic sequence.
SEVDEIIKELERLLAEIARENERIIRESRKLADEVRDHMVLHEYVNAAGITRLADAVRRKGSESEEVKKLIEDVLREIERLLKRIEEENREVVKRNSELVERVRAINEEILRRVAELVEKIARDIGDKDEVTKVKKVADDVLAEIKKLDDETRRVIEDTNKKIADLDKATRDVVRKVLEEVKKLEK

SEQ ID NO: 15251 - protein, 185 aa, Artificial Sequence
  Synthetic sequence.
SEIDEVLTRLRKISKDLNETSDRVNERARKIIDDIRDHMVLHEYVNAAGITRLKREIDKTRDRDVLRRILKEIEDVARRVKEINEELLARVEKVVREVEEINRELVKRSREAVEAVKRLLDRGVSDEDKVERVVREVEKLHEEDRKRLEESTRSVRKLLEELKRELEKSTRSVKALVDELRERVR

SEQ ID NO: 15252 - protein, 177 aa, Artificial Sequence
  Synthetic sequence.
SEDEDLDRVAEKLAREHKKSVEEIKRVLKSADEESRDHMVLHEYVNAAGITEVEEARRGNIDEELVERLKKKIEDILRTLEERHKKLIKELREILKRLSDESRRLAEETEKVLEDLERKGVDEEVLKKLAEIVRRVKEENRKVNEEVEKRLRELEEENKKVIEDLKSTVEELVERLR

SEQ ID NO: 15253 - protein, 185 aa, Artificial Sequence
  Synthetic sequence.
SSVEELLERLRRISEENKRRIEKLLREVEKVLRELRDHMVLHEYVNAAGITKVKEEIKSGLPEEAVKRVLERVRERVKEVLEEADRLNDEMRRIVTEVEKELDKSDKEVEDAVRDILKKIEEGVRDRETAERARETLKRLLDENRDRSKKVKEEIRRILEDLTRTTERVKREIAKLLKELEDTAR

SEQ ID NO: 15254 - protein, 238 aa, Artificial Sequence
  Synthetic sequence.
EEDERLTKRVEEIKRENRELLRRLEEEVKELERKSRDHMVLHEYVNAAGITKLDSGKGSTELLVEELEKLIREILKLSEDHNRTLEEVVRKIEDVLRANLERLKELVDEILKALKERGKGDSEELKRKVEKVARDYERLLRKLREVVKRILDESKRLDEELEERLKEVLKKLEELIKRGGPDKDVLTELKRILDELLKLVEKLIRRNLRLLEELLRLVREILRTSNEILEEILKDARR

SEQ ID NO: 15255 - protein, 238 aa, Artificial Sequence
  Synthetic sequence.
SKEDKARELEKRLRDNLKKLEEVVRELAEVLKRNLRDHMVLHEYVNAAGITLLDKLRAGGLPKDELEDLRREVEDVLRRLEDLLRKLKKANDESLTRLEELLRRAEEENRRVLTTLRELLRGNGDDRDLARLVARLVEANNRALEELLRLVAKNVEDNNRVLEELLRLVKELAKRLLGRIRDEDLVRDIRRELKELEERARKILRDDERDLRALEKRIRDIIREDREELERLKERARK

SEQ ID NO: 15256 - protein, 243 aa, Artificial Sequence
  Synthetic sequence.
KREDILKKLEDIIRDIIDKLRRILEKVKRLNEDIIRDHMVLHEYVNAAGITLLKRIADKSRDRELEDILRRVLEKLRRSLDKLRDTLRKLKEETDTVLERAERTLKELKDRLEKLLRDGEKVSEEDLVEALKALIDELRKVLEDVIRVSKELVERLLRALREHLETNKRLVKELLDALRKTTGDDEEIKRLKEELERRHRRLEEEVERVARELEKAHRDLERDIRRVAEELKKLLKKLRDDRR

SEQ ID NO: 15257 - protein, 247 aa, Artificial Sequence
  Synthetic sequence.
SEKEELLKLIKRVIELLKRVLEEHLRLVEDVIRRLRDHMVLHEYVNAAGITDLKRLLDEVRGDKEELDRIKEKLEEVLERYKRRLEEIKRDLERMLEDYKRELKRIEEDLRRVLEEVERIATRGEGPAEALIDKLRKILERALRELDKLSKKLDELLKKVLEELEKSNREIDKLLKDVLRRVEEGGASEDLLRKAKKVITEVREKLKRNLEDVRRVIEDVKRKSARILEEARRLIEEVERELEKIRK

SEQ ID NO: 15258 - protein, 238 aa, Artificial Sequence
  Synthetic sequence.
SEAEKIREALETNLRLLEELIKRLKEILDTHNELLRDHMVLHEYVNAAGITLLEEGGLDEEVLREVKRLVDELRKEARRVLDEHEKLVRKIKKEAEDVARESEEIIKEVEDKLKGLDREELLERVRRVLKKSDDLIAELVRRALKILEELTRLLAELLKKVVEILRRIVELVERVLTKKGAPKEDLERLRRKVEELEDRLRRLLEKLARDSAELMRELERILDRYARESEELDRRLAE

SEQ ID NO: 15259 - protein, 247 aa, Artificial Sequence
  Synthetic sequence.
SEAEDLEELIKELAELLKDVIRKLEKINRRLVKILRDHMVLHEYVNAAGITELRKGTVEDKDILRDLERRLREILEESDRLLEELKRRLEEILRKSKELLRRLEEVLREILKRAEEVKRSNLPKEELIKEIVKLLEELLRVIEKILEDNIRLLEELVEVIKEILEKHLRLLEELVRVIERILREVGKDKDEAERRRRELKDKLDRLREEHEEVKRRLEEELTRLRETHKKIEKELREALKRVRDRST

SEQ ID NO: 15260 - protein, 240 aa, Artificial Sequence
  Synthetic sequence.
SDKEEIKRRVEKTARDLETEHDKIKKRLEDTVRDIRDHMVLHEYVNAAGITKIEKTLREGDGDATDLVDKLLETVKRLNEEVLRTVKKIADELRRLVEEVLRVLRESNETLARLLEEGNVGDEVRERLEEVLRRTEEIIKTLEEIVKRLLDELRRLVEELRRISKKLKDELDKIKEKGKDEKRLIEEVVRLLRENLDVVRRILEALAKLIKELLEALEEVLRRNKELIRELLRVLDEALK

SEQ ID NO: 15261 - protein, 240 aa, Artificial Sequence; identical to SEQ ID NO: 15260
  Synthetic sequence.

SEQ ID NO: 15262 - protein, 248 aa, Artificial Sequence
  Synthetic sequence.
DEDRIIEEIARLLEELLRELLELIKKLIETNRRLNRDHMVLHEYVNAAGITLLDRLVKKGISDEKLKRIRERLKRALDDLERLHREINKRLEDLVRELEKLVREILKELKDALEELRRASARAGGEEVLRRLEEIVKKLLDLVRRILERLKEIHKDNVRLLRELNERLTRIVEDLVRLIREILREAGVDEKIAEEIERELEELRRMIKRLHEDLERKLKESEDELREIEARLEEKIRRLEEKLERKRR

SEQ ID NO: 15263 - protein, 251 aa, Artificial Sequence
  Synthetic sequence.
DEEEKIRTTLDLLRKLLKVLREILEELIRSNKELNRDHMVLHEYVNAAGITLLKKLADDGGVDEEALRRIKKRLEDLIRTNREIEERIDRESERLAEELRRILRELEKELRRLIEDLKEVLKRGLPREELLRRLKKVVEDVLRILEEVLRVVDELDKENVRLLREWLERNKEIVEEVIRILEDLIRKGGSESEEKVRDTEKKLRDLREKHAEIAKELERLLRENRRRLEELAREAKKVLDELRKRLEDERR

SEQ ID NO: 15264 - protein, 238 aa, Artificial Sequence
  Synthetic sequence.
DADELLRRLAEEVERVIREAEDLLRRWKETIKKVLRDHMVLHEYVNAAGITVIRELTKTKGDEELAKLIKDLLDTNEKVNRDLLRLIKKLLKDAERVNRRLLELIEELLEELKRVAKDLGLREEADKKLRDIADRARKELEDYERRLKELLKTVEDALRKAEEDSRKLKRDVEELLERGRLRKDDLEDILRKNLDRLRKLLERLREILRENLEALKKTLKRLEDVVREILEDLKRERK

SEQ ID NO: 15265 - protein, 231 aa, Artificial Sequence
  Synthetic sequence.
DKAEVLREALKLLKDLLEELIKIHEESLKRILDLIRDHMVLHEYVNAAGITLLERSGLDERELRKVERMATESLRTIAKLKEELRDLARRSLEKLREDLKRVDDTLRKVEEKVRRTGPSEELIEELIRTIEKLLKEIVRINEEVLKAVRELLKTLLKLSEDVVRRIEEILRKGGVPEEIDRELKRVVEELRRLHEEIKERLDDVARRSEEELRRIIKKLKEVVKEIRKKLK

SEQ ID NO: 15266 - protein, 236 aa, Artificial Sequence
  Synthetic sequence.
STREKAKKVLDTLRADNEDMKRVVEKILRALKRTNRDHMVLHEYVNAAGITILKEVGVSEEALKEIEDTLKRVLEEIKRLLDESKKLLEDVEREIREILKTSEELLERIEREIETVGSDEKTLAEILKRLLELNEEMNRRLLKILRDLLRLNEEVIRRLLAVLERLLDALKEALDRGDVPEDLLRKLEEELRRIKEKLRKALEELEREHRELEKELDKLHDESRKEHERIEEELRR

SEQ ID NO: 15267 - protein, 247 aa, Artificial Sequence
  Synthetic sequence.
SKAEKLLKDLREALEKVKRRYEELERRLDEVLKEHRDHMVLHEYVNAAGITRIEEGGLPEEELEKLKKLAEKVKELLRELLRLSKELVDRVRELLKRDLDLVRRLVEIALKVLREAREQPNDEKRVEKIKRDLEKKARRVREENERIKRDLKRTADESRKRLEKLLEDLKRELDRLREDLDRGRKDIDERVEELIERLIRIIERLLREVIKSHEKLVRTIERLIEESIRVNEELLEVIERLLDRARK

SEQ ID NO: 15268 - protein, 247 aa, Artificial Sequence; identical to SEQ ID NO: 15267
  Synthetic sequence.

SEQ ID NO: 15269 - protein, 231 aa, Artificial Sequence
  Synthetic sequence.
SKEEEVEKVLRKWEEILRRLIEENKRANDKIRREYRDHMVLHEYVNAAGITVAERLGVSEEVKRILEKLIKLLEDILEYEKENVERLIELNERILRELKKSVEELKALVTRVRRDGLPESEVRKLVEDVLRKNEELLKEAKKAWRDSIENLKRVLEEVAKLVKTVLREIEEKIDDEDVVRALIEVIERLLRVAEEVIRRILKVNTELMRVDERSIRESLKAISEVLKVLDT

SEQ ID NO: 15270 - protein, 231 aa, Artificial Sequence; identical to SEQ ID NO: 15269
  Synthetic sequence.

SEQ ID NO: 15271 - protein, 231 aa, Artificial Sequence
  Synthetic sequence.
SKDEELARLLEELVERWRKIVEDLERDHRRLVKEIRDHMVLHEYVNAAGITRIRKNGIDERIVRLIEEIAKIIEEVLKEIVKLVERAVRENVRVLRESVRLVAELVETLARLLRGSDERVTEAIKKVLDTSEDLIRRVIKVNEDILREIAKLVEEVLREAERILTEIKKEGDREEIRRILEELKRIVDDVLRIIARILKLLRDLTRRLAEVAKAVHKLLEELLRKLKEDTR

SEQ ID NO: 15272 - protein, 231 aa, Artificial Sequence; identical to SEQ ID NO: 15271
  Synthetic sequence.

SEQ ID NO: 15273 - protein, 237 aa, Artificial Sequence
  Synthetic sequence.
KEKEDALKKLEDLARKSREDLERVLRKHKKILDKIRDHMVLHEYVNAAGITDILRKTGTESEILKELARLLREHHEALRRLIEELRRLLEEHHKILEDLAREHKRLLDELIKVVADGVDKDELERIIKELRERDKKLVDDLRKVSEDLLDAVRKLVEDLERISRELLRRVEELAKGIDEELAREVERVIKELLDKSKEILERIERAIDELLKVSEEILKLSEDASEELLKILREFAK

SEQ ID NO: 15274 - protein, 237 aa, Artificial Sequence; identical to SEQ ID NO: 15273
  Synthetic sequence.

SEQ ID NO: 15275 - protein, 229 aa, Artificial Sequence
  Synthetic sequence.
SKEERLREVAEKHKKDLEDIVKRVDEAAKETARRLRDHMVLHEYVNAAGITDLEKGPDDEKLKKVKKILKDIMDRLAELIKKILKLLKENLEKIKELLRRNLEISEELLKLAKGLSDRDVLETVRRVLEKLDEEWDRVLEDSRRIIETILRELDTLLREVEKLIKEIKDEISGSKEVLDILERAVEVVRRVIKALKEVLERHVDATREVIERVKRVNKRLLEAVREVVT

SEQ ID NO: 15276 - protein, 229 aa, Artificial Sequence; identical to SEQ ID NO: 15275
  Synthetic sequence.

(The sequence listing continues in the following parts.)

What is claimed is:

1. A molecular feedback circuit, the circuit comprising:

a signaling protein that, when activated by an input of a signaling pathway, drives an output of the signaling pathway, wherein the signaling protein comprises a degradation-based switch polypeptide; and a regulatory nucleic acid sequence responsive to the output and operably linked to a nucleic acid sequence encoding a key polypeptide, wherein the output induces expression of the key polypeptide in a eukaryotic cell, wherein the degradation-based switch polypeptide comprises an amino acid sequence selected from a group consisting of the amino acid sequences of SEQ ID NOs: 1-25, wherein the amino acid sequence of the degradation-based switch polypeptide comprises:

a first domain comprising a degron;

a second domain comprising five alpha helices; and a third domain comprising an alpha helix, wherein, in the absence of the key polypeptide, the second and third domains form a three dimensional structure comprising a six helix bundle to sequester the degron and prevent the degron from triggering degradation of the signaling protein, and wherein the key polypeptide comprises an amino acid sequence selected from a group consisting of the amino acid sequences of SEQ ID NOs: 46-49, and wherein the amino acid sequence of the key polypeptide comprises an alpha helix that binds to the second domain with a binding affinity that is higher than the binding affinity of the third domain binding to the second domain, and, when expressed in a eukaryotic cell and bound to the second domain, modifies the three dimensional structure of the degradation-based switch polypeptide so that the degron is exposed and can target the signaling protein for degradation, thereby inducing degradation of the signaling protein in the eukaryotic cell.

2. The circuit according claim 1, wherein each helix of the second domain and the third domain are each 30 to 50 residues in length.

3. The circuit according claim 1, wherein the signaling protein is an intermediate member of the signaling pathway or a transcription factor.

4. The circuit according to claim 3, wherein the transcription factor is a synthetic transcription factor.

5. The circuit according to claim 3, wherein the regulatory sequence comprises a binding site for the transcription factor.

6. The circuit according to claim 5, wherein the regulatory sequence comprises a plurality of binding sites for the transcription factor.

7. The circuit according to claim 6, wherein the plurality of binding sites is 2 to 10 binding sites.

8. The circuit according to claim 3, wherein the output is expression of the transcription factor.

9. The circuit according to claim 3, wherein the signaling protein is a receptor and the input is a ligand for the receptor.

10. One or more nucleic acid molecules encoding the molecular feedback circuit according to claim 1.

11. A yeast or human cell genetically modified to comprise the one or more nucleic acid molecules according to claim 10.

*     *     *     *     *